United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 49

SEQ ID NO: 765 - DNA, 1169818 bp, Homo sapiens
caacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtagggaagaggggctgccgggcgcgctctgcgccccgtttctgcattcggatcgcccggcacgggcagggtgagggggctttcggggggtcggggcctccggtcgcggcggcgaagacagatcggggctcggtagggaggtcattccgagcccagagatcctaggcaccccccacacacaggctcccactctggcgtgcgtgtgtgtgtgtgtgtgtgtgtgtgtgtgtgtgtgtgtgtgtgtacgttcgttaacgggaggaggagagagctcccagtccttttttgctagcaggggcgacattctcgcccacatcaagtggggtaactttggttccctcctccggaggctcggtgcattggagaaagactcagttagaggcgactccaacgagccgcggttttccccagcccaacgcccagcggccgaagcgctgctcgggtccggattgcgggatgcggggctggagaggccgagcaggcaccaccgacttcccagggcgcccgggccccctggtacagcccggctgcccgctggaaggcgcctcggggcagcagagagcctcagcccggctgctgctgtcgctcaaaggcgccggcgccggccgcacccgcatcggggtccttttgctcccagaccccgggcccgaaagggccggagcgtgtcccccgccagggcgcaggccccagccccccgcacccctattgtccagccagctggagctccggccagatcccgggctgccgcctctgctgccttccctgagcgggagcggagcgcagagaaaagttcaagccttgcccacccgggctgcagctgcttgttaaccctcagagcgccacggcgcgagggaagggcacgccaaccaggagagggggcgagggagatgcggtccgcctgcagtcacctctgcacctcagagatttcgggaagtttgagtgcaggaaagcagcgctccgaggccaggcctggggtgctggccgctgcggggggcacgccctgcgctgctcaggggcctgtggtttcggagagcaccccgatccagtcccccatcgcctctctggcaggcgttgggacttggagtgagctggcagcctgcaagtgggtggataagagccagggcagggcagggccgggcagagtaaggagggaaagagacagggagtgcctcagggtgctaggaatgagtgttgagttcctggccggggtagaggctcaggtgagagtttgcgggtgaaaggcaggggaagggagttgggttcccaggtagggactgtctgggatggggagactggtgcagacttctaagggagaccactgttagagcaatgttgggtttagactttggaaatgggctaacatctcagaaatgcagtgatgggtgatagtaccaggggagattcaagtgcccggctgctgagcccgctcccaagctcctgacttctttcttggatatacagtcccgattaaggactgcccagttatagctccttttctaccaggcttttctggttgattatcttggggtccctacagccttgagtcttgccatggatcccaagcctggctgtgaaccagttttccagatgtcctgtaccctagagaccccaaggctgtatgtgtgtacatataccccaatttagcaaggcggtttggagcatgcctcagacagaaaggattcagacagatccttcctgccatctgctagtggtaccaacccgggcaagttgtttaacctctttgagcttccaagttctccattgtaaaataatctgctgccttcctaggactgctgagtggataggattgcattcaacaggatgtcctatgcaatgcatgccagtctgggagctgtcggtgtctgagagcacttaccattgccttgtccaggacttcacagtcctctttctttcttggcaggtttcaacctcagttcatattccagggcttgcccaaagttatgcctcctttaaagcaagacagaccacgtgacagggccccaggatcgatttttatgcactaagggctctgcgcacggttctttttgcaaatgaactggtgtgtctcctcacccagggccaggctggcacaggtgggttctgaaggctcactctatttatttagatgaaggaagcagagattttgctgtgaattgaaatgattgccctgagaggcttatttctattttcaattgttatgcatatcagagcaaatgtccacattaggatagtaattgatatcctggtagcaatagtacctcacagagaaatcattttgatgcaatccagttaaccagcaagaagttcacgtgcagaactctgtgtgccatagaaaaaagtggggaaagtcttcgaggccttgagtcgacgagcaaaaacacaactttcctgaggcagagagaaaacagaagggaaaaacaatgtaataaaacaaattagtcactcggccctggtggtgttcaggcaagcctgtatgtttttttccaccacagttgtaaagcatcgggtctggctttggaagccatcaatctctgtaagcttattggcttggttgttgttttaggcattttggtaggaggtgaggaattctaagcaacaatgactggaagctggcaccgttgaacagtcacctctcctatcccctggggtgttttgggaaagtctgtcccagaagtggcttctggaatttgcctatgataagtaatgactgtgaaacaaatcaagaaagaaatgagcaagaaattccatggtaaatgtgattcccctccctatttgggtagcacttacaactaaccaaaagttctaacaatgagtgagtaatcccccaagaattaggaatttagggaggggttcaggcttggaggacagtcgcttgggagtgactgaaaatgttccatggaattctgagatttcgctataaagtggggagttctctctaggggtcagagtcttgattttcaggattttcaatgagaatcagtgtcttatagtgctcctgcaaatttgtgtgttatgttttaagagcagtgtttatttgcagaactttttggatgaggaaaaggacacagggttgaagagggtgctgccccctccccccctagggtcaatacatgacagcctgtaagatttccagagcactagggaaatggaatatgtagtgaaaggagtcagtgatagagttcacctgtctgaatatttttttttagcaagtcccaaaacaggtttaataaactgcaaagctgagtatgtaatctggaatttgtgtaattccacagtctatactaaaagccccaacagtcatcttagctgatcgctcctactctgcctccctcccttctccccttttctatctttagcccttgggttttccgttaagtaaaatctgtttacttccagaagtatcctctatgtgttatagtgaaattgcccaacaaaccaacatactcaataactgcattatctaaaagcatcagcacttggatgtgtaaactgagcctcaatctgaagttcaatgtttaggttaaagtgtagctaggttcttgaaaacatccttatttccttccaaaaatacaattgcttggggagtctagttaatttatatttagtggaatgtaggaaaaggacaaactatggatttaatttacacctgaatgacagtcatatcatctacgtagccaacagtgtttctgtgtgcgcgtctgagtgagtgtgtacatctctgcattttgatcttgtaatacctgttgaaaaatttctccagaagagggctccatccacagcattacaaaattctgaatctacagctcattttaaagaacttcaatgcagcaactccatcaaaacaaaactattctccttattccacattaattgccacaatcacccccaaatgagaaatcctgccatttttcactgtatttatttctgtgtctctctctttcttgctttccttcttttgctctcttgctttctcgctagctttcttcttgctttctttcttttcccctattgtagttggttctgttctaattcattctttgactctgtatcccctctgagtattggagcagggaaaatttcaaagatgtttgtagacggtgcaatacgcaatgtgaggaagttctgaaatttcctggcatttgactttggttggacttgatttcattctttaggtagccaaaaggcaggaacagttctgcctgtggaaggagataaccttcccccttacataaccacccagaagggtgactcctgagctaggtccactcactttccatcactcattgaaaaggagaaggaaatatccccctgtcatccaattacaataatcagctggacagaatcaaaccaagtgaccagtggttttggcattgtttctatttagctgtcagccaggtacccatgcacctgtgagaatctgaccctcctgaaggatgctgccaatataattccccacagcccgcttcttctgcagccacctgggatcccaggcctggctcctcaggtatgaacaggctgcacagacaatgaatggctgggctgtaggatctcttgctcctgcagtaggcactcagcagtggccttattctagagttagggtggaaagtcatctttctctgctgagagaggcagcttgggggaaggcaggagaggagaagaaaggacatttctaacttgaagtgctgactgagccagggtctgtggaggtgaatgtgtcaccctctggcttagcaagttgaacctcgagacatctgcttggtggtaatggaactcatctatcccaaacctgcaactctggcttctgggcagaggttgccaagtagcagccacaggctaaatttagccatggatgcagtttgtttggctcaaatgttttgcaaattgtacattaataaaaaagaaatccaggtttctagcatttctgaaaaagtcaggtcaggcaaccctagatccacacttcaacatggccgtacttgacagggctgagtcactactgccctctttaggcaggacgtgcctccgtagcttgccataatcgtcaccactctctactacccagccttctgtgctcactaattttgcctgcttgcccctagggctttttgagtttgggacctctgctttcacaaatgttgaggtttgatcaaattgatgcagtttatttctcagtgatggactatttggaaagggagggactggccttttctccttccctgtgattgaattccattgatgtgtgctttggaacagcatgaccaaggggactgcagcccctccctgagcacattactggcagtacttttggacaggcacccagagagacatagcacccagatcattgcttcaggtgtaagagtcatgcagagaagtgacacgctgcagctctgagtcagtacgagccctggcacaccagtgtgttggtacaaaatgtcatcacgcaccagcagccaagggactctgaaaccctgggatcatatagaggcctgcataccctctctgtcagcagtcctcaaccattttggtaccagggaccggtttcgtggaagacaatttttccacggactagaattggggggatggttttgggatgattcaagcacattacatttattatgcatttaatttctgtattgttacattgtaatatataatgaaataattctacaactcactataatttagaattactgggagccctgagcttgtttttctgccactagatggtcccatctgggggtgatgggagacactgacagatcatcaggcattagactctcataaggagaaggcgacctagatcccatgcacgcacacagttcacacaggattccaactcctatgaaaatccagtgccacggctgatctgacaggaggcagagcccaggcggtaatgcgagtgctggggggccattataaatacagatgaagcttttgcttgctcacgggccactcacctcctgctgtgtggcctgatttctaacaggccatggactggtactggcctgtggcctggaggttgggaacccctgctctacgtagtgttctaccaagagcatggctgtccttggagaacagtgacagctgagcatcatcattccatgagtgttgctccctcacggtatagacataaccagaacgtcacaataacttactctacttagacttgccaaggcctccgggaacactgctctaatattcagcacctttgtaacttcaggataaagctgaatctgcagctctgtcacctactttttttctttgagacggagtcttgctttgtcacccaagccggagtgcggtggcgcgatgtcggctcactgcaacctccacctccagggtttaagcaattctgtgcctcagcctcccaagtagctgggattacaggtgcccgccaccaggcctggctaacttttttatttttagtagagacggggtttcactgtcttggccaggctggtcttgaactcctgacctcgtgatccacctgcctcggcctccccaagtgctgggataaacagacgtgagccactgcgcctggccaagtacccttatccataggacactgtcacatcctagcaccgtcctggagcttgtgtgatgtttttatatctgttttaacagttaacacccacggccgttctacatacagtgttaatgctacaattaatgctctctggctctgtaaatactagactaatctgtctgcctcatcccataccagcaggtgagcctcagatgattcttgttttccatagctacagaccccaaagatcagagtaaatataactccatatacacatatgaaaaaaagtgattgtttttcctctgccagttgccaacagaagtcaaattctagaaaactaacattaacaacaggcacgttttgacttgtcatgtctcatttcaaagacaccaatgagcatcacccgatctgctgcagaggcacaaagaccctgtgtctcctagctgaacgcagcccgggctggggcggagggcagcagctgctcagccatcaacagccctgccacatgcctgggcagggcccggaaatgagctcagcctctggaggagcctggggaatggaaggaaggaatgtggcagcttccatccttgccttacggggccttcaggccaatgtctctttccctcaaggtgtcagggaaccgctttcttgtgttgtgtgctgcaggaagaaggtggtggctgcagacacctgaagcttgagcttctgtgattgtctccctgtggactgattgctgtagggcctgcggaaagttgctggacactgccagcggaaccgaggctgactcagactgcccggagtatccctcctcaactgccatcagccgtcgggcatctgggatcatctcactcaggggttgcaaattatggcccgtgagccaatttctccctgcagtctggttttataaatagttttattggattatagccacacctattcatttatgtaattgtttatggctgcttttgtgctataacaacagagttgagactgtctggcccctgaagctgaaagtatttactatttagtccctaaaagaaaaagtttcctgactctttatctaacttaaagttacagccaaagaggcttctgggcgtcttctcaaataagaggggcctgagaagttcagccgttggggacttttcctcctaggccccaagcacttgagcaacttgacttcagggagattcacctgagaccaaatggttccaataaatatctatgatctctatggaggatctactatgttccaagcaccacttgtgtgtgcaggatacagttgctcataaggcagactgagtctctgctctcctggggctcacagcttggcaggaaggatcaatagcaattaatgaataatttaagatggagacaactgtgatgagggaagaaagcccagctgtgtgaggtcatgccgttctaaatattttgcctaggtgttctttgtctttctcctccactagactataagctctgttgtggtccacattgtggcttgatttgttcatttctatactcccagggcttagaacagtgcctggcacatagtactcagcaaacatgaatgaacaaatgaatgaatgaatataagaaagacatcagaggcagatgaaggatctgggcggcttccctgacaacctgatgcttcagcccaaatctggaggagcagtagggcttacagacaaagacacagtagagggtgtgggtggggaaaggcattccaggaagaaggcacagtctgggtgaagcctctattcaggggaaacaccacacagccaaggcagtgatgtgaagtgtggctgggaggtgccagagccaatggggccatgtcagccactgcaagaatattggtgtttttctcagagcaagtggcagccattgagggtactgagggaaaggtacagagtgatgtgatcagatttgcattctggctacaagtagcaaatgggttggagctgggtaagaatggaaaggaaaggccagtctagggctgagatcatgggaagctggattcaggaacgacggtgcagagatggggcaggtgattgaagtagactgatatggtttgggtctctgtccccacccaaatctcatgtcatattgtaatccctaatgttggaggtgaagcccagtgggaggtgattagatcagagggcggatttctccttgctttaatcgtgatagtgagttctcacaagacatggttatgtgaaagtgtatagcacttccccctttgcgccccctctctctcctgcttgctgtgtgaagacgtgcctccttcgccttccccttctgccacgattgtaagtttcctgaggcctttgcagccatacttcctctacagcatgcagaagcaagccaattagacctcctgtctttataaattacccagtcccaggcagttctttatagcaatgcaagaatggactaaatcctattcagataatccaagagacatttaggtggataacttgacaggctttgatggtggctgggtatggagatggcagggccagagagaggtgaaggaggcctgcttgagttctgactcttccaattggcaggaagagtcaaacaaggagaccaggtgtttgacattgtaaacagggtcggtctgagggcttctctatgtgggagtgtaattcaggctgcagaacgttcctgggagaggcacctaaggcctgcattacagtattgccagcagatccagtccatgcctgcatctaggatgggcaccgtgggggcctggaaatgcccttgaataaagtgaccgacgtgcagcctgtacaattaaccaatctctgagacttttcatgcacaagatatttgagagaaacattgccaagccctttaatcgtttcttgaacattcaatcagcagcactggaaatatgtcttacatgaagcaaataatgatcttctaccctcagcaatcgctttgccaatgctaacaagcctctgcttcagcatgttgggtgtagccttggtgacttctgtttgtggtgtagtaggagaatattcaactgggtgccaggcagtggtatattggtaaatgtttaacaactgggccactctaaagaaacacccaaaccagaaagcaaaacccaaaccaagacacaaccaagtaatttgtagctcttgccaatttctgtgatgtaaatactcccgtcatgggcaatttgaatctgccaacctgagagtttcctaaaaacttaacaaggggctcttgctacctgatactaactggctccagcacaccatggacctggatcctgtttctagctcaccccctcactcgtggtatgaccttcagcaagcagcttgaatgttttcatctgtaaaatggaccaggttacttggaggttcaagtgagtaaaaagatgttagaatgcagggaagtccaatttgctgcaaagatgcatgcagattatctaaatcattatcacttacaaggaaacaggacctttggccaggatcctacagctgtctaattgggccctgtaaaaatactttgattcagccactgaatgaagtttgatgtgtgagaaacagagggtgtacctctgcttcctgcagttctgcatgtttttgcagtaagaaagattattgcgttctgtggcagtattgattccgaacgtgtctatcttgtttttctgctttcccttcttttcttccttttctcaacaaagatatttagtgagtgctgtatgccaggcactcacctaggtactttatcctcagaagctgaggtctgtacagttactgtgccttttttttttttttttttttgagacggagtctggctctgtcacccaggctggagggcagtggcgcgatctcggctcactgcaagctccgcctcccgggttcacgccgttctcctgcctcagcctcctgagtagctggggctacaggcgcccgccacagcgcccggctaatttttttttttttgtatttttagtagagacgggttttcaccgtgttagccaggatggtctcgatctcctgacctcgtgatccgccagcctcagcctcccaaagtgctgggattataggcgtgagccacagcgcccggcctatcgtgccctttcaacagatgaagaaactggtgagtttaaggaactgacccaagatcacagaataataagtggtgagctgggatttgcacctgggtctgtgcgtgggcgagtccacctggggcccgtgtcttcactcagcgagtatttattgagcatttagggaattcagaggtaaacgagatgaactgaatccctgtctcatggagcttacagttttgtgggaacagcagataaaaacaagtaagtacttgaaataattacaaatgtggtaattgttacaataggaagcagtagaggctgaaatccattgaagggagaagaggctgctgtgccttcctttgctcctttgcttcctttcatctgccttgcctccctctttctgctgtctttctttctttcttcccttaaatgttacctaccaactatgaagaacgctgcaaacctgggaacccagaggtgaacacgacagtccaggccttcactaggaaatgtgctggagcagaattagagcctggggctggcctggacccagagctgctggtgccttggactgcttagggactgctgagcagacctcctagccctttagaagtgagcttgaatccctgcccagccatttacacactgtgttgcctcagataattgacttcatttccctccttttctgttttcccctgtattaaaacaactgaaaaggaatatctatgcttgccctgcaggatttttgtgagaattaaataagtgtatgttaatgatgtcatcctatgcttaagaaatgttggttgtattacttttcaccctatgctccaaggaattttatggtctgaaggtgtcatggggtcttggctttcaggatgtgactcacttaaggggggaaatgactgtgcatgtcataatgcgtggacattaaaaaaaataaagtttgctccccagggaggatttgccaattcccatattagtaggtcccccaagattgttcccctcgggattcatgcctcataaaatcatttgatctggtgggatctcatcttcttaatgtgtctgcccatcatctgttcctgggaggctttattagggcagtgtgtgcgtgtgtgcgtttgtgtgcatgcacgcaccagtgccatgagtacttgtttaaagtacctccatgtaaccacaattcactgtagttgctatgcactagttacccatgttatctggaatccttcctgcaacccttagaggcgactcttattcccaattttatatacgatgagaagaagttttgagtggtggagtcatttgctcaaggccacacagtcactgagaactgggaccagggtttggacccatgcgtctttattcctgtgcatatttattttcctctatgttgcactagtatataaaagttgcctttcccactcccctcattatataaaaattctttcctttgtctattttgttctctacctcccttaaagtcaagatagctgcctgggatgactacttttttgagttcctagtctctcaaagtgggtctgggccctggacttcctgtctgggctactgattgcaaccttcagaacagggtcagcccggggtcatttgtgttctttgtctccatgtccttgcttttgaccagggccaaacaacccacctgcactgcatggttcccccagcaagaacatcccagtgagaatggcccacagatgcctgggcgtgacccacctgcagcttcaaccatgcaggtaaatttgcctgctgctgtgtcgtgtggctggatggaattcttccctagggatgctaagaaaccctgttgcctaagtcagtgcttcctgcaagctactctttgtaattctttccccaaacaaaaagaaaacaagaaatatacagtctgtagctatatagagacacctggatctatattgtgtggcaattggattgaatgtaacttgaagtttatttttgtcttaccagactagtgttttttcctgttaatttaagtgctttagtgagggttgccattgattgagcaaacatgtgttgagtgcttattatgtacccagctccattttccgtactagccacagagcagcgagagcatggcctttgccctccaatcctgttctggtggacagacactctctcccttgacagggtcctcaccactgtgtgcaccgtcccgccacctggtggccgtgcctatctgtgcattccctatttggttaactcattcacttaacaaatatttactgggggaagacaatatctcaagcacaattctcagcattgagggaggcagcagtgattaagaaagacaagattgcctgcccccgtggagtttgtgttctgatagcagagaaagacaggaaacaagaaaaataaataaatatggtagttttgcgtagtgatagtgctatagaaaaacgttcaaatggggtagagtgatagacagtgttgttctgagcttgtccaccacaccctcttgggacagaggattctttgttctgatggaatggcctttctatagcatagagatgaaatgtgctaccgtttgtgaaaggaagttagtaatacatacatggcatttttgtcttcactgataaagtgttgttggtcaacttttgtcaactctctactttttgtttgtgttgaaattttactgttgggaatttacgaatatggcaactaatgatttaaaccaggggtaggtatcctttttctgtaatgagccatctagtaaatagctggtttctcttgaaactgttcaattctatccgtgtagcattaaagcagccacagccgatatgtaaatgaatgggcagggtaataaaatgttatttacaaacacaagcagagctagattggtccttcaggctgccatttgccaaccactaatctaaaccagtagctgccttaccagttggtcaaacttgtttaagacagggatagggcagaggccagcgaggggaaccaggcattctctttggcctcagttgccatgaaaatcatggtacttctttagggtcacatatcactagattatttgcattaacttttatcaaggtaaagatgctaatagtcaactatggaacataattctcagagtagatctaacataggaataatttagctttgtaatatttatctggactacaatttttaaggcacttttgctacccaaaagtatcttggggttaaacacgctcttggattgaattcctctaaataaatagagacacagaattgggttcagggggttaagttggtaaatgatctcaaggtccataagtgagcgagtggggagagtgagaccaagaagaaggaaagccagcaagccaacagtgaatgtgtcattgaggtggtcacagtcatgggaaactggcttcttgctgctgggtctctacaaaagcactgtgtaaagctcatttccgaatggtccctccacagaataggtggctgagggtgtattcactcgcccttatcttctgctggtcaggggtgacccctgccgtcattaacttctctgtgcttccctgctgagcctttgctgtcatggggagcagtcatgactttggaagcatcatagcagaaaaaatggaaaggtatggcaagttgttggactgtcaggatatgccctgggtagggtatgaatatatgtgatttctcttgccaccattacatgttactggaaacttcctcagtagagctaatggtaacagaaagaattatggtagtggtaatttttaaaaccttctgaatttggttaagcaccctcctgcagatattctctttcccactagatggtaccagtatgccaaagccctagaatgctaccttagggcctcgtctttgacatgtgatatattctcattacttttcaacaatgaatgaataagccagttgaggtcaaaggaatcaactatggatgttttagggacaggagatgggagaaaagtggaggctgtctaaacagttaccctcattcacgcattcagtcatttatcaacaaatattactcagcactgactgagtgctcaacacttttctaggcactgggaatacagaaatgagtaagacaggccaagtccctgctctggtgagcttatgtactggctgggagagagacaataaaaaaatgaacaggtaggtatgtgatgtctgcaggagggtgatgagtgccatgaagaatgagaaagcaggcgagggggtagatagcgacaggcagaggtcatggcgcttgccttcgctgttggctgtagggtgagagattattttcatctgcttcccaaacccagttcttccattcaccaactccttatgacacccctatgcggtttatttttgaaatgaaactaacagctcatggagggcaaaaaaaaaaaaaaaaaaaaagtggtgcttggcaaatgtgtgttcactagtcggggcccactgcagcctaacacctaactcattggactgcttgttggctgatttaatttgtctggaatatttctgaattactattgttgttgacacacaatagagttgcatttaactcagaggttagactataaggtcagggttttaggcaaacacagttgtcattagccttgaactcttttaagttgcccattaaagtacagtaggcgtggtttagtctatgcatccccgtattgtaatcaatagggaacaatgtataatgcacgcagtaatgtacagggcataataaagaatatatgcaagatataattttatagcatttaattgcagtatttacattgttctttttctctctctctttggtgggagagctggctttccattagttaaatgtgcatatgatgagacttgactatattcatttaagccacattcctaatcatacaatctccaccagactgtgcattacgtaaggcaagacctgttttctctgttgtgttctgtttatctttggattcccactaccagtcagatgctttggggtgggggaattgaggaataataatagtagaagtggcagtaatagtagctgatatcagtgtggtgctgattttgaaccaggcctggtgtgagtgcttcagatgcattaatcagcacatgtaatcctcatagtgactctataaaatatcttctatggttttaatcccatttcataggtggggaaacttcaggagaacttagtaaaagaacctaataaagctttaggactctagggctgagattcaaactcaagacaattccagacacacaagaccacatgttgtatgattctatgaaatggaacaaactgtccagaaaagtcaaatccagagacagaaagcagattagaagatgtctagggctgggggcaggaggaaatggggagttactgctaatgggtatagaattgctttggggaagatgtaaatgctctggagctagatagtggtggtgattacattagctctctgtaaataaaccccaaacctgggaatcatatatcttaaccggctaagctttatagtatgttacacatgtctaaataaaactggtattgaataggaaaacaagcaaaccttgggcaggtcagcctcagggctcctgtttgttcatgagcacacaccacctgtcttacagttgttcaccacctgctggtgatactctacttgctttacttatattaacactgcgactcctcaaaagatccccattgtccaccctactgagatcagaaagcggaagcagaacgatgttgagaaacttggggctggcaagtggtagtttcaggattaagacccaggctgtttgggtctaattccttctggctacactggttcttacatgtgtttcattcattaaaagcaacctgtgttatttggaactgcaggtcaccttggcctattggaaataaagcaagggttcttcacgtttgttttgctgatttgtaaagtgaattaagaaccatcttttgcctcactggttattattctcatagtagcctaccctggtgtagagttctggctgcaaagctctcagagactgaagaaaaggagatggtttagtgttactgactttttttaagacagggtctttctctgttgcccaggctggattgcagtggtgcaatcatagctaactgcagccttgaccacctgagctcaagcaaccctcttgcctcagttctggaaatagctaagtgggactacaggtgtggaccaccaggcccagttaattaaaaaaaaaaaaaactttaagacaaggtcttgttatgttgcccatgctggtctcgaactcctggcttcaagtgatcctccaggagtagctggcattacaggcttggctgacttttaaaagtagtaagtggtttaggatggggggtggtatggaggtcgggtggggagaaagaggagagaaatctaattgatatgctaattgtcattgtactcaagttgatagcagattgctgaaggatttaggatttacccaaattaacatgaatgtttggcaccctttggctggtgcggctgaagaattcaatagcctagtaatgagaagtcaatctaaggtctaaggctgggaaaggagctcccacttcttacattcagtgctcatcactctgcaaatcaaggccccccgaactcctcccacccctgccttctgcgtctccctctgtgctctccatcacccccctacggagttcctttgattctcaggtcccttaaccatggaacgtactcctgtctgccctcactcgtgggttgatgatttctatcctttgtcatgttgaaaatgctgagtgacaaagccattagccatgcacagtgaaacaaggaaagcagcctagagctggtccccagaccaggcccagtgcacgagtttgggtgctggaaggggaggctttatggaggcaaagctgaggggctgtacgtgtcttcataggtctccagtctgtaaaagcaaccacgctttgggctggggcagaagtcaggacttgaactggctctggctgggacccaggctcccaggtagccagctcccaggtgacaggagtccgctgggctccctctgattcttaaagcctttccaggtagcaacaggagatcacgcaaagccacgtaagtgtctgattcagtcctccctggtcagttttccagcatagcgttttgcaaaatgtgttctgaagagatactggttccatgggaggttaatatgggttctggggaaaaaaaattaggggaatcaaaaaattacttgtataaactaatattttggaaaactctggagttagagaagtggaccagattgggttttgttttttcacaaatgaaagtctctgagattgtagtgtgtttcagtttcagagggctcttcccaaacccctgaggttaaggaaactcttgtacacagtgggtctcgggcactaactcacagatcacacttctgaaaacaagctcctaggatgccatatctcagagtacgggcttcgacggggcccttcacccagctccaggaccaactgggagcctgttaggactgcaaatcctgtcctctggacctagagaatgaaagcctctgggggcaggctcagaaatctgtgtttccagattccactgggttttcaactccatccagaataattcttctggtgtcactgtgaatatttgctgatccttctgacgtctatccgtggtgcttgtttctgaagtgtagtctaaaccgttggctctcaactgttggggtgaggggggttgtgaccctcgggacagtttgcaatatctacagacatgcttgtttttcacaacctggggaggggagtgggcatctagtgggcagagctcagggatgctgttcaacatcctacaatgaacagcacagctcccaccacaaaaggttatcctgacccaaatacagtagtgctgaggtggaaaactctgatccaaatgcatagcttcatactcacccagcacacacagggatttttatccttatcttatcctgttattactaggaggctggaatctgaagctggggctgtgaaaagatacctcacagcaagccgctattcatgtataatttttcaaaaggtaaaaccaagactcttgggtaaatacgcacttcaactcattaatttatgaagaaaccagtaagatgccatggttattccaaagggcatttaagaagctaaggtattcgtaaggaatttagcaaagaaatgtgaagacgagattgctgagttagataaaaagtggttaatgttcatcatgcctaaacttttgggggttatctgttctattagataaaaagtatttgcatctctactggacaaaagttgaccacttaagtggtgacttcacaaagtctgggatcttcaagagcaaacaatgagatgaactaagagcatgctcctaaacaacttcaggttgtccctgactgataaccaaaggatgtgccatcaaccatttgggccttgtttgcaagctttgaataatttttctggtgctttaaacacattattgttagtattttgagacggagtctcgctctttcacccaggctgaagtgcagtggcgtgatctcggctcactgcaacctccatctccagagttcaagcgattctcgtgcctcagcctcccaagtagccaggattgcaggtgcctgccatcaggcccagctaatttttttttgtatttttcattgagatggggtttgaccatgttggccaggctgatttcaaactcctgacctcaagtgatctgctcgcctcgacctcccaaagtgctaggattacagacatgagtcaccgcgcctggcctaagcacatgacttttaatttactggtgctgcatggtctgtgaaaagtgggtcaaagaaatgggaagtgatgggaggagaggtcacaggaggccaaggttgtaatatggttagaagccatttcttacctgtcttctatgaagtgtgggttgtgagcgatgctttcattcaaacctatgaggtgcatcttgtcatcatccccatctacagatgagaaaactgagtcagaggaagagttaggtatgtcagtagcaggcatgggcaaaggaaggagaaagtaatgatcaagatgatagagggagaattgcaattaagccagagagaggaaggatgatgttataagctcgagggaagcctgagtccagatctgaagcagatatactcacagcacgttcagggggtaatgaagaggctgttatgggtgactatgaatgtgaaggcaacgtgagattggatcagagttagaaagatgacagttgttaatagcatcagtgttattttagccaaaggactttactattgctgtagtgcagtgcctcgcagtacaccatgacagttaagagcccaggcctcgagggaaggttacagtttgaagcccagctctgccactgtagggctgtgtgaccatgggcaagttgcttaacctctgtgcctcagttaccagatctatgaaatgtcggcagtgaaacctagctgatatgactgggatggggattccagagaaccttgtaaacacttggtccagcaaataatatggcctcagaaaatagaagctggatgtgtttacgtacatgaggaaatggacagataggacttaacagaccatggttgtgagtgacttggctgtaagtgtcacagtctcagtttgagtttcctcaaaagcggatgctgtgaggaggatttgagtgcaataaattctcttgggaggtggtccaaggggaagtgtagaggagtgggaaagtgaggcaaggaaggaaaaggaaacagacgaggggtctgttactcaggcaggtactgctctgggtgtctggagcttaactcccctgggaacctttgagaatcagtgtggaatacctgcttccaagccatcccacctgaggggcatgggagctccagattttatgccacaaatctggttggcattgattcaaagctgccccagggggcactgattttgagactactggactactccagcctcagagaaagcagtcagtgaagaggtgtagatatttgcagttggaagttgagccagccctgtaatggaaaagccagaagagacaggagcttggggttgggtggtgagctgtctgtcagtgtctaatgtggtaagtatctgatatggtttggctgtgtccctgcccaaatctcatcttgaattatagctcccatagtccccatgtgtcatgggagggaccctgtcgggggtaactgaagcttaggggcaggttttccctgtgccgttttcatggtagtgaataagtctcacgagatctgagggtttcataaggggcagttcccctgcacatgctctcttgcctgctgccatgtgagacatgcctttactcctccttcgtcttccactgtgattgtgaggcctcctcagccatgtggaactgtgtgtccattaaaactctttttctttataaattacccagtcttgggtatttcatcatagcagtttgaaaatggactaatacagtatccaaaggcataaaaatagtcatgcactttggggaagtaatacacatctgagaagttaaacagaggtaaatacaggaaaatatgtacaaaatacattatattaaatgatatatgaatattgtatatgttttatgcattgtatgtgaaatagtaataatagccaacgcttaggaagtagttgccacatgcctgactctcctaaatgctctgcaaataggttagatttccagcaaatgaaaacaggttaggcagctcaatagaatattacataaccattaaagaggatggttataaagatgatgataatggcatggaaaaatcatatgaatgagaattgaatactaaacaggagattgtgtgtgcagtaggattcctacaaagcaaaacaagcctctaaataaagaaaaagaagggtggaatctgaaaggaatttatcaaaatcctaactgcaattttgttcatgcgttgggattcagagttgttttttcccctctggtttacaagtctccattgatacacttgcgttacatctataatgaaaaatacaagaaacttgaaaaagtacaagaagaaaaaaccttctaaaaaataggtggtaagacccagtgaaagttttaaagaagggaataacataatggaaaatgtatttcagaaaaattaatctgggggcagtgtggaagatggattgaatcaggaaacacccaaggtgagaagtccagcttgaaagcttgtatgagttactgggagtatggaaaagaaagagccaattttagatggttgatcatgaatgagatgatggggaagaaagagaaaagtgccagaaatgattccaacattttaaagcattttgaatggaagaaaataagcaatggaactaatataaatatagttagagagtgagcgcgcaccggctttctttacatttgttgcttgtttaaacctaacagcaatcctatatgctatgcttttaatattcctattttacaaatgacataatagaagattagagaaataaagccacttatccaaggtcacacagggtccaaactcagattattgtgaaatgaactggctagatagaaggatagatgatggatggaaggatgaatgcatagatggaggatggatggatggatgatggatggatacattgataactatatgaaggggaaggaatctggtgaattgtaatgttatagtggaaaatagggcatttcaagaaggaagtggcagatagtcttaggcagtgaagaaggaagggaacagagaaagcactagattcaacaaaaagaaccagtcactggtcctctttgagaaggtccttccagttaaataatggaaagtgggcttaagcagcatgggggactgaagggccaggacatgttggggaacctgtgaaatggctagtcagagcatggcatgtatgagcttaaaaccagatctgaacctaaggaagagatccaacaataggaaggagaggggatgtaagagagaaaaatgatggggaagggagaggagggtaagaagacatggaaaaatggaaaggaaagaaattactggttaagaacaaggacaccagactgcctgggtttgagtctcaactccgctgccctgtaaccttgagcaaaccccataactgtctctgcttccgacccctcatctgttgaatgggaaaagagtaataagctctatatcctggggttcctgagaggaggaattgaagcatgtaacatgcttaagacagtgcccggtgtgctgtaagttgaaactgtgtagggatcctgttgccttagtcatcacaacaaggaccatttcctgggcaacaacccaaagctatagattaagaaactgaggctcagtcacttaaagaatgttctctgagaaagtacacttggagcctcaacattgctctacctgcaagtagttacctctcctgtcttccagggagaaatagattttgtgtaaaataggatgcatggctttgttagtggaaactaaccttcagcaattgtaataaatgaggtacgtgaggttgcatttttttctcctttttgaaaaaagagttaataaacagaggctgttcaataaagcagagttagaaggagtttaggaagcactggagagtggctgaggagcaaggtagtgaggacttggaggacctggagaaggcagatgagatccatcagatcccagaaagctccatcaactcagtgccctttctctattccagaaagtcttatgctcatatcattgatgcttggagaagcctgcacaccacagacttggcatgagaagtcctaaaagcctcattaacccaaccacttaggctttctgagtgcaacccctaccctattctatttgggctcagggtttgctgggccccaaaatgtcccgctgttgggatgaggagattcagttaatacctttctttggttggctctcctcccacatccccctacctctctagccttggtttccagaaaactgtatctgtgctcagcctgctccctcctgcccttggtgatcatgaaacctgccaaagaagcattctctctgaggctgagccactggagaagttgcacatccaggattgattttgcatagtgtagaaatcaatccggtgaacctggcagcataggtatcctctaagtttggttgtaagcccagtggggcagggcagtaaacagtttaaattggaaagttaaaacaataaacaggagagacaggtgaagttggggtttgaaatttgctgggctagaatgggttttctctttctgtgttaatcttatctggcagctaatctttacctgtcatgtggtttttgggggagaaaacggtaccctctttagactgcttccttttctgggaggagaaccctgagaaagactatcagtttgaagttgtccctcctgggatagaaatttatctaattttagtgggtggcaagactatgaacaaccatcattatctgtgctccaataattattaatttaatgacattttaacaaataagaaataacttttattgagcactgtctacatatcaggcacccagctaagtactttcacatgtgatgtctaattaaagcttctgaatatgattaacttcattttatagctgaggagtctacagcctatagggcacacacacatataccatcttcattgatcttcacccaaccatcagaagcctgggaaagacattttgcagttaagaaaagtgaatctcagggacttgtcttcttcagcaaacaattggcagaaccacggtttgaatccaggtcttctgactccatattactttgattttattgggagagtatatgggtggcgtatcttcttaaattcctctggccaggtcctgagaaaagcatttactgtgcattgtctcaacacttgtaataaccctattagggaggtggtgtttttccactttacagtgaggagactgaggcttagagagggtaggtacgccattggaacaaagccactcaggcagttgtaggaagtacagctggggcttataccttcccattctaccctccaggttttccctgctataagcatttcttacagcagtgccttcaataggagaaacaatgacaagtgatttttccagtgggacagcaagaaggtgattgtggtcttggaccttgggatttaggacgggctattgacattaacagttggataggctgctaggtcagtccagggaaaagcaggagggaagataagacatgactgagaattcaggaagggccagcgccatccaatcagaacaagttggagcttttcgtcttctttaagcctactagtttcacttctcattttgaaagaaacaacttgctcggccaacctattgttgctgcctttctctgcctaccacagctatgaaagcaaagttattggaacatgtgaacgtcactagcatccgaggcaagatttaggttctgaaaagaggtcatcagattgtagagttggatctccatttccctggagagtcttgtgcttcagaaaatcattattggtttgtcatcctagcctgtcatggtggaacccctgggctctgaaagattacaggaaaatagctggtccttggcagttctcagaaggttctgtttctcacctgggccaggattgtgcctgtggtttttgttcatgacaagatgagaagagcttggttaaataaggaacgacctctcgttatatatcttctatcctgattgattgcatcagaaaagccattcatctggtttgaagatagacaggtggttgctgtcactgcaccagcagcttttgaagtttgctcagtgatatgattacagcccatacttaagcttctgctccaggaagtgagattgacctttgatcctactcctcatttaaaaattacagatcttggaaaatgaaccaatctagaaagatattggaagctgctgctgctgctgctgctgctgctgctgaggttggctgtcaaaccaacttaactggcctgcattacctagaattgtttttttttttttttttctggttaaaaccaatgacctttaaagcctttttatttttcctctgacaatctctagtggacctatggtcttttgtgagttctgatgggaatcccagaatctttctgtaactgtgggttccaatgagagaggcacatttaacaaagaccagaagaaaatcaaaactgttgctcaaactgacagtgtatgttcttcatcccactccttcattagctcattcattcattgattcgttcattcatgtgctggctctttgtagaagttgggggtaaacaggcgaccaaaaggtagtccgtgaccccaggatgttgtaattcagaagggtaaacagacaaggcagtcaacattgtccattcagtgtgaatgagcttgggagtacaaccactttggaaacccattttgttaatttacctttgatagatacttattgaacggtttttccaagtgtctgtgaagaagacatggtggtggtagggggtgggtggatggtttctgaggacctgataatgtttctccttgattttagtgccagttacgtggcaactcatggaaaacattgagctgaatacttgggcttttgcacctttttgtagtgccttagtgtattttacacaaaaaaataaataaaagtatgctcagcctcaggtgtgttggaaatacagaggagagaccagcccaactttggaggagaacagagagagggacccaggaaggccttctggggaatatatttgacttgggccctgaaggagcaacagaaattaggcactgagtaaaatgggactggatgtacctgcacaaagccagcagcagaagaaaagacatggagtggagggagctggcagttcatgcttgggggaagctgagagttgcttgtggggctggaggccaaggtgcagggctgcaggggtaggagggagcagccagggagggggtggattggttaagaaacacgatgtgcatgtcatgttgagaaacttggatttcaccctggaggcgcaggaactaggggggatttttcagcagcagtgacagacgctcttaaatctgggttttccaatgatcagcatgcttgtgcctgcaccggggcgcaggatgggagacagatgccttttgcagtagttccggagaagaagactgaagaccacattcaaggccctgagagagaagagaaggggacagataccacagagatcatgagatatagcacaacagataagacttgctaattaactgtacggggttacagggagggacagggagaaatcaggtttcttccagcccagcttctggttggaatcactcaggcagagacacatgggcctgagagaggattccccttatgacataaagccgcaaaaattctcattagtcattgcaaaaacatctatttccggcctacactgcaccagccagtgggggaggtcctgagagatagagaaaggatgaattcttgcccttagagagtcacctagagattctggggagacagcaggtccgagtctctctgcctgaaacctctggacagtgtctttggctgacacttacatggtggtcttggtttcttattcaaggtcggtttcccaactctcatagcatcagctttagggcatccccaaatctcttgcagaagagatggttctttccccttgagttgttttgagccaagcatataacattgtgtgaatgtttgaaaacttctcttggttctcagaatgcaattctgacagtgctgaaggctgccaattaaatgaagatttagataaaggctgtgtgggaggtggaatgcaatattcttaaacctaataatggcttccttctgtctttttgaagctctcaaataatcctgattgactgactctctgctttgggcattcccattttctggacaatttaataccatttaaaatgtttgacaacttttatttgggggcagacatccttaggggatggggccgtgggcaaagatacaaatgctgtaccatcaaaggaaccatggatttaaataaggatttttttttttttcatattcagaagaggtgggtacagaaaggatgagggcagcttctcaggttatagtattaaccacgtgaagcagctaacaaaggtatgtgcctggccttgtgctaaaggctttcctcgtatcagttctttcatccctcccaacactactgaggtagatggagtgactagatccattatacaggcaaagtagctgaggcccacagccatagcaaataaactgtggagctggtggtcccagatttcatgcttttagtcattctcttggctctggggtacaggtaagcttccagaactggaggatggagtccaaaagaaactcaagataatttccctgcctttcccattgtatcaggggattcatctgttcatacattcattcattttcccaacacatttactgaatgcccgcaagcaccaggaaaatagcaatgggcacaaccaggttcctatcttcatggagctattgctttattggcagaggcaaacagtaaagaaaattcattagtaatcagtgttgcaatcaatgagccggtcaatcaagcaccataaaagggtaaagtgtgacgaaggtgctccttgtgataggggttgggggtgaggggaggtgtcctggagaggagacatttcaactgagatctctctgaagtagatgagatggccatgtggatctcaaaaggaaagtgtatgccaggaagagcaaaaagcaagtgcaaagtcctaaagcaggaaatagtgaggctaccgcagtgtcgggtccaagagtaggagatgagatcagggaggcagattaggctgcagggagggtgtgcgtgtgatgctgagagtgatgggaaaccactggtggggttgggggagggcaaggcagtgacatcatttgtttttatgtgcagcagaggaagccaaagcaattcagaagaagcctacagaagcttacctcctccacaggctatttttttcttgtttacatttgttaattttacatatatattaactcagtcctcacaaccaccaaatgaaataggcattgcccttattatcattctttcccattttaacaatggggaaactgaagcttagagtaggcaaggtcgcccagataggaagcaatgccttcgggtcatggctcactactcaagtgcctgaaatttcagctagcctttagtgggcacctgctatgtgccaggatctgtatgaggtttggcaccacctagacagccccttgaaccagtggcatgtctcaggacagtgtgagagacagaaacttcagctgagagttaccgtgcaaggcagaaaatgctggtctagcaaaaggaactctgatttcgatttggaagtacagagaaagagcatctgccttggacagagttatcagtgaaaagatgacatatgagctgagactgaaaatcatgttgaagatagtcaaacaaaagctggcagtgtgggagtgggggcttcaagcagagaatcagtggttcaaaggcacagggtagaaggagaatggcagctggctcagtgtggctggagaaagaggctggagtgcacctggttgcatttgaatggtgtgcgtgtgtgtgtgtgtgtgtgtgtgttaatgatggtgatgagatgaggggctagagaggaagacaggttggcacctggtagcattttttaaaaagcaagtaaaccttattttttagagcaggtttaagttcacagcaaaatttggtggaaggtacagaagtttcccaagtacctcctatccccacaaatgcacagccttgtcccactatcaacatcccacatcagaatggtacatttgttacagtcaatgactctacattgacacatcattatcactcaaagttcacagtttacatgagggttcactcttggtgctgtacggtgtatggtggatacatgacaaatgtgtaaattcatgtatccaccattatgatatcacacagaatagttgtacagccctaaaatacttgctctgcctatttgcctacccactcccttctccctaacccctggcaatccaccgatctttcttctatttccatagctttgcctttcccagaatgtcatatggttggaataatatagtatgtagccttttcaaattagcttccttcacttggtaacatgcattgaagtttcctccatgttttcttatggtttggtagctcttttttttttttttttttagcattgaataatatttcattgtctggatgtatcacagtttatccattgacctacttaaggatatcttggttgcttctaagttttggtgattacaaataaagctgctataaacatttgtgtttcctcatatagatcttgtatatatacagtagttccccagttttcatggggaataagttcccagacacccaatggatgcctgaaactatggattgtaccaagccctacatacattatgtttttttcctgtacatacctgtgataaagtttaatttataaatgaggcacagtaagagatgaacaacaattgctccataaaatggaacaattatgacaatatgttgtaataaaagttacatgcatgtgggctgtctctctcaaaatctgttgtagcgcactcacccttctcttttaatctgtcagtctgataaccaagatggttactgagtgactaatggatgatgggtaagatagacaggatggatacactgaagaaaatgataattcacattcccggcaggatggagtgggatgacagaagatttcatcatgcaactcagaacagcatgtaatttaaaacttatgaattatttttggaatttttctatttaatattttcagactgtgattgaccacagttgagtaaaactgtagaaagcaaaccttggagaaagagagactactgtattttgtacatttcatgtacacagtttgctagatttatatgtaaatattccaatttggggagggtaatgtaaattgtattgtgttttaaattcctgatttcattcattcattgctggtacataggaaagtgattggcttttttacattaacctcgtatcttgtaatcttggcataattacttattcttggagtttgtcaatttttttggatttcttacatagataatcattttatctgcaaactaagttttgtttcttactttccaatcactatacctttgttttcttttcttatcttactgcattagctaggacttccaggacgatgttgaaaaacaatggtaagagggcacatccttgccttgctactgatcttatcaggaaagctagtttcctaccatgaagtgtgatgttagttgtaggctttttgtagttgttctttattaagttgaagaagtttctgtctgttactagtttgttgagagttattatgagtattgattttgccaagtgctttttctgcatctattgatatgtgcatgtgatatctattgatatgtgcatatgagcctcctggtcatcatcccaggcttagctcacaaaagttgtgagcagggaggccaccaggaatgtggggcaggtattatgcttcccattttacagaaagtaatgccagaagaaaacagtgcacagttactgctggttcccaatagttgatttgactcctttaaagatttagctgtcccatttatgtgctggataacatcaattgattcttaaatgttcaacaagccttgcatacctgtgataaatcccatcatggttacattttaatatacttacttttcttcatacctgtctcaagagagaaagtagctcagtggttaagactggagtcaggctgcctgggtataaattgcacctccgttgcttattagctgtatgaacttgggcaagatatttaatctctctgtgcctcagttttcacatctgtaaaattatgtcaaatagtactgatctccaagggtggttgcgtgggttaaattatacctaaagaacttagcaccccactcagcacatggtggctgccatgatggtttgccgtgacctctcttcatttgaatgtgtgcccagtgtcttgtttctctctgtattctcagtgcctggtacaaagtcgatagattttaaaagcccatagaagaaaacatacatttttccctgtttgtgggtatgtatggaagattctgtaactttgactagacacttgatattcagataaaatagccctaaagaaggttctcaagggggtggattttctcagactattgtgagcatagttcctaaagctgactctatgtcttgtgctgactctaatcccctcctggccatcatcccaggcttagctcacaaaagctgtgagcagggaggccaccagggatgtggggcaggtaatatgcttcccattatacagaaagtaatgccagaagaaaacagtgcacagttgctgctggttcccaatagttgatttgactcctttaaagatttagcacctgagttagaatccggatggcagaacttctctattggaacctagtcccactattcctctctcccttcattcaacactgggtttagaatgcttgccagcagcattgtggaaattacctcaaaggtagaaacacgtaactcataagcacacatgaataggtataggtcataatcctggaaagacggccttgccattgagaggggaatagcaggagcaaggctacggaagcacgggactctggttgagtctaggcactgtctgcatgtacttggcacattccttaaaaatggcagcaagcagtccattctcaaatggaaattggaacaaaaaataacgtaaaaccataaataacagaaaagaatatatactcaaacatgtataatccatatgcatgaacataactcccctattgggaatttctcataaagaatccccccaaaatataataccacgtccacaagaacccacccacaggccaggtactgtgcgaggcactggaatacaatgggggtaacatggactaggagactcatgaaaacgtcatgacaaacacctgggaaattctgaacgttaaatagtagggaagggtttctccaccatggcatggtggccactttgggcaggaagattgtggtgaggctatcctgtgcatggcaggatgtccagaagcatccctggcctctacccactagaggccattggaagccccatcctcactgtgaaatccaaaaatgtctccagacattgtcaagtgtctcctggagggaaaggggggaaagtgactccccattgagaaccactgctttaggggaatacttaagaagttgaggcatatctgctcactggaaaatggaaatgagctaatttggaggcttaaaacagcagcactgggaaaatgacataaattttaaaaagcagaaagtaatactgcatttattctgtggtttggctgaggttttgggtttcagaggaagctgctgagaaaagagagggagggaaaatgtgacccagaaatcacgggaaccagggaatctcaacaaattgagtatcttggtttgtgtaagattaggaacctggagataaatatgggtcaggcagatgcaagtaaaatgatcacacgtggggagcatggaaattgggtcttaaaagtgagttaagtcaagggtggtatttaaaatatgtcatatgtaaatatgacagagaaaccaccaatcaaaacagccatctgctgaaaccacccactatgggcgttcctgtgcctgccggggcgtgcggggaaacccaagagggagcaccagttggtgaacgtcagtcaatccacaaaccatctaacagaggcacagggattaaattcagagcaagacctggcaaaacagaaacagcccgaggccagagatgaagtgaaagaaagatgacaacctagggcccaggagggaagcttccagaaggttgagttatatttaagccctttcactgtatacctgggaccaaagaccctagagcagcttcagacataaattatgtatatacatgaacaaagacagaaagggagcaaagaaaaatgaaaacagcttgatttgtagggctttcagcatggcgggtggttttctttcccccctcgttttatttagacgtctgctgctgctgcttcaattttgttccggcaatacaagtaaaatatatgtggatgttaacaaagatgtaaagagccttttgaagtatataactgattataatttaacattcattaagtttcttttatcaaaaaaaaaaaactattaagttcattgaagaagtcataaaaacaaaccaaacacccaccaccttctcccctcctggggacatggcagtggccacttcaaagtgggtcaggtctccgtgaaggaaaggggctcttgagagagtgatggtggcccaggggccggtgtgatgtttcatgctggagggatacagctgtccgtttcctttgcctcttttcatcctgatggagcaaacggctcattgtttacgctgacctagtgaggttggcttcaagctctcccctcaccatgttgtaatgagatagtcctgaggacacacgctctgtccattgaaacagattagctctgatcacagcttaattatgtgaagtacagccaaaccctatttatgcttttcctagggatggggtggaacagataggaacgggtaattgacagacattaagaaatagacttaaatattgtttgtcctgctttagtacgcacgatattaatgagatgttattgtgagtgctgagtaaagaggttgctgccggctggttctcatgccaggcagccagcagaccttcttcccaagcagggaattagcgcaggtgttcccttggtgaaagcctggctatcagcatcaacaccttctagaagatccgtgcctcttggtttatttcagggagcctgtgcaactccaaaaggatggatgctggatgcatatggaggttccatgccttaaggctagcttacaaatgtatgaactcgtctgtcttttattccatcagaaatgaatgtacattgtaggaaccagacttagcagagaacacggagtattgggggaaacctcaattagggaataaagagctagtacacacacagatgtgtgtcacatcagactatgtaatggacacaatttaggaacaactaaggtatgtcctgtaattaggggacttgttaaatctgcactgtctaatatagtagccactagttacatgtgactgtttacatttcatttaatcaaattaaagaaaattgaaaattcagtgtcttgatcacaggagaggaattttaagggctcctttgtcacaggcggctagtggttctcatgtgcagatgtaggacatccccgccatcacagagggatttgctggacaccactgagtcaaataaatggtagtatgtccatagaatggagtattctccatattctcaatgaagtaaatgcagatattctggcatagaaaggtcacccttgtgtattgccaggtaaacaagttacaaaactttatgatattaatttcacttaaaaaacagatgcaacacacaggcacatactttttggataagagtgcaaaaaacacagaaaggatgcacaccaaattgtcggcattagttaccttgaggaggcgggggtagatgtttactttttattttcttcacatgtgtattgtctgaacatatttcaatgagcatgtgttactgttgtaattaaaaagagatttatgtgatgaaaactgatgaaaatgattgagaaacatgaacagagggttttctctttgcctctttagagactggttaatggtgctacctgagtgagattgaccagatggcttgttgggagaagaagggagctggtttggagtaaatccatccccaccactatcaggtcttgcccaggcataccctgcttttcctgaatgtcctgaatgttgttgtaggacaacaaatgcgctttataattattcataggacctctcactactaatctttgagtcgataacagcttctgctatagaagggggcagatcactgggcttaaatgtcaaatagcgcctgagaggcttaaacaaccaccagtatgtgtccctctgggagggcttctctgccatttagaagatcaatgagaagatgtcctccaggccagtgtgaggtggtagaggtgtgtgcttgcgtgggcatgcctgtgtgtctggtacccttacccactgaaacagcaaaggacatgccttctcccatatgacaaatcggtacattgatgatttcgagttaaaaacattggataaattgcagtttcagaaagggctagctgacttgtctcttcctacatgtagcaggccagaaagattcctctctgggaggggcatcctccccctgccagggcaagaaaatagcccttatcgccagagactgcggattgcaggctgcagtgggcttgaataaatacccttactgaagtggcccttagcctccactaggttttttgtttgtttgtttgtttgttttgagagggagtttcgctgttgttgccctggctggagtgcaatggcgcgatctcggctcaccgcaacctctgcctcctaggttcaagcgattctcttgcctcagcctctggagtagctgggattacaggcatgcagcaccaggcccggctaattttgtatttttagtatagatgggtttctccatgttgttcaggctggtcttgaactcccgacctcagataatccacacgcctcggcctcccaaaatgctgggattacaggcatgagccaccatgcccagccaccgccactcattttacacagtcccctgtatgtctcctagtgactcccctagaaattcactgaccctagccagatcccatttgtcctgtctttgtcagatttatcattctttgtctaaaaagttcaaaagcatcttgctttggccgcttcttcagacatcactctcttgtgaagatcccttgtacctggaaaactattaagatccgtatgcttttttcctgttgatctggttgtctgattcgtgtccatttggtttctaggtccagccaaagagcccacataagaaccaaggtggggttgggggtgatctctggtcccctttgtgatcctcttctaggagatttacctctctgctagcttacatactatgtgaatatagcgtgggctttcttcttgctcttcagaaagtcttctctaccctccctcctcctaccatggcgcattctgcagcatgacaggcattccactctgaggtgtgagccatgtgggctctcaggactcttttggctccacttctgcctttgtagctgtggaccacgaggcagtgactttgaaattcagtcttattctgcggaaatattacttactcgtccctacctcatagggtggtttttcgaagtcagtgagacaaggacagtgaagggttgaggcagtgctcagcacatagtaagcgctaaataaatgttagcttttgttgaaattaatcttacttttcactaaattgtgctgcaaagcaacgtgccattgcctgttcttcacatggctgtgtctctcctcctcagatggatggagtaggagggttgttggaagacaaaagcatcctgcttcactcttgtctctccaggctcctgacagtgatttgcactagctgattagtaaattcatggcagtgcctggtgcctgagagagcgagggttgggtgcagcttggctacagctctgaacacagcagtgggggctcagttgcttggaaaagctgccagccagtgagcccagcacagtcagagtcctgtcaatgcagtaggtgggtaaaataagacaccagtgtgcctttgaagcatgactttctgagggagaaggctgggagcctttacatttgatgactgggagaaaggacccaagtttttcctgtgtgtttccttaaaacagccttattctctagatgtgatttgttttctgttttattttcaaagagaagaaaatcttgttaatacttgcttattaactaacaatttcactttactggtttggtatgtaaaactgagggttttcttctacccagtggcagtttttgatatgaaacagtaacaacaacatcaacgtaacttgtatttttgaatatatttgatacagatattggttaaaagcattttgtacatatatattcttacatatttgtgggtatgtatgaatacatgtatatatgcatatatatgtgtgtgtgtaattgattctcattattcatgaattctgtctttgtgaatttgcctactcagtaaaatgtatctgtagctcccaaatcagtggtcatggtagtgttgtggtcacttgcagacatatacagagctgtgacaaatttgaatcatatgatgtatatgcttccaggtgcattcaaactaggtgagactgccttcttgttttagctttcatactacaaacaaatatccttttcatgaaccatttaatgccacatttgccacaattttatgctatttcttggcaattttgctgtcaaaatggccccaagtggactgcagagtgctctctagtgtctctaagtgcaagaaggctgtgatgtgtctgactgagaaaatgcatgtgttagataagctttgttccagcatgagttacagtgctgctggctgtgataaattttaagtaaggcatctttaaaccgaggcgcacgtaaaacaaggttatatattgactagttgactgaactgtgaccagaggctcacaggaacctaaccctgcatttctactaggagcaatggttcaatatatgttaagtattcatggtgacttcatagaacataagtaccataaataagagaatcaattgtatgcagacactccttgatttatgatgagattttatcctgataaaccatcctacatcaaaaaggcggctgcatgcctacctcaaacatcacaggtactctgcttcaccttcctcaactatgtcatgcctcaactctgcttggactctgcccaactccagacagggacaatgtgacagtagccagctcctctctgaactgacaccctgtaaattggacctactgaacagcaatagtttagcctaacctactttatatgtgcttagagcacttgcgttagcctacaggagggcaaaatcattgaatacaaagcccattttataatgaagtgttgactgtctcatataagagtattgtaccacatatttctggaccaggaaaagatcaaaattcaaaatctgaaaaatggtttcaatggagtaagtatttcttttgtaccattgtaaagttgaaaaactgttgtctagtcattctaagtcagggaatatctgtgtataaatcgtgtaaaatcctcccagaacctttatgagagggtgtggactgtgattcttaagttaatggcatccctctctgcctataacgatctcacgtctgtttttttgccaaaaaatatagctgctggggaacctgttcagggaagttgggatgtgtttatccttaggtgtttattcatctttccaagctcctgcaatcaaccagaaacacaggggaatggaaggcttagtgtttgttgtaccaattatgccacaggcagtatcttgtgtattttaagtaacagcactgctttggtaaggcagttgatcctactttcaaaggcaaggtacctgaatcatggacaatgaggccaccatcagccctccctctccaatcaatggatgaccatacactgtgcttgttccttccacatggagacccatacttgaatacttggtgggtaccttgagctaacctctcactttgtgtggaataggcagtgggctataaggggaaagcacacactttgaagccagactcacttgcattggaatctgggatgtctgacataacaacaactactactatttttttggccatttactataacctagtcgtaggttaaccatacaacaaccatggtaactgaggcacgaagaacatctttcttatttgtggtgcatatcacaatgtaaaggtagtcctgttgatacacccatttttagaaatgttaaatggtgtgctcaaggtcacacagatggaagctggtgaatccagaatttaaaagtagaacatttaatcccagagccagcctgccttcccaccatccaaacgatgctatgccacatcttgaagaatcagaaccaccttgtcaagatgggtgacaattacaacagagaaatgatgtaaaatgcagtgtgtagtttctgcccctgagatgagttcaggaatgggtccagttcctgttcttaaacacgctttgccctactgcttgcaagccaactcggagccttctgatgtttctctccaaactgacaaaggaatcagctgttccttctagagggggaatactttgacttgtgtcttcagaagttatctgatgccagcttattcacatcgcctcacctcctagcagctggagcaggaatgcagcagtagggtattgaaatttaagaggttggccttgagtcactgacttagctgggtatcccataaagcagagagcttatacatttctatcgtattagggagacaattccagagagtgagagtgaaggaagaggggattgaggcaggtaaggaggggaggcttgcgaaggcgcgtactgagctggccatccccaagtgcaactgattgagaggtttgtagagctttgtccctgagaagcctgcctcaccaggatgtggtgtggggagatgaaataattcctccactcattcccatctgctattggccatatgttggctcaaggggcgttcctttccttgcaccgtaggattgtgcatgtatgatggggctcctctaccgagttaagaaggaagcccttggcaagggcggagaggctctcagttcagagaggagttgtctgatgtcacgttgcccctatctgaagttggacagagcccaggcagagctgagatgtgacgtgagtgaggaaggcgaagcagtgcacccatgatgtttggtgcagtcttgaaagcgcagtcactatggagccgccccccgcctctccccttctgagccgccacagctcacgcttgctttctatgtcctgagcttttctgtacctctgtcttgctatgtcaggcattcatggctgtgctgttagggagccttttcaatcttctcatgctccagtttcaaagctgtctcaaaatgagataagttaaagcctaatacagttttttagaaacacctgtatttgtcacgctgacctaatattaacacaggttctcgtctctacttgaatgttacgcatctatcgcgacaccattaccaggactgcgctctgaatctttagagattatctgtgtgcctgatgtcatgaataccaagtagatgatgtaggatggctataccctgccagggagacctgcctggggtaccagtgagtttacaaagacttgcaggaggcagcatacagaccatgggcttgtagctttccagttcaactacaccaccaaaccctggcacctaagactttggttgttccccgtgtcctatgagccctgatcacaaggtgagcaatgccttctaggctgggaaggcagagttggcaagaactgccaaccccagggatggcatcaggcccgctgataattaaagggtgcctaggacatattgcctaagctgttattggttctagaggactcgacttcattccatgaggggtaaaataagtagatagggaggcattcagagcctgaactggtaaaggggggacagttataatattaccccaaagctacagctcagggaaaaccattagggcaatgtttttttgttgttgttgtttcttccttaagaagggatctgtgctatgtactttagcatcacctgagatggtgtgaacaatgataagagtttgaggccctgtcttttatctacagattcagcattccttggggtaaggtctgggagtctgtgttttggcaagagttctgagtgattctgatgtacactaaagtttgggaatgactgtcgtaggagtgttcagtaacttgggcctcctggaatgctctaagttgtgtcacagcccagctgagtacctgggacagaacagggaaaagcaaggagtgacgatgtcagagaggggctgtgagcccctggctttggagccagacctgtaccttcctggacttcagcaagttccagaatttctgtgcatgtgagtttacccctgtgtaaagtgaagatgacaacagggctggctgttattctagggggctgccccggtgtacctggcacagtgcagtcctgctgattttcatattgctctcattgccatccacatccgagggagtaaattagcgggatccacaagccacggatgagccttgaaccagagaagccacaaactagcatttaggacttcctgaggctcaggtatgagcaatgctgcccaagtgcatggcatgaaacccactacagaccatcggaaacctcttgaggacaccattcctctctggtagcctttggggcatcattgaacattgggtcagcatgttagatacgatgaagttccagatccaaggacaagccctttagatgcctagtatatggctctgccctggcatttaacgcccaggagattatattaccctatcaagcttatagaaaatggacgcaggtacaatatatcttatctactgccacattgataaagtctacagagaaaatagtgggtcttttaggacttacccattgagccttttattttaagtgacacattctagtacggacttaattgtaattctgataacattacttgtaatactgtctccagtccttggaattaatttgactggaaaaaatccagaaggacttaaatgtttctcattaaaagcattatagataacttattagacattgtgactaattgtagtatggcccaatgtaaagccatcccaattaagatgctgtttcttctcttgtgattagttggcaaaccttttccatacaactgtgccctctagaatgtagatcaattaagcatatataattggacggaaccatttgctccccagttatcaccctctccagtgagatataccccagccgggttggtaggcttgtgaagacaaatgtcctgatctcactttagggagttgacaaatggatctctataaggcagcttatgtgctaaatatttctcctggccccattggcagagatgtagtctgttttcccagtacagagaatttcttgcagcctgtacattttccctttaaaagataaagagaaaccattatgcagtttttattcctgacctgcctcaaggagcagatacggactggaaagcagcccctgttggataattgctgcttgtctcagagtttgagattctgccggggtttcttgagtcaccgagcatatggggcttcaggttggactgcccactccagtgcctgagaatttactgggaagttttaataaagtagagcagaaattttccagctgcatccgaaatatttgatgtcatgctgaattgcaaatccctagtcggaacatttgaacatcatctagagggatcaggaaataacccaaaggtttggtaggcgacttagaacaatggctgctcttaagagggaacaatttagagcgatttctttcctcttccttctctccaccttccccactgatttctccttcacgcacctatgggtgtgaaatgagaaaaaaatatcacttgaaaccaaatcaaaagctacagcaattctggaattaataaaagctcacatgtagaaggaagtgtgggtttatgggtagggtgaccatgcactacccaggtttgctttacctgaaggcagcggggcacacgtactgaggactattgggtagaaggacagatggggctataattaggggatgagcttccaacagattctcggaatgagctaggcatttgcaatgttcagagtatatagactggcacgtaatttggggtagtcgggtatgaaacttatagacacatccatggatttccctttaataaatcgtctcttctagtagtcatttgtcatcaacgagcaattcagtaaaagttggaattgagcataatgttgcatatcatttcagaacatctggccctaatatgtagtaacagctgtttagtacctgagatataaacaaaacatttttcccatggctgtcactgttcctcctcctggaggtgcagtatcaccgaggcttctctgtatttcctatcatgggtaatagtaacaatatcaataacacaatgatgattatcatgtattgtttaactatgtgtcatacactatgtcaagcacttttcatatatgatcttggtaaatcctcatgccagcctttcgtgggtattagatggcgaggggaaagtcatcaagccagagactgactactttgaaaattgaatacaagtctgtgcagtgctacagctaacattctttaagtactaaaataaattgcttgtaaataaagtaaatgaaaaaagaacacaactgtgtaagtcacaaatgaagaaggcaacaaaagggaacccagaagggttttttattttttggtgtggtcttcctttgtttgggatgtaagacactgattttcctgctatattatagtatgtacactgttacgaggtggcagtgcagtaccttggtcatgtaagccaatcaacaagacttgttcttttcctgatgttcaagggagtaattccttaagcaaaatcacatttatacacatgtcttttcaaatttttaaccaaatatttcaaaatcagttgtttaagaaaacgattacacctataccttcaatatcaaagcagatcaatttttaaaacaaatttactaacctagtcttcagatacataggtttgtttttctcactaatcctttgtggtcactgaaagagcataggccaccccagtcttttgcccagatagtgatgaaaatgctgatcttcgtgaatccaactgaaattttaacttcgtgcccaagctgttctagaactcaatttatcagatccagatttggtattctaaagactagagtgttttactttctgggtgttctttgggcttcttttctattcatgaccctttggattataaaagaagagaaacaccatggggcagatatgtccaagaataaagaaaagagaaagttgcgcacctgagaagtgccccctgctggccagcatcatttctctgtgtctcactacagaaggaggtctttgtttatgaattctgccctccccctcttgccctgagactatcacctgctttggaaagaatggcatcatttccagaatgcccctaggggcattagcttctcttctacactctctctcttgcttttcaatatggaagttaacaacgcagtctttgaagctgggccgattggatttcaaattctaactcagtaacttcccaactgtgagtttgagcaaggtatacctcttaaggctcagtgttttaatctgtaaaacaggaataaaatagaaataataacaataactatctcatggggttattataagagtcaactgatataatgtatgcacaccattgagcagtgtgtcttcctcattattactccttgatagatagctagaattactgagcatccgacttagaagtctaattctctattttgattttattcctaaactcccatgtatgcaccaccaccttaaactcggtacatctatctaggccgtgatgacccctctactggcagctttagtccctccctaatcactgtatttctatcattgatattaatattcttgaaatcacccggattcgaaacgtccagtatcattcttggctcttccctccactcttctctgatcctttcgcaccatatcatcccctactgcttccccacacctctatctaggtgatcagtcaccaactcctattatttcctcctccatctgccttgtaaatcttaattccattctcctcactgattcactgttctccatagaattccttgtgactttcttggaggtggggatctcatgtttcctttaagaaaggaaatatatatgtgtacacacacacacacacacacacacacacacacatacacacacacacacaaaatatatatatttggagacagagcctcactgtgttgcccaggctggagtgcagtgacatgatcatgactcactgccacttctacctcctgggctcaaatcttccttctgcctcagcctcctgagcagctgggaccgcaggattgcgtgccaccatgtatggctaatttttataaagttttcttttttttttttttttttttgtagagatgatggggtcttcctgtgttgcccaggctggtctcgaactcctgggctcaagcaatctttccaccttggccttacagaatgctgggattataggcatcagtcactgtgcccagccccaggaaacatgttttatttcttgtgcccccatcagtgttcgacgaagccccgggtaggaatttggtagatgcaggtgtttgattaatttccccttccttttgtttctcttctcagccgtgtgtctctttcctctgtcattcattcaaccattcattcattcattcaataaacacttactgaggttcacactcagtcaaggaactgagaacactaatgccattactagttctctctagaaactcactagcaggaaataaaagtatccccaaggagaaagccttgggaattaaaattttttgcacaacaaacgtttattgagcactgactgtggcactttgctttttagtgatgaacaagatggacacaaccccagccctggtggagcttaaaacctcacaggtattagatgagcatgagataaataattctacgagccatgaaagtcatgaaagggagaatgcaacagcacaacaaaaaggttttcatttctgagatggcgagagcctccctaaagaaatcatatttaaacctatgttgagaaatcgagtatagtttagttaaacctgtatatgttgagggcaggaggcagagtgttcacattagagtgggcagagaatgattgctccacaactttacaggcatgggttcttgacatatgcatacaagctcatccatgtggaagtgttagcaacagaggcaactgtatgggcagcaactccaggtcctcaaaaactgagaaaactaaaattctatccaggtccggcaatgtgtgctttctgcatctttagtatgtgagttggtttagtttgttaattaagcctatggaacaaaagtgttctttctcctccagactttcaaaggatgtactctagggctcgaagaaggggaacagagctgattatgttggtcctgttgtttgtgtttttcttcccatttaagaacgtacatttgaaggtgcagtcttgaaattcttgatatggatggcagacacttgtaatgagagaggaattagcagaaaatcacacctcatttcaataaatcttcaccccttaaggcagcctggtgcccttcctgcattggcctatggaagtcaccatctggactgggaggattgatgacttcagtttcacccctttctaaatagtgtttatgaagatccctttcttcaggtcagactagagattgtacctacaaataatattgtaattggaccacttagttttcatctttgatttgaggtatttgaaatgaatgtgagattaaagcaaatgaaggggcatgagaagtgttagcaatcctccagacagggaaaatttcttttcattctgtctccatgatatcaaactgaaatcctcagttaaccacagcaggggcaagtgcctgagttgaaaatgtcttcatccttgtattcttaattcatcacctgagaagtccttggatcaggtacgtgaaaccagaagagagatctccctggggatttcatagatggtggatatttaaatatgcaaaacattattgagaaatatgagatgtgtcagccatctcctgtgctaacattttttccaagtcaattactttgtggatgtttgaggtgggggcacactggaaagaaagaaagaaagacaggaggaactaaattatttataattatggtatgtgttggcgggacgggggctgccttctgagacacaaatggatgacaaagaataagttatctctttatagatagaatgtggcaataattgcattgtctctggattcaaaaagtcataatctattaatttgatggatatcaaaaagctataatctgtcaatcaggtgtcagaagaaagagtctctcaaagctttgaagcatggcatttagaatacccctggatacctttatttctattctaatattaataggaaggaaggatacaaacatttttggcatagttagggaatggatatcattttagctgtcttaataattttgcaacttaaaaatcgtattggataagggtgccgtattgaaaaaaatgtgtaaaagacacactacagtgaattagagggagataatttcatcctaagatttctctgacattaggcattgtggcatcgctttcttggtttaaatgtgaaatagaacctgagattatttttcataaatttatctagcccatctattatttctctatattatatggctgtatacttgaaacataccaatggggactgaagaaaatgcttaagtctataaatggaatgtcaaactgatggaaggaggaaattggagatgtcacacacagtaaaaacacagcttttccaggacccagtaagcttgccattaccaaggaattaaggtattctcctctggtaggaaaagaatttgactccttggcccagcacagtttcaaagctgcatgaagtcacgtttgcctcattacaattcctttggttaaagatgcttttctaagtacttcagaaaatgtatgcaaaaatattttttggtgcggaggccaccaaacctgctggactcacgttcctgcttttggcaagcaaagcaaaagaaccttctgggttcccttcctgcctttcctactgagatcaagctgaaggtggaatttttctatatatccagtccagcctttgtgacctctgcctttaacacaaacaccttgtttaaaaagtagacttgagggagggcacttgagttcagaagccaaaagaaatgggtattgctctttccgcgctaagcagttctgaacctagaccatatccttgggagaccagagcagctgtaagcagcaaactgcctcttttctgcctccctgtgaacctgcttccctggagggtatgctcaaactcaattccctgttttattgttcaaaggacagggaagaaaggagggagaaaagattgattaagcccccagtctgtgcctggcaacattctaggtgctttgtatctgaaaatctattttattttcacaatgatctcatccatgtccatggattcaactttatctacctgaccaccaataattcatatatttggtctttcggtttagtcatcttggtgctccagagctgtatacccactgcctacttgacattcttcttacatgtctcaaaggcaccttggattccacgttttccaatttagtgtgtgatcttccctcctaaactcaaggctttctagtgttccctacctcattctgtggcaccattctccatccagtttttcccctttctcacagtcaattaaaattctgttgattttgtctgctaaatatctcagcaagaatccatccagttctctccctctccattgccagtatcctaatctgagctaccatcatttctttttttttttttttttttttgccttgaatatcaatctggccccccagatggtcataccacaatcactcttaccttcttccaatctttctcttctccccaaccagaatgattctttgaaagcttcagtatgatgcatatgacgatgtcattcatttgatcaaaatccttcagtggcctgccgttggttttttttatgaaatataaaacaaaacctcggacatgagctataagaccttgcatgagatgcactttctgagaccagcccctccattctcctttcatgccactctacactttcaactccagccaccccagtccttgttaagttgctgagactatcatgcacaaaggtatttacacagttttgttttgggtttctttgttttttgttttgttttgttttgttttgtttttttcaacggagtctcactctgtcaccaggctagagtgcagtggcgcaagctcagctcgctgcaacctccgcctcccaggttcaagcgattctcctgcctcagcctctcaagtagctgggactacaggcacctgccaccacagccagctaatttttgtatttttagtagagacggggtttcgccatgttggccaggatgatcttgatctcttgacctcatgatccaccctccttggcctcccaaagtggtggaattataggagtgagccactgcgcctggcctacacagtttttatgcatattgctctctgtacggagaaaggtaatgcagactcattcatcctttgtatttcaggtctattgccacttctttgggaaacatcacccctcagtctagatctgatacccctcttattccctcttctgttttatacctcttcttcctagcccaggtgtttacaattcccatttatttatggggaatatgtgattattgtattttccctactgagattcaaagctatacaaaggaaaggactcttctgcctttttttttttttttttggtttttaactcattatgaaatccccactgctgagcacaatgctgaacacctttgaagtaattaataaataacgactaaattactgctgtgtagataaggcagataggattaggttctttcaacagtgaggaaatcagagctcattctaacttaagggtttagaagtatcagaggcaggactctgacccgggtctccagactcacaaaacacaatacactataaggtgtacaatagcactgacagatattttttaaaggttcctctcatctcactatactaacacaaatgttttcagttctacaatctacatttccccctccaatttttctcctcttttttgactgccttgatggtttcagtgggtcctggttaagcctgtctttaagtttctaatcaaactaatccaagtgaatttggcttctgaccttgctctcacatatttgccatctctaaatgattgatgtctgcttgatccctgttggaaaagcgtctgaagatatgatccagaaaatctatagttgcaaatctagcataattttaatgaatcgtggtcagaatagtaagaagcattgcacagaaggcttgcataaaaaatatgcatcttctgtcatcttcaccctctacactggcctcccaagtccccatggaaggtatctagtacgggaaactttcttttcctgtaagaatgttgtggccaaacatgctgtgtattggatggatggatgggaggatgatttatattttcatctcggtatagttcataggtctaggatcagaaataaactagaataaatataaatattgcttttcttaacgttggtttaaaatgcaaatgcatggcatacagaaaaaactttttttttttttttagctctgaaagctcaatttttactacatgatttccctagtagaagtactttttgcagggtataagaattttctgtttgcttatctgttttcagtctagaatgttcacttcttaagggcaaggaataggttatgtttaccttcttatctctggagacttgtataatcctagctggtcctaagtactcaaaagttttcttgaatgaaacaaagccttctccggatgaggaagcttgtcagaagcttgagtgactggtaaggagggtgaatctctgctgctgatttactaagaaatatttggatctttccttgaagctaagggtatatacctacttctgtgcaaaacaggtggcatggctggcccttgaagagtacacagtttaaggagacagtaatgggtacagttatcttcttaaagatctgggccactttgttcctgaaaaagtgtgggaagtttctctcttaggcagtctatctcttagagcccagtactcacagcaaaatatttataaaagaaaacaactctttcatcatccctgacatagcctgccctcagcctagaaagaaaaggccaataattgggactgtgtggttccaggagataggacagaaggatagggccaattcaacaggtaagaaagacagcacactcaagggagcagactccagttgatcaccgctgtgggcagctgaggcacactcctcccaagacagctatagaaagtgcctcagaaatgtctgtctctaggacacggttcccattatccatgggtcaaagcttgcccgaggaacgccagctcctttgcattcccaaactttgcaagcatgtgtcatcctgcaggttctcttgggtattccattgtaaggagtctgagaagctccaaggaagaatgcagaaatacggggtatagctgaggccaggtgctgtctgatcatatacctgggaagctgttgttgatcacgtacctgggaagctgtctgatcacatacctgggaacctggttgttatatccatggctggggagcagggtagcagggagcaagaactgtccaacataatctagtttacctatggactttcaaaggtttgcaaagatttacctcctactaaaatggcttgtgagcatggaaggcttaaacattagcagagcaggtagaaaaataacgcctggtaagatgccaaatggtggaaaccgaggcagaagatagtcctctggacaaggtcagcataatctagtacatatgaactcactcacgctcctgcatcagactcccctggttttggaatctgtctctgttgcttcccagtggaacctgagaacattgtttaatcagccttggttatgtattcgtcgtcagataaatagggacgttaataccaacctcatactgtttagattttggatcatttacaatgagaatgtgttcatctgttacctgtgtaactgaacataataatactatgtttgaacagatttcaaaaatgggtttggatctgattttaaaacatttgaaacagatgtggaacaagtttttaaagaaggaaccctatctcataagattgtcaggatcattaaacatcacgagtatgagcccacaggaaaccttcagtatatcgtgatcttcttgacggtggtgaagaaggacaaggaagaccaccaccataacacacgggtcttctttggaatggaggttccaggatctatggggaatttgcttgtccctatccactctcatccctccactggggaagagagagttggtgccagtcttccagcgtaggtcattgttggctcagcatctgggaagaatctgggcctgcaggaaggactcctggacagtgccatgagcagctgataaagaccaagagaggggaatgtggggcctggtctaatgagagttactgccataactggcatttactgagcacatcctacatgtgactctgttctaagtactttctgcatgtcgtgtgttagacatcaagagtcgaggcaccctcattcacattctacacatcatgaaactgagacttgtagaggttaggtagtttggccctcatcacagtgccaggaggtgcgggtgtaagatttgaacccaggaagtgtgattcttgtagcaattgctgtgtggttgagatctggtctgggaagtggggctaacacagaagtgtggataggacagattatttctgcgctccaaagttatgaatatatatactccaaaatatgcttcagtgactgagtgagacataaatgggttactctgtcagtgatcattatattactccccatccctgcatgcatgttagaaaggcacacacaagctggaataatatgaatgacatttaatagactacttacaaaaatgttggaagatctggggaaaactaacgaaggaactttccgtacttgaggcctatcaatagcaggaagttattactacctctaggcctgaaagggcaaggagaagggggccaatggaaccaggagatagaaggctggtggagaggaccgcctaacctgggtggtggccataaagcgagggagctggagagaaaaagacaccttaaactcacttgctcagtagctcccatgagccaaatctagtggaaagccagagaagaaagtgagaagagaagggagcccataaagaagacaggactgcctacaaaggccagtgtctcagagcacaaatgaggatgcagatgagagcaggtctgttctggcatggcaaaggggcttgcccagcactatcagcaatctgcaaaaagatattcttgggaagactctggtgtctgaaagattaaagggaaaatgcatccacgtgataaaatattattcagccagaagaaggaatgaagtactcttacatgcaataacagggatgaaccttgaaaacctgatgccggtggcaacgaccccataccgtgtggttccatttagatgaaatgtccagaataggcaattccatggacacagacagtagattcgtgattgccaggggcgtggaggaggagggaatgggaagtggctgctactgggtacaggatttccatttggggaggtggaaacgttgtgaagctagatagtggtgatggttgcacagcattgatagtgttccagatgtcattaatggccaattttatgttatgtttgttttctgacaattaaataagcaaatacataaatgagaaagaatttttctctcataatgtttgtttgcctcttactcattttctgagctagtcaccaaaacgtatctgacactttcttgcttaacctggcgggagtggtagcggatgctcctggtgcccccgttgcattccctcacctttctgccagctcagcttccagtagccagcgcctgcctgtgtttctctgcctgagggctctctccggctgccaaagcccgtgtccacgcacagcagtaccagagaattaccaggtcccaggagcagcactcgggtgaggactgacatgcgtcaatgtgtaaacaccaacttccctgcactccaggtggggtccagagctcagtgcgtcttgctggctcccagaggccccagcccggttgagctccagttgcctgcagcagttcccaggcttagtgcacttgactgtgctgccacctctcctttcatttcccctcttccctcctggtttctccttcaccttccaaatcaggtggggctctcaagcccttggctcaggatttataataactacggagtaataatagataacatgtattgaatttttattgttaaaatgtgtatgagaagacactggcttgtgttcattttgcctctcttgttcccaatgataagactgccttcacgcatcaggcaaataactataattggttcctggacattagcataaacagaatcccctagggaaagtgctaaaagtgcagattcccaggccccacccatcaacatgctgattccatctgtctaggtgtgagccttggaatctgcatttatcaagcttttctggttcttctaatgcagaatagagtagaaagttttcattgaaaaacactggacactggcatgatgagaaacagaggagaggccacctattggaggcaggcactggcatctggtcagtatttcaacaaatgtggtccctcaagttctgcagggagaaatactccattacatgtatacatttactttctcttaaactgatgggatccatatccaagtatgaaagttaatttcggtatttaataatcattaagtaaagagagagtgaaatatctacactatgtaattacataaaacatgcttctggcaatatttgccccctaggaaattcaaataggaagtctccaaggagcaaggttgtattcttggaggtggacacaaagtaattgagctttgctaatggagataattaattaggaaacggatgtgcttgcttctgagaaaaatattggaaagatcttctgagaaggcctagccctctgctcttgtaattttccgaagtctgtgccaccctgaggactggtgcttcccctgagccatgacccagccacagttaggaattaagggagcagaaaacacacagccattgcccacagttcaggctggtcctaagaatgcctgggccctaggaacacactatctccaggaagcagctctgaattagacctcgggttcaagttccagcccccacttatcagctttctgaacttagccaagttattcagtttccatggagcttagtgttctcagcttaaaactaggggttgtaatagcagaaacagtcatcagtatccagtgaaacaatgctctgcaggaaaataagtcgtagatcagaagatgtcgccctggtgtggtcttactaaaccttccctgtctcagcccggggtcttgtttattgcatctgggttacctgtttgcccctttctgtccaggtttgatctgcaggaacctagccttctggtctaacctttctagcttgtctgcttatcaccccaacctccccgctttctggttccagatgctagcctgttcttgccttgtatatctgacttgctgagctcactcttggtgctgcaaagtggccatgccatgaatcttccatagcccgatgcaatgtcaccccagtgacacggaaggatggccgtatggtgagagactgcattcagaccactgagccttctcttccctaattatatcatgccagaaacagctagaccaaggagtcaagcacacaaatatagttggaccagaaggaccagcagctctcaaggggtaagagaataaggaatcatgtgagcattcatggattgaggaatgcatccattattcaagcaagttgatagagataattaattaggaaatggttgtcttactgtcctattcaccaagctatccacaccatctagctcagtccatactttcttaatgagggagaaaatgagactcaagccaagaaggcaaagacttgatgtggatgatattttttctatttttgctttctggtgatggtagacattatattacatattattaggttaaggtaccgatggttttgttttctgtgttgataaaaattgtgcgctttttattcttttacagaactaataaaaacatgacacattaacctttgacttgtctagtctcctcttttattaaatctgctctaagcagttggatggggagtgccttttcgcctgtctaccccttcccaaggactatttatattgaggcaaccaaatgatcaaggaagaattcgtgaatagccatgatcaaagtaaccagacagggagttagaggttcaatcgtatttggggaaaatggtccaatgatggggaaagggcccaggttttgacacctgaagacatccctggatttcaggaatttgaggcagatccctagagctcagatctaggattcagaacgaaacggtgactgtgagagtaaaccatggtgtctgacataagggtttccttgattaccctttaagggcccctatgaatgtctctgggtcatcagtcccttagataacatcatgtgtctacagctgggatagcaagtaggttttgttttgtgggtcaactcacatgaagaggatgcctagatgtctgcggtgagcaagattctagagctcatcaggaaagtatgctgtagtcaattagtgatgtctgccatgtgcacgggtagagaagttatgtcatgcataccacagactcaccatctcagcttaatagaccatgaagtcaggatctggggagctaccttaatgtatgaggactgtttccaaaatatttctgaaaactattgatactagatcctacctggagtctctactggttccatagcatggaactgtttacaattgcttttgatcctttttccaaatgattgagtgctttggcataaacaggtcaggtacagaaagcacggcatttgagaattatcctctgcaaacatgacttgcaggcatagcctgagcccactcagagcccatacccaagttgtgctttcttaaggccacagcctccttctgagagctgaggaagataagggtggaggacaaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggcaaggcctttctgggagaaatgatccaatgaggggaaaaaatacttcagttttgttgagagatgatcttaatctgtttgagctgctatataaaaaaataccatagactaggtggcttaaaaacaatgaatgctcatttcacagttctggaggctgggatgttcaagatcaaagcgccaacagatttagtgtctggtgaggtcccgctttcctcatccatggtgccatctagccgtgtcctcacttggcagaatggatgagggatctggatggagcctcttttataagggtactaatcccattcataatggctcatcctcatgacctaatcacctcccaaaggccctgcctcctaacactatcaccttgggggttagacatttaacatatggatgttggggggaataaatctttagcctgtagcaaagataatgagatcaggtgtaggtgattaagtgacatctggagaaagaattattagctgctaagaaagatgtgtttgtgcctgtgtgtgtgcacttgcacatgtgtggatgtgtgtgtgtgcatgtgctctgtgtgtgtgctttgtacacaaggcagagtttgcagtctgtgagggggccagcaggtgttcaaccccgcctggctcaggcagctttcgcttcagttggcttttatctcttcctatgtgccctcagccctgtgtcccagggagaggtttaaccaagtctagaatgttccactctgcttagatgccacttcagaggtcttaaaacagaacctttgttttaagcagagacagtcctctttttgatacgtggttttcaggtgctccctttaggaatggccgccacccacatatcatggttcctctagtggttaaatcatgatgaataggcacagagagctgataattaaggtaggaaagagtaccatatttctcttctgcattatccctagtgaattacaattttttctcccaactgcaagtagaaatgataatcacccttagctccacttccacacccttctcagaaatttgggtaatgcatcctcatcttaattatcaaaatacagggttatcatttgcagagaacatgtgttttgtgtttgtggggtctggagagagtgatcatacaatttctaattcaaagcagaatactcttgaaagtaaatcaggactttcctgttgaaactagaacaggaagtcaccttagcagtggtagatctttgaattcgtctcctcctggttctgcggagagccatgagagactagaacacaatcaccagttaggatcaatacacttataaatgcagagggtcttagcatccatttgggtgccagcttcccttgtgtgattggttactggtgtcaacggagattgtatgggagaggaactaaagaatgcaggctcggcttttcccagaggcagcagtgcgatgcatgggtcacagaatatgccagagaacaacgaggccagtcgctcactgactatggaagatgagtccattatttaatcactctggccttcggtttttcagctctaaaaatgagaatattcctttcctcaatgattattgttatgattcccggagataacgtgcatgaaagattttagtgcaggcctttcttccttccgttgacaacccagaatgttgcttgatgcacaggggaaatagagtgatcaagaagagcctttataaatgagagttgatgttgagtaatcattttgggtattatcaatacccatggccataacacccccaccatgtggaacaacacagggaacacgacttcttactcaagctacaacaggagaattcttccttggatctctcttacacagacaacattgtctgtttttcatcaaaatgctagaaatgagagctcaacatttgtaagctcttgcttcgttcaataaagattgtgtatgggaaatccactgcttctctcccttcgtagatgtaggaatctgcctcagacattgtacaaatgggcagagaggggaatggaactgagtcttacccattacgtttaggatttcagggctgcaggtcatctgtttacctaagatggagaggccaagtcctctctcatggtagctttgaagctggtgtcagggaaaggtcagtgcctgtgaacagtgatggaaggtgtgtaaaggaggaggcagggtttagcacaaggggtaactaaatcttaacttctgggatactgggtggtggtggggttactatttccaatttatagcaagatgtaagtgatatcagctggaggacaactttactggtctatgtgggtgtattagtcggttctcaagctgctaataaagacatacctgaggcagggtagttaataaaggcaagtggtttaatggacttacagttccacatggctggggaggcctcacaatcatggcagaaggtgaaggaggagcaaagtcacatcttgcatggtgacaggcaagagagagcatgtgcaggggaactcccatgtataaaaccatcagatgtcgtgagacttattcactatcacaagaacagcatgggaaaaccctgcccccgagattcagttacctcccacccacttcctcccatgacatgtggggattattacaattcaagatgaaatgtggctggggacacagagccaagccatatcagtgggatagatatcatttggaatatggttgccttccattctgatctcattctatcaaagttggtagatcctaacatggtgacccagcaagagtctcttttcaaactggctgtcctcgggggtaggagcagagccagggcaaaccgtcagggatgctaagtaaggagcttcaaggggatccaaggcacctccttggactcagacatgcttgggaccgcgttcgtaggacaacttttactgtccattgccacaatgaaacatggcagtgacagatgtaggccctcagtgatcacagatctatatggcagcaatggttcaagtgcagaaatgacaacagtgtttgtgattttacctttttgtgaagctgggttactggggtttctgtcctggaatctctaaacaagtaaccacagggtagttgcttggctcttgcctcaagtgaaccagccaagagatctcgtccaacactggtatagcctggcagcaactgctacttccaggctgtgtctcgaatgccctgctgggctccatgtgtatctgggaacatggtttctgatctacaaatctaagcccctaaatacacaaaagcgctaaggcaaaccatatgccttaggctcacttttaaacctctctgagcttcagcttcctcagctgtaaaaagaagccatgatcacaggcatgtttatgcactaaatcaaataatgaagctcacaagttcagccctggtcatcaccattcaagactctgaagtctatcaaagcagaattcatgttctctggttgcattttccatcaatggagactcagaaatatttattgaataaaacatcaactatgacaacatattttacagtgtaatagtgaaaacatcattcatctgatgacatgcttcttttgaaccattttgggatggttctgatattgtttgtaacaagaaataaagatccgaggatgatcaagtgagcattcaattattcttaccttcatttaaaaaatatattttcaatattaaggaatttgttgttattgttatttacaaagcaataaaataaggtaagaaaaatggagaggcctgggttggtgatttggtcaccaggcagattgagaatggaaagaaaagggaacagggtaaccatgtgaccaatttgcttcttggaaaagggaccaaataggacccagagaggggcttggtcaggcttcctggtcactgccagtgctgagacattaaagatccaggccccacggagaaccagggcacctggactttgatcttgccataatggtatgcctccatttaagaactaggtcagctgtctttcacaccagctgtgttcttcatgcttagggcaataacatgtataaagtaatgggtatttttctagtagggttaacacacttactcaggtttattcttctaacttgcctgcatccaaacatttttttttttttttcaagataaaaccagcctgtcaaactgtgcagttgacattacttggtaggatgcagaaaatatctgaattagaaatgggcccatacaggttccagtgggaatggctttctcagcaggtatgaatcactgctattaaaaatgtattccgtaggtaaattgttagttatcatattcatccactcttacagaaagccaatgttatcatttgggtccattattaagactatcattatcatagtcagtttagtaacctccttttacataacattggattttttgtgggttttcaagtctcttccaaactgaatctcacaatctaggtttatttttgaggccaccttgcctgaaggctcgaggatgacaggagtgacttccgtcactgccatatttcttctacacttgaagattgttttctgggatgttgctgcaaatggcaaatgtgtttgatgccctaatgtttaacataaatcaggatcatggatgtgcatagccccctcccgtttctgtaaagtattgtaaagggactcctgtcctcagagtgccaggcctcacatttacattctggacaaactgggctgtctgcttgaaagggcagataccacaggttggagcaaacatagcttctgaagaagatgtaatgcatttctgtcccagtaagttgtgcctgattaagatcttctcatagctgggggcagtggctcacgcctataatcccagcacttttggaggccaaggtgggctgatcacttgaggtcaggagttcgacaccagcctgaccaacatggtgaaacgccatctctactaaaaaaaaaaaaaaaaaaaaaaaaaaaaaaaaaaaattagccaggcatggtgttgcatgcctgtaatctcagctacttgggaggctgaggcaggagaattgcttgaacctgggaggcagaggttgcagtgagccaagattgtgctattgcactccagcctgggcaacaagaaactctgtctcaaaaaaaaaaaaaaaaaaaaaatcttctcatgaccccgggtgggtggctggggtggggttggtggagggaaataaatatgaagaagaatggtgagacaaccagtgggcatatactgtgtagactaccagaaagctttggaaatgtgtcaaccctaaagcattgctatttttaaatatttagttgtattttaatatttagctataaatgaagaacttggcttggacacaaaaataacaaaaaattaatatctaagagtcatgttctctgtggaataatcttagggctggtctgtctttacacatttattgatgatccagaagaggaagcacacaagtttgtagattagcctaagctattctggatagaaaatacacagggccctagcacagcctcgtgggcagaagagttcatctcgtgagaatgagcaaagagacacttaagaaaaaaatctgatgcccaaagcctttcatataggtgaccattgtacccacagtaatgaagcagaactactgtgctctggaagccactatgcccaccgttgttcatgaataaaagaaacatggtagatatccttatgcatgtgtgcacatgcagcacacctggcctggcacaacctgctcacacctctgggagtcacctgggtgttggctgacgcagcctggcctcggctgagctgactgtcaaccccgcaactgcctgtcccatcatggaccagaagcagagccagggatgaggatgaacgctctagttgcctgtggcagataaagaatcagtcatctagctgggaaggtaaaggttgagaggaaagccagccaatgtctataaagacacataggaaatgggagaatagagccagtgagggacatgcagagaaacacctagattttggattcatttacacattcagcaaatatttattgggcatctatggtgtaccaggcgctgcactggactcagagatataacaatcagccaaatgaacaagtctggaccttcagggaccctcgtggaggtgttacctacaagtgaggaaaggaagaccaaagtgtttgttagttagttactatgcatcaggtactgtgcacctcagaggccacctgcagtcagtctccctatatgccaatggctgccagcatcttcctgctttggggaattctcagcagccagtagcagcttgcatagcctgagcatgtggcaggtgggacttgatgcaaaatccatacccaggaaaaatcttcaagctataggggtgaaagttggtgaatgggtgtcccagcctccctgccctttggtgggacaattctgaggcctgtgccattaacttcggcagtaccttactcattaatgcaccctttactgacattttctccttctctgtctcacttactacttggggagattgtcttccaaataaactacctgtatccaggtccttcttatagatccactctggggaaaggcaagcaaagaaaatacattataagcctgttgtactattagggatggtgacttccagaagctgactgtgataacctttcctcgggcttcagaagaggctaatggagagttgaagggagaaatcaggaaagatggtctcccctcaatattctgacatgggttaataaggaggcactggttcttaaattgggatctcgatgatgctggactagcagcagcaatatcacctgagaacttgctggaaatgcaaaccctcaggctttaccgagacctcatgaatcagaaaagctgccagcaacctgtattttcacaaggcattcaggagattctgatatatgctgacagttaggaaacactcatgtaaagcatgtctatcttcccttcaattatgtttttcataatctgcaaatagttctgtcacttttaggggatatggctggacaatgaattatctgtggcttcattagaaaagtacatgaattatattgtggacagcaaagttatactgaagtgctgaagggaagtcaaatgcttaggagtgtaagctgcaggaagaaataggcagagaagctgggatagtttacccagcatggtaacttctatgttattaggctcaaatgttcacactctgcctttgaaataagtcattagaaactatattagtctgttctcaccctgcttagtaaagacatacccgaggctgggaaatttataaaggaaagaggattaattgactcacagttctgtatggtagcggaggcttcacaatcatggtggaaggcgaaagaggagcaaagtcatgttttgcatggctgcaggcaagagagcatgtgtagggaaactctcctttataaaaccatcagatctcatgagatgtattcactaccatgagaatgacatgggaaagagccacccccatgattaatttacctctctcttgttccttccatgacatgtgagaattatgggagctacaattcaagatgagatttgaatgggagcccagccagaccacatcagaaaccttctgagaggatgccttgaataggtgatatggcagtgtggtccttagcaatcagaggagagagaacgtgggttctctgtgaatgaaatttatattcctagtttccgtggagctgtgtgcatgaaaaacctaggttctcagtagctgggaggagacctgcacaggcatttttagtatatgtggtaggcagcttctaagtgaccccggtgatcctcacttcctggtcttcacggcctcaggtaatcctcttcccttgaggaactggcttctagccaatagagtacctcaacattgagggaggtgtcttctgtgatcgttttacaaaagattttgccttccaccttgttagattctctctcttgctggctttgataaagcaagttgtcattgttgaggagggccatgtagcaaggagctgggggtggcctcctaccaagacctcaccagaaactaggagtctcagtataatagcctcaaaggaaatgaatctgccagttatcatgccatggactttgagatgagaccccagacctggatgatcctttgaagccttttgaagcaccttgaagcagagaagatagctaaggcatgccctgtttcctgacccagttaacccatggttgaataagtacctctttattttaagcttcttagtttgtggcaagataactaacacatacatgaaagtctaggcttgggtatcatcaaaggacctgctagcagaattcttgtacatgaaaacacagttgtgcaggacatatctgtgcacctctttgctgaaagcaacatcctcaggaagaccacttcccagcttgcgacctaaacatttaggtctaaacacttgagctctaaacatttagttactcgctctcccctgtattaatgtatgctgcataaaggacccccattttcctacattaaaccctgtataagaacctccaagtagacacttatgcaaacatgccaagatgcaggaccacatccaaatgataagttgctgtcagtgaatcattaatgagcactgctgtgcaccctgccacatgttaaaaggtaaaattacattctgatgtttatttgagctattgcctattgccacttgaggcatatttcatggaatgataggagtagagcaaggtatttattttgcattattgacccaaggtgccatcagagtcatgaggtccccattaaaattccagtgaactcttagattctgccattcctagaaaatcttataacattcttggttcaaacttctcatctgtgatttaatgggatacactaaggtacagtgaaggcctggattaaaatgatgtcatttatttgctgcgtacatggtcctgggcaagtaattgaaacaaactctgaacttcaatgtccacatctggattaaaataaaaataaaacatatacttaaacactatgatcataaaaaattcagtgcctggcacttagtaggtactcaataattctgtctccccagttaatttattcacttgcatatagagctatttatgcagaaaagtttatgtgacaactaccagatatggatacttttatagaagagtatccataggaaatggctcagccttctgtcctgcaataaaaagtaatgtttgactccaagtacatgagattgaacagagttatttgagctacttttgataaaatgtgacaggcagactttggtatttcaccaccccaacatttttttatggactgctcactatcactgcaacattcagcacttttttctgtgtcaatgtgatagacaatattcatattcttcttgggtaattgcctttttagctgaatcaatggcttgcaggcatgagaaggaggctgttttatctcaactttatttatcttatgattatactaagactataaaactgaatctcccctccttcccttcctcccaggcccattcccaatcatcttctaaaacctctgttaatactcagcttttttggtgaattttcccactgccatgcttcatgttaccaaaatatttcccttttctgacaacattccaaatataaataaggacctactgaatgaatgaaccaccagtatgattcacccaatcactcattcaaaaaatattctttgaggatttactgtgggcagaccctggagatataagagggagggaggaggatgactatgcctacttgtaaagtggacagctgtggtctcttctagaaaggaggagtgcctataaaggaggcgccttgggtattcttactgagcataacagatggaactgaggagtcaaggagggaagccttctctgattatatgaccatggagctaagatttgaaggaaaacacataatggtgcatgtgtgtggggagggtggagacaggaggcagtggaggagctaagtatcccaaggtggaggaggcagcgtgggcaaagtcctgtcggctggaggaagggcatgttcttggtaccagaagcagctcagtggaaaggatcctgaagcggaggctggtgggccgagtccagaccctgggggccttgtcaacctagctgctttgtgcctggggcaatgaggaggctgtgaagcatcaacagggagatacagtatttagagtatctcaaagtctccctctgtgtggtgtttggatctttctgaatcctcagatgtaatataaattatttgaaagcaaataccaatttgcttctaattctggatctcttactcaggacttggttgcccagaggaggtttaataaattctttttaactctacttcccaccaatttttctcccttcgatctgttcctatatctctaccattcatggcagggttagcacgtggctccaatggtgagcaggaaggacttcacctcttgtctgtcccttagctttggtgtgtgctgctcctaacgtagctttggagttggagttaagaaccatctcatggcattgttgggttaggtattctctgggtccactcaagcttcctatcagttttttagggacagaaagctactgtgctgacctcagtcaaagcccctatctgaattcttgaaagagacatgattgttaggtcactaattgattctccatagtgttagaacagcaggagatttgaacacaagggcatggtgctataccatgcagcctggtagagttgagctgaataacttttaggtttgtaagacagcacatttaatttttaacagattatgtacaagatattgagtgacattaaacacagagttaaatcaaccataacccatttaaagcagccttgcagataaatgtctcaaatctactagcctgccaaatgtattccttatctacacacatttatcaatttttccacaacactaagcctttctaatgtttctctgacagttactttctctcccaagcctgaaattcgggtgacatctactttctgtaaactagatgtgcttgaccagggaaagcccctagatttgtgttaatcttttggggccactgacccttctgggactctgatgaaatctttagtttgctgtctaagtaaaaaaagaggtgatataaacatacacagatttctttttgcataattctattgtgttgcttttgaaattgattttattcacgttatatattattcaaatacatctttactaaaaagtgtcactcactctatatattttatatataaatgaaagattactttctaacaaaaattagaaaaaacacagtcaatgtaagttaatcagaaagtaaaccttaattgtattcaaaagtaaaactcaatgggaacaccgttgttttgtaagagtaagaaattttggtagtcacaaggtctttgacatggcaacatgaatgacagctttgcagttaagttctgcacctttggttttgatggcagcaaatatgtaaaaaaaagtcattgattcaggtgatagaaacaaaatcagaatgcccatagctcatgttgcaacgaaggctgtaacaggaaagcaggccctacatgactcttatcatttcatttatgtcccatgatttcttcaactcagttaggtcaactgtggtggtttcagtgggatgctatctatgtatgttaattatctattgttgcattagaaattttccccaaatttagtggcttacaagcaagtattattacagaaacattgcaatgaggtacttgtagttcagagtctttcacgatactgttgtcaagatgttggttgaaataggagtcatctgcaggcttgactggggctggaagatctgctttcaaagtggcaccctcacatggctggtggtaataggcctcagttccttaccacaataggctctgcataggactcttaaggtatttacacaaaatggcaagtggctttctcctgtgtgaaatatcccagagagaaaaccaaggaaggaaccagaacaccagttatgtcccaattttggatgtcatatattgttacttttaccatgctatatctattagaaatgcatactgagtccaggtccacactcagagggaagggaattaaactctatgtcctgaagggagaaagatcaaataatttgtggatatatttcaaaaccaccacactatgtcatcaaagaaggcgttgtatattcatgattcagttttaaggtggtttgggtaaagttaatagcacagttgatccatattcccaggtactggtgatttccatctgaagagaacaagatgaggctttgtcactctcaccccagactatcctccaacatcctttaatcacctttaagggggccaaggcatttcttttttcttttttttttttttttttttttttgagacagagtctcactctgtcactggggctggagtgcagtggcgtgatctcgactcactgcaacctctgcctccgggttcaagcaattcttctgcctcagcctcctgagtagctgggattacaggtgcccgccactatgcccagctaattttttgtgtttttagtagagacgggatttcaccatgtagaccaggctggtctcaaactcctgacctcatgatccacctgcctcggcctcctaaagtgctgggattacaggcgtgagccaccgcacctggctgggccgaggcattgtgtgtgtgtgtgtgtgtgtgtgtgtgtgtgtgtgtgtgtgtgtgtgtaagttttttcatgaattcaaaacatagccaaatggttttgaatatatagaatttatatttgcactgctgataatagcttgtaataaagctgtggaactatactgtttattgttgccccaacatgacagtgctggtgaggaggaaacaaagactggaggatgtaatctaccccatagatgagctccttgaggatatggctgcatgttaatgttccagcgcagtgattggcacataggggctataaagaagtatctgttgaatggatgaatgaatgaatgaatgaatgagtggagactcatggaatttaacttggacaggcaggttctaactgttgctgtaggcctaggaataccatgttcaaagtatggaagattggagcattggtaagaatgagctcttgaattctaaggcagtgctatctctagtctctttagtgttttctgccaggttggaagagtctttgcatgtcaagcatatgtttgccttcaaaaacaaaggtgaaagctggttgggattgcttgcttttagtgaagaccaaggcaaagaactctatctcctgggtactctctgtagatggtgggaaaaaggaagagaatgtatcaggtagcttttgctctgtgacagacaactacaaaaccttggtagtatattaacaagcagtgctcactgcccatgcatatgggctcagccatcagttaggtggctctgctgatcttagctgagcttgttcacgtatttgaggtgggctttgctccgtgactttcccatattgtagcagtgtagcttgggcatgtttttagagcattggaggaggcatgagagacaagctcaattctacaggtgattttcaagcctgttcagcaagcaatctactggccaaacatcccatggctgagcccattgtcaaagagggagggcactgaatagctccatggcacaggggggcgtgaagaatcggaacattttttacaatctattacaggaagccaaagaaatagctagtttttctctgtttaagaagggttcacacacattgcctttaaaaggacagatagtaaatattttagactttggggccacgtacaggccctgttctatattctttttttacttcttttccttttcttattatcctttttcttttaataatcctttaaaaatgtaaaaaaacagagatattcttagcttccaggctgtataaaaatagactgcatgccacatttggcccgtgagccgtagtttgttcatccctagtttaagaagaaaaaacatcttcatactaataataatatacaatattctgttggcaaaagacattttgatacttgtcatttaattgatcttcatagaagcctgattgttgaaggtggatatttctaatagctcccctttcatatggggagagatgggaacttatgtgatgaaactgggattcaggctgtagtagggccagggagggtcactgatgattacctgaggttgccctgccaaggacagctgcttgtgtcctctgcctctgagaactaagcttccaggaggaccaccggtagtagggagtgcattcagctccatcctcctgagaacatacactctgcaagtggagagaagccatctcattatgttaatttcaacccagcccagactgagaggaggctgatttcaagggcaaagaaggtgaggcagccgattcccaggtcccatttcccttgctccacttcattaacatggccacccttaatgcgtgtcataactctgccttccagcaagatttcctctccactaagaaccttttagaaatggtatttaagagaatgtgcataaaacaagtcttcatggtgattatgacatttctgctgaaccaaaatgtaatcagtacacacattttgcatccttacacttaatccacaaacatagcttttactgttttaccttctcccacccacaatccaaacagtgccacagaacaaacgtaacaggatattaagataatctcttttgtctatgccaaatgtcatttagctgttgagagaggaatgtcccatctagtttttacaaacaataaataatacagcttatgaaggtccacatgggtgacactgatgcaatgtttcaacagttttccgaaaaaggaaaataaaatgagtcatccaattagttggctgggcatttgcctgcaagttgccagagagctttgttgatttatcccaacttggctaagattggcttactctagaagttcgcctgttacagaagtttggtctttactagggtgacacaaagtatattttatggatattagttcatcaggatgctgagaagggttatagcatcaaagacaaatatggctgaacatattggggatcatttaggttaaagaaatttaaatgaatttttcctgcgggacttctcagaggctttaatctgtgaatgtgcatactgaatttccaagaagggtttagaatgtgcagcagtttccaaatctacttgacctgggaacccttttgttcacagggcatcccatgagagaacactttaaagaacagacgatgagaatcagtaccatgcgtaaaacgtgaccaacgttctatgcagaggagatttttgaaagtatccccaccagtgaagagttaccgtgtatgtgtataatgtacataagtggacattagcttgtattttcaaataataaagtcaaactttattattaaggaagatacaagaattagggctagtaagtgtgtgtgtgtgtgtgtgtgtgtgtctgtgtgtctttctatgtgtaaatgtccatccccagggattaagaagtctggatttgggttaaacttaatcatttctaagaatctcaggttttcagtcctgtcctagaatttcaaaaacagtcagagaaagcaactgtgagaagatcacagcttctcatcctgttttgagtctcaccctcctctttgccctcacaaaggatttcagtgattatgttcctgacaggatgcattttaattgttttctggtatgacttcccaatacatcaagttgtgttttctatatagccgctatcccaaatgattactattcagaacactaatctgatctctaaatctacaaagaaaaggccatgtaatttgcttctctttacagtgcattacgtgcaccattgtaagtgctggaacccgcccccccccccccccccccgccccgggcatctccaaactgctgtcctgtggatagccccagttgcatgtgctcaaaagcaaacttcttatctcctccatgagtcagttcctcttcctgtttttttctctcattgcagctaatgacattaccatcccctcaatgtccaaagttagaaacttctgagtaattttttatttctttctcttcctcaccttctactaatattagctgttaaatcctgttgatgctacctctgaaatatttctcaaatccacatctcctttcaaccttgggcatggccctagttcaaggtcctatttttcttagatggaccacggggtccttttgccatgatctctttttccatccaacttataatttttctacaactttgacttccatcctgattactaagacttttaacatttctgtgtgctccttcttctctgggtgtttgacatgcattgtcattctgtcttctgattgcaagtgatagaaacctactccagactagctttcagggaaaagaaaggaggtgtttagtagattgcacaactggcaaacctggagttgatttagctttcatgaaggctagaccttagacttgtcatcaggaatatgtcctatttgctttttctgtcagcagtccttcctttttttttggctgtgctctgtgatcacatgtctcattgtggtgataacgtggcttccagcagcaatcccagactcacagcccatcctcagcatttccagtggagagaagtgttctctcttcctaacactttccatacaaatcttagaaataaattttattggctcttaacatgtcacgtgcccatccttcaaccatttgctatgaacaaggggacaggatgctctgattagccaggacttagtcacctcccctcttctgaagacacagaagttgggacttcatctctacccagccacgtggacttagaatacaggatgggtgggtgcagtttccccgaggaaattggagggctgttcttggagcaaggacatgaataagcggcttacaaagagcaaataatcgttgcttatggcactcaaggtgttctgtcaccccatccaactcacctttcccacttggccttctgtccttgaatgcgaagaaccagagtcccctgctctaaatggctccttttctgtgtgtgctgcgtgtttgctctgctgctgagatccatgcttttcccttgcctgaaacaccctctgtggctgttgcagatgtgttcactctgtaaacgcagctcaaatgccttccaccccaaaaagcctccttaaacttgcccctgctcctctgtgtgaataattttcacagcacatgatctacacttccatcatggttcttgaaatacatgaaatacctaatcataggataggtttcatatgatcccacctcccctgctagacactgacagtgtgacagcagggcccctgtcttgttcgtctcagtgctccccagggcccacatgcagtaccttgtacacagtgcaggcaccataaatacctgttgattgattctggacttgccattcattaagagaagttaatggaggttttctgattcccatcagatgaacaattttggaatgttttatcagtcaaatttctaagaatcaataaaacttccatttggattattctttcccccactcaaattgtattttaaaaatagttttattgtaattgtccccctcaattctgacaatgtgtaagcattgcagaaaatttgtgaatataaaagtatgaagatgatcaaaagcttcttcctgactgatggccattgcatgtatgatttcctctgcctggaaccctgtggcccccagggttcagctccctggtgcctcatcaggcacagcttagtgtgagcttcacctttgtctctagatcttcctgtgcatttagatttttaaaaaatctggtgtatcccctcattggttggctatgaagtaagctccctgtgtgcagggacctttttttagcttggtgagggtgtatcctctccactgctggagctgtggtcagcacacagccagtgagtgctctacaaacacttacagcatcagttcatgaatgcttgcaaacatgcagaggttaccattgcttatacttttttttgttttgttccacttatataaaccacttatatattcagatatttgtgtatatatgcatatatatgtatttatgcacacataaacatactacacacactggatgtatactacacacacacacacacacacacacaatgttataaggtgtatgtaacacactcagggctgccccacagcctctcagtgccctacttatgttccgtccccccaccattccttctggcagcttctcactgtgaaccctgagatgttctgcctgagtgcttgttctagctgctggagcatggcaggccagaagttctggagaactcgtacccccaggatcagctctcaaccagggatgaatacagatggaggataaatttccccactcccttgcccctttggagatgtatttgacaccatttctcagagtctccagggagaatgagctccagtagcccacagtggtacctggactgataatgctttactggctttcttttcatatcactgcctcctggaaccacctcctaaataagctacttacattcgagaactaattccaataatacgctacttaagacaagggagaatggtagaaacaggtttctatacttcacaaaaatgagcttttgctcttcagaaatcacagccaatagattgtgccttctggctgccccctctgctaatgccccctctttgccccctgaacaagggcacccatgtacaacaatgtgtatatacttccttaggaagctggtcattcagagccccgtcagtgacacctgcactcagaatgtaatcctacccagcttcgggggctccaggaattcctgtggcatccgtgttatagactcctttgcattcagctttgcttttatctgtttccaatttgtgttttcaaggcttcggtttttctcctttctgcttcatctccagcccctcctttgcaacagtaccaaataaaaaaacccatgacactgccacagctgaaaaagcctttgaaaaaggcaggtggcgtggcttgaatgtttctaaactctaaaactgcaagccacagacaaataaagaaagaggtgggggtgggcatggggggttgtagtcttgtggaagcaatcctcagccttcagcaggctctaggggcacactgcctctagcatgttttgagcacgttgatttgggcatctgtcttgctgaatttgagtttgaattatggatgttacagaatgaatcattaaggctgtgtccacccggattgctctggctctctggcctgttcacagtgctgttcaattttatgtaagcattacttcaacatttttggtggatgttcttcatttattcattcattcagtatgcactgatggtgactctaagtcttgggactgcaaagatgtctgaggcccattctttactcctccacatctcaagacctaagggagatagacaggcaaatcaataaccacagtgccttgctattggtgctgtccaaggtgggtgctgtgaagaagtgcttaagggcaagtgctgcagaggcaggcacacctggggtccttttcctggcctggggggtccaggaaggtttcccagaggaagaagcagggctcagtcatcaagagctaaggatatgccgtcaaatagccctggcttattagaatctgctttgcactaagcctcctgaatacttaatttccccaagcctcagtttcctggtctgctaagtggccagaataatatttacatcgtggatttgtatgaaataaataggataatgcatgaaccatgcttagcgtgagccataacacgcaaaagcaacataatcagtatttgttaattgtaacaaatcaagcccgggatattgacagacacctaaggcagacttgggagacaatgtctcttgctgctgcctcatgaggaaggtgaatgaccatgcattgccactggacgggaaaataaacggtttcttctttttattcttgtagacaccagtgaggcctaccatatacctatgtcaaaacctgcaatttatcaaaaataaagcccgagatagtaacagtcttgctgaccacaaaggcaaaaggatccaggtaaacagattgcttccaggactattatttcatgatgagctttcaggtatatagcacatgagagggaggacaaggtgcggctgcacttcaagagaccacgttggacaggtgagatgtccaatatattcttacttaagatctgatttcttctccttctctccagcaagggatgcccagagatataacaattagaattcaatacgctaatacagtgtctcattagccaagccacacaatcgcctctagtggtccatatgcacgacaacccgggatcctagaaattagctcggcttcctgcatccgtccccatctgaatctttactcaactactttttgattgtgaagagccaagctcatttgagcagtaggaatttcatggggctggtgatcccaagactaattcaaaaattaataagtttcccattccttttcttatttatttttttggtagggacacatttcaccacacacgcctgcttctttcttgccagtatttcattcaaaactagtcctcaagttttgaaattttagagacttaaaaaaaatcaataatgctttaagaagattaagaggctgtgcttatgtcagccttagacaattctggagagaagatagacttgattgtgcttctcattttgtttatgatcctgcaatgtatcacgcattctctgccaagtgaattctgactgcatgaagaaggggtagatgcttttacaacaggtttagtcatctggcatattatttaatacaatcagtggtgttttccttcgtgagatgcagccttatatacaggctaggtgttaagtttatacccaggttatctacccttccccctcctgtcctctctcccaccctgtttttattctgtcttccctcccttcttcccttcttccttattctctctcttcctccctttcttcttcatcttcctgtcttcctcactcctcccttctctcctccccatcttctttccctttctttccgcctcccttctccctttttcgctccctctttcccttcacaaacatttattcaaaccctattatataccaggcacgatgcaaggcactggaaatacactgaacagggcagatgtggttcccgttacatgatgagtaacacaggtgataaataaacagttaacaagataagaaaaatggccagcgagtatttggaagaaatagacaagtgatagggaatggctttggggagaattatctgcatataaggataagggatgagacagactcagcagccgtttcatgccagggcagagtagaaggccgtggagctgctaggtggttggcctggagaaaaaacaaggagttttttctgcaaagtgctggtaggagtttacagttctctgtaatgttcagaaatgcagaggtcagcggaggtgggtggatcacctgagggtcaggagttggagaccagcctggccaacatggtgaaaccccgtctctactaaaactaaaaaaaaaaaaaacattagccaggtgtggtggtgggtgcctgtaatcccagctacttggaaggctaagaaaggagaattggttgaacccaggagacggaggttgcggtgagctgagatcatgccgctgtactccagcctgggtgacagagcgagactctgtctcaaaaaaaaaataaaataaaaaagaagtatagaggtcatttttaatgtgagaatgttctcagtgaattaggtatatgtgcctgccacattttccaaaccaatgtttttacgaatattctagtttagccctctcttctagagttataaaattattctgccttcagttctacatttagggagtcctcttttaaggaaaggaaaaggatagttaaatcaggggctgtcacagaagcctcagattggaggacaaggcgtggaccatcccctgtttggcgggaaaatagctttagtcacaggcaggttgttttgcttcctaaagcgtaaagttggaaatgtgataatttcgtcaagtagttgatttagttgtatcaagcttaactaattaacaccaattccatgcttgattcttttctccattaactgaacaaaagccattgctaatgaggctatgtatacaaagccagctgactcattttgttatggagatttcaaagagaagggagttgtaaacatttgtagggaagagataggggtagacatgatcttacacatatttaacaacaggtgcaatacaggcactggccaatgagaatgagcaggggtataatggtgccaccagcacatacagaaggagtaagaagtatcctcaaggcacggagagatgatagggtgcagggcctttgcactgggcttattcacaggcaaaatatttttccttattttaaagaaatggaaagaagtcttcctagaagccagggtctgtgatacatgacagagtgaccatagcactcaggggtgcagagggtgtgtggattctgatgacagattgcctgtctgattttgcagaattagctccaacatggttttggtaacacccgttgccctctttaagcttgatgtctctgttttcatgtaatttgcacaaagtaggcactcactaaatatttgtaggtgaagacgtgtatctcagcacaaagcagcctcttggactaccatctgtgtggtattcaaggttcttttggtttcagagaagaggaacacagtaaaatttacccaaagaaaggagcatatgtgtcggttagggaaagaccaagcttccataacaaagagactcccaaatccaatggcttgataagatgagcctttatgtcatgttttggtcccttggtgagaggcaccgactggcaggctggctttgccctgtgtaatcattccatctttttccttccagctgttgctcagacgtcaccttgggcatggtccttgtctgcatggttgaaggtggctcatgtgtatgtctgcttttcagtgcacgcatggaggcaaacatctgtcttttacattagagatgactccaatgttgcttacatcacactgttcgcatcccatttgctcaaatgtggtcatatgccacatacagctgtgagtgacgctgcgaaatctagctggctggctttgtggcatggcttgcattcttctgctgtgggagagaaggaggagagaatgggttttagtggacccacagggagttactataaaagtgcaaatagggcataaggggatgcaagaaacactgaacaaccaggcatcagagtgcaggagcctatggagttcagatgagagctctccttcgtgcttctctagctctcactctccatctctcacactttctctttttctgtgtgaagactccactgtctctgtctctccaccagcttcctctgatgtcctatcttggatctggccccagatagtatcctctactttcttgaccttgggttttccaaagccaactggtatcttcttacttgtctcttgattctaatttatctaaagggaagatctgattcgcccagctcaagatagtcagggtctaaaacaccatgaccactctaaaaagaggggactccgagtcagctgtctgcgcttatccaatcagatgacgctgggcaaatggagaagctgtcagttttctgagacacccctccccagactgacccaaacacaacttgcacagtgtgaatatcagagtactatgtgagaaagtactctgtggagctgaccagcatcagaaattctgctagggctctcttataaattgataacttgtttctcagtcttttatacatttggcaaccgtgaatctattctttagaaccagaagagtcctgagtgatgagttcatagattagagattctcatacttcacagttgagaagtggggacaggcccaagggtaagaatcagagtgagctgccagttacatcgctggtcagctcctctttcactgcagtagatacaatgaacataacaatggatataagctccaattctatccagttttccacgaatgaagatgagtctttgaatacgcccttagcagttctcaaaaaccaatcagcagaacaagtctggccagctcccactttacatggacattatcatcaaaagctattttaatcccaggaaccaagaaaaagaaaaaaattctgaacttgcaatttttttctgttttctgtttcatgccacaggaataatttttaagaaattctttaaaatagacccaattctatgtcttatttaaagcaacagatatgaagcagtctgtgtagcagacaaatttaatggttccaatcaggggcttggaattagactgcctaattttaaattctagctccatgcttgcaagggatgtaactctaggctggttactcagtctctctgatgtttctgttacttcatctgaaagtgtggataacactaataggtaccttgcgaggctgtggacaataaatgagataattcatgtcaagtatttggcccagcgactgcgacatagcaagtgttggctgaagataattattaggacttcacatgagcgttgttggaggagcttagcttgtttaacctggaatagaaaagatatggtaaagaggatgcaggagcttccatttagtatctacagggtgggccatcctgtttcctgtggcagagagagaagaggtagaaccaatagggaagaaatcataggcagacagatttcagatcaacaaagaaaggcaaaacagatagagctgtccaaagaaggaatgggtttgaaagaaataaagccccagaagggctctagatgaggatgtgaggttggataagctacataagggatgtcccaaagtcagaccatcttctgggcttgatagcatgggttaggatgggctgacaaagactgccttaaataaaagtatgcatacacacacacacactacacacacacatacacacaatacttatatgtaaatacatttaaatatattatatagatttaatatataatatatagttctatataaatatattttaaatttataaatttaatttataaattaaatttattatttatatattacattaatttatatttatattcataaatttatatataaatatatttatataaaatataaaatatattttatatgtttaattatatataataggtggaggcgggtggatcatgaggtcaggagatcgagaccatcgtggttaacatggtgaaaccccatctctactataaatacaaaaaattagctgcgcatggtggtgggtgctgtagtcccacctactcgggaggctgagacaggagaatggcgtgaacccaggagggcggagcttgcagtgagccgagatcgcgccactgcactccagcctgggtgacagagtgagactctgtctcaaaaaaaaaaaaaaaaaaaaatatatatatatatatatatatataaatatatttctatatttataaaatatataaagtatatatgatatacaaatatatttacatataatataatcattttatttgatttaaaaatatacagtatatttatatatttgtatatttataaatgtattttatatattgtatgtttataaaatattagaaaaatatatttgtatatttataaaatatataaaagtatatttatatacaaatataacctataagtatatatgtatgttttacatacacaaatacttttatacataaatgtgtacacatttcagaatcaaacagcccattataagcatatatgaaagaacagtttgatttggcatattttataaactgtcacctgattttttttttaccccaacattaaaaaaaaaagctagtgcataaacaaggtgcagaaagaagctagtcatccattcatctcttcttgtgccagtgttacaatatctagtagctgaaagtctgggccagtcatttgcccggaccgcattatgtctgaatacctcctggcagtttctacgtctttctcagggcttctaaataggaatgaacatgaaagggccgcgtggcagtgaccgcagtgtggaggttctaataatgactatgagggacacacagttttcaaggagatctaacagtgtttatgaaagattctgtttcatctcaccagtgaagagcccttcatcatctaccattctcttaaggatagagtcttagaatctccagtgatcctgcaggaccctcatcccgtggttttaaacctgtgttctccagaggtctagcattgagcggtggcacttgggattctggaatggggaggatgcaagaggaacacagtgaagtaaacagcttggactctggcccttcaagcatacttcatccactttcatctgttttaggcatgtgggttcaagaggtgatgccacttgaaaaaagattagagggttctgaaaaaatcaggtgtagaattaattccaacatagacctaccttcttattgcacagacaaagacactgagatccagagacattgaggggctctcttgggctcccccaccttgtccaggggaaagtcaggactgggatccagcgtatagtcacttgctacggctattcccattatgttttgctgctgctgaaacactggaacacattctaaagttcagacactcaggaaataccccacggtgataaggacaaccggtgatgccgatgagttcccaccaggtgtcagtgcctcgaggacttgtttaatcttcacaacggtgctctgagttaggtgctcatattagttccatttaacagttggagaaaatgaggctcagggaaattaaatcacttgctccacatcacacagctactaggcagtcaatgctggttttgaggctaggtgatctcagtccagaggcctcagccttaaccattctgctctctcgccttcctgcattttatactccatacttctcttgggagaaagatactatcatattatttcgtccaaacttaccatatcttaaaaaaaacttaccagcaaacaaatcatccaactgcctttcatctattgaatgttctacagacttaacgccattatctcgcatgaccttgatgaagatagtaaccctccctttatcaaaatggtcaatcttcattaatttattttactaattagttaaaggctggtgtaatttagagaaagtctaaattatagaatacattttattctgtcactttgaagcacaaacctccacaaagatttgtataaaaatgctcccttctgggactcacttcagtgatttgtagctaccattcatactgcctctatgtaaatgaaagggaggcataatatcagcaccttgcgtattcttctccatggtaataaatcgtgcctgataacctatgaaaatggcttcatttttctcttaccacgcctatcatggtggctttcaaactcactaccctgtgccccacctatcacacctgtcctttgtccctttctcacatggatgtctacaaaatgcagcagtaaagtgttccataatccacacttcagtctacataaatgtttaattcccctgccccttttgttttcgtcaggccccctgaagccgcagctgagatggctgactccctgaactcttcttatgttcttgactgttcgcatagcctttcctgggattacctcccagttccaagtttgcccattctgcaggcagtcttcttgggttccagcttttctccaccatcagcttctcccctagggctcttattaactctccgctctctgggggccactctcattttcagcttcatgtggatcagtgattacttgtcctatctcctctcctagaacgtgagcttcatcaaggaatttctctctattgaccctcaggcatgagcacaatgtcctactccctgggtgcttagttaatgcttatggagtgaatagaaccccggcgtgtgtgtgtgtggtgtgtgtgtgtgtgtgtgtttagggaaggcaaaggacgtttggcaaaaaaacaagttacctgagggaatagcaactcgaagtcattgtccctcaatttgggatcccggtaccacccgcataagaatcttttggatgctgaataaacctgcagtttctccagcctggccaagacctatcaaagcagggttcctgggtatgaggtccaaggatctgcaactggaacatgctctccaggcaattctatacacactggtatctaagaaccactgcgctcagaactaggatatccatcaagcctgatttgaagtacctgcatgagtcccagtgtcatgatgagatcaagagagcttctgtgtccttgaggggctggagtatgcgtccccctgaaaccctttccctgcctgcccccagcactgttgggtgtcccttctctgtgcttcctctgccaacactctgtgcggtgtttccgggagtcagaatggcagggtggtcaagagtacggactcagaggttgcagaaagataaaaagatgattgcattcatgattgttatgatgtcttgtacatagaatattgtcttatttgctctaagactccattaaaaagccagcaaaagcaaatgcataccagaaaaacagtggtgtgctctttgaatattaggtggcctagtgcatgtttcacctaggtctctgactaattctatgagcttgggcaaattatttagcttctttagggcttctgtatttgtgaaaaaaaaaacaaacaaaaaaaaaggaaaacaatagtttccctttaacagggctattgtaggaatccagtgagatcatatcttggaagtgctcagctgagggcctgggcgggataagtactcaaatcatacccttaatatcattattcttttttgagatcaagtttcactcttgtcgcctaggctggagtgcatgttggccaggctggtctcacactcctgacctcaggtgattcacctgtctcggccttccaaagtgctggaattacaggtgtgagccactgtacctgaacaagtgggtgttgttttaagccactacatttgtggtcatttctcccagcagccacaggacactcatacgtccataaaggcagcttctctgctctttgatgcctctgactccacttaagccctcttccccagggctgaaccaacatacccgcttccaagtctattaagtattgaattgtgttcccccaaaagatatgttgaagtccaaatccccaggatctgtaaatgtaacactatttggcaacagggtctttgcagataatcaaataaaaatgaggtcattttggggaagaagctaatctactgttactgatgtccctgtaagaagaaaagagggtcgggcatggtggctcaggcctgtaatctcagcactttgagaggccgaggctggcagatcacctgaggttaggagttcaagacaagcctggccaccatagggaagccctgtctctactaaaaatatataaattagctgggtgtgttggcatacacctgtagtttcagctactcaggagcctgaggcaggagaatggcttaaactgggcaggtgctggttgcagtgagccgagatcaatccactgcactccagcctaggcgacagagcaagactccatctaaaaaaaaaaaaaaaaaaaaaaaaaaagacacaacgacacacagagaacttgtgtgatgatggaggcaaaaactggggtgacgcagctacaattcaagggacaccaaaactgccagcaatgaccagaagctaagagaacagcatgaaacagactgccatctagagccttcagaaaggacatgacttttctgacactttgatttcagactttttgcctccagaactgtgagcgatcacatttctcttgttttacaccagccagtgtgtgatactttgttccagcatccgtaggaaactaatacaaagtcccaaactctttccactatgtctagatccaaagtcaccaagaggcctggcttggggcagcactgggaacttagacaggaccctagctaagttccattctgagttaataattgttattaactcactcagttcatgcccagttagcaagcatcatgaagcacattaagccaggatatggcctttctaaatgtcctgagtatcaggagaagctttttcacactgcaaaagccagtctaattctatgacttgcaggctgaaaatcaactatggctgcaaccaagtcacttagccatcatcagcgccaatcctgcagtgcttatagccaagtcagggcgtctgtttgttgagaggcaaaggcggccccgccccatgctctggtttctgcttgcaccttattaacgggtaatgaagagtaggttctgctttattgatcttgagaccagagctacgtgcgatgctgcctaagaaaagccgcaaaggattttatttgatttttgcacacaacaataatctccctcaccagattagctggtgaactggtgggcttttcaccttgaaattgttgatagggtagccaaacaggaatttctatatttgctaatccttcctcaaatacacatccccaccgtctgtgccctgtcaagtgggtacctgggaaatagcagagaccacactgtggaaggggagacactccagtgcaggaaagatcagaagaaagaggtgacaatgacatgcagcacgaagcagcgatgatggggttttttctttgcaaaattacaagccacagtctcacctcattcctacctgccttttttatttcccctgctctcaaaacatacctgactagaaaatccccagtccaactccaggaatgccctttcttctttagccacatcacagtgttaccagatgccttttatgagctctttggtagaaactaagccatgtgtcactactgggtgttgaaaactcaggagtcagcttccctgcagtctgctggcgctcagttctttggctctgcctaaagtcggataaggaaatgaccttccaggcatggtgagatgagtccttaggacacagaagggcaggctggcctggcctcaggagactgcaacagctgccagagagccatggcactcctcaatcccccgaggagcctggaaaagacttccctcttgggttcaggcatgtcctctgcttcctgcctttatggaaactggattttcgggaccttggaggacctcctatggggaatagaaactaacagcccatcccgagcctgcttttccatgggaaaggtggtgggaattctccatgtcacctttgcagagagagagagacaaacatggatccaaattagagatggcttcaggttctgacggattcatctctcccaattgcctttgtaacacatctgctaaatttagataagtcacaaatagagccaaaagaaaatccagaagggagccacaaaaaattattaaacagttgtaaaagttggggattatgagtggaggaatcggggttatttatcctggaaaagagaaggctgaggagggacatataaagacttcatactagattaattatgtaaataagcagacacccagctggcatggaatttcaaccatttggcagggagagtgggtattaaggggggtgactagttgttttaaaatcattagttgcctgcacaggtttctggaggggttcactgttgctgagtaatacaagttatgaatatgccaggtctgttttaatgagcccagacttcacccaccaaaaatcctttccagccaagcacgtgataactatagatcttctttgtcctttgcctcaagcagaagccttacacgggtccgtcgtaagatgcacctctagggctcattccttcttcaagtcccggtgtagagtttggtgttagaagggacaattagagacttagagattccttcgtccagacaggaagatgctggaaggagtgccttttggggaatgagctgagcttggccagatgctgcagttgtgtccccttgctgaagttagtcacacttggctgctggagaagtctgcccaggtgcacttcataaccacactgccatcttctgcctttcattcaacaggacatgaattgagcacaggctggtcctcctgagccctggcccaacaaggctcctgaacctgggcccagagatgcataagaggatgccaaatcacataaaaaataagggtatggtgaaatcccatctctactaaaaatacaaaaaattaataaggtgtggtggttcgcagctgtaatcctagctactccagaggctgaggcaggagaatcgcttgaaaccaggaggcggaggttgcagtggattgagatcacaccactgcactccagcctgggcgacagagtgagactttgcctaaaaaaaaaaaaaaaaaaaagagcccccccactcatccacacttactctcttacaatcctggaaggcaacttgtttcaatgggctagaggcaagttgttggctagaggagattccattgctggactcttttagatcctggtggttcccgacattccttagcttatagccacatcagtctagtccctggctccgtggtcccatgaccttttgtgtccaatattcctctgcccccctcttatgaaggaatttgggattctatttagtggctacccagataatccaaaataatctcttcatttggaaatcattaatttggccacatctgcaatgtctttaccacaaaagttaatatagatgagttctagggattaggatttggtacctttggggatcattattcagcctactgtagtaggggttcatcagttagtgggggggaagtagccagtttattcccaaaatgcatgtgtcatcacaaaccaagatgagtttcctaaaagaaaataagatactactgcgaatgtcacccaatgagacctgacccattctgtgtgtgcagggatgctgttttagttgggttcccacagaagcagaccctgcaacgatgatttgtgtgcaaggtgtttatttgagaggtgatctcaggaaaccggtaaggcagtgggggaagtgagacagggaagaaagggcagccagtgatgggagttgctttcaagcagttgcttgttcttatgggcagctggagctgaatcccactggggactctgggagacaatgaaaaccacatctcatagttatccccactgaggaatgagggacctggggtatttatctaccaactccccttctattattggttgagtccctcttctgacgagtcacaggtattcccagtaagcagcctctgtagggcacaggtgagtgatgatgggattcaccgctgacagctctgctgtagatttccccgggcaggtgacctctgaactgccacctgaagtagaagtaggaagtaaccagcaactggggtggggatggtgaagaagaaggagaaagtgttaaggaaggaaacagaaagtgccaagccctgaggtaggtggggcacagtgtagtgttgtattagtccattttcacgctgctgataaagatatatctaagactgggcaatttacaaaagaggtttaacagactcacagtgctggggaggcctggcaatcatggtggaaggtgaaaggcacatctcacatggcagcagacaagagaagagaactcgtgcagggaaactcccctttataaacatcatcagatctcgtgagacgatcacaagaacagcatgggaaagacccagccccatgaatgaattatctcccaccaggtccctcccaaaacacgtgggaattatgggagctacaattcaagatgaaatttggatggggacacagctaaatcatatcaagtgtccagagtgaaaggagttgagatggaacagcatctcaccagacctgagagccatttggtgcgtgttggatgcatgtggtccgtatctgttctggttgattgatgcctgtgccttgacatttgttcaatattttgaatatccttcacactgaggtcaatatctctttccctgggtggttatgagccttaaatcagctatgccatgtgaaagttatttgcagtttgtgaagtcctgtggaaaggttgttgctgtttttctgctggggctgttttaagatgaaacatggtatgggggaaagatgcaagctctgggtcccattctcaggagtttccacgagcaggaacctcacatcactgccattggcctgtaatataattttggcctgagtctatctgggacaggtggtgtggagatgcactgttactaaagacttaaagcttggaacttaaaagtctacattttctttggagtcaggtggtcctgtgtgcaagtcccagttccaggcccttccactggctgtccaatggcttggagtctgaggctcagttttcccacttgcagaaggaaggaatgatgccaacttcgtaagttacatgagatgtgaaggcagtgatggaagtggagctggggctccttccccctctgttttaagcatttgattaaaacaagttaggatgggcgcagtggcttgtgtctgtaatcccagcactttgacaagccaaggtgggtggatcacctgaggtcaggagtttgagaccagcctggccaaggtggtgaaaccccgtctctactgaaaatacaaaatttatctgggtgtggtggtgggtgtctataatcccggctactcgggaggctgaaacaggagaatcacttaaacctgggaggcagaggttgcagtgagccaagatcacgccactgcactccagcctgggcaacagagagagactctgtctcaaaaaaaaaaaaaaaaaaaaaaggtcttactgtaccatatgtcctcacttaacttcattgctaggttcttgaaaactgtgactttcagggaaatgaaatataatgaaagcaattttactgtatgctaaatggtataaacaagagttaaattcttacggcacgttcctggtcacaaaaacattaccaaacttcttaataaagacccaaaacacttctaatattaaacattgaaataaagatgagctatacatacatttaagaaagatgaataaaaacaagtaagataatcgtttgctcaatttttggtgaatcagtgagtgacggtggtcgtagtggtggtgggttaaatcaaggaataaaggtttgcaaagcgaaaattgtcaggggcacctcctgccaccgtgcagtttgaaaacaaacaattccaactaatggcagactgactgagtgctttcttactgcattgttttttattgtgcatttttatgattattatacacagtacttcatgagtttttgttttacaatacttcgtattaattaattcaccttccaaattgcttagtctataatagtttagggtcttgggtggccaaagcctctgctagcacagggtaggaactgaccctggacaggacatcattccatcgcagggcacacttacacccacgctcacactcactcatactggggcaatttagatgtgacagttcacttcacatgcacaactttgggatgtgggaggaaaccagaggacccggggaaaacccacacaaacatggggagaatgtacaaactccacacacagggtggtctgggccaagagttagtgtttttttttttctcatcaacattataataaaacaacattgaagaaaacagcattatatgatgtctggatgtatttattgttcatgatggccaggtcttcctgcattgttgtttgagtcagtcacagtgagttggcattgctacaagtcactgagcaaaaggccctcgcctggctcattcgccaatgagtctcctgtgcctgaaacaaagcttggtaaatagtagatgctcagtaaatactaactgaataaatgagtgagtgaggtttactggagaagggatcaagaacctgaattgatttagctctccccacatgattatgggatgaagccatgataattactggcacaaaacattcattttatacataatggaagtataaccagggatgcaaagtgatttgctccaagggtgctcagttaatttattcaatgaccagtcattcctctccttgatttaacaaacattcattgagcacctacagtgttgctgatgatattaaaacctcagtttctatcaaaaagcataagacattgcccccacccttgataagccatgacttggtagtgggttcacatacataaacaaaggatcatattgcaatgtaccatgatctagtatttacacacatgatgtgctgaaggaatacagatgaaggaacatcaattctgccttggggcccaaagaaaccagttgggaaagttatatttaggatgagtgagggacacggaggttcagaggtcctcaggcagttaaagagggagtagggtagaaggtgcaggataggtatgggcacatggaaggtcatggaactggccagtcacccagtgaggctagagtggaacactgctcacgtaggcaggaagaaaggtactccaggtagaagtaacagcaaagtcaaagaaagcagtcggcaaagagatttgtaagtttgaagaattaaaagatgaaccataggaatgaaggagagtgtggcaagaaatgtactttgacagagagaacttgtgccaggtcattctggtctttgtaggccatgatagagagttcagattttgttctaaatacaatcaaagccattaggaattgtaggcactgtacttccagtgagctaagttttggggtcagtctggtcactgtgatggagcagagagggcagggaggagagtcatcaggaggctgtaggtgcagaccaggggaaatgccagttagactacactatgctgtggcagtgggaatggaaggacctgatgtgctttcctgaaatgtagttggggcgtgtcacatgcttgagttctgtgtccctaccctctctcactgacccatagtcggacagaccacactgccactgggcccatcgggaggcagggatgggattcaaggaagacttgttggtttggatggaaacacaacagagtatagaataaactttttttcaaatgttgtttcaatttaattcagtaagcattggagatgtattttcatcagaaccctctcaattttaaggggttaatgtctaactcaaatgggaaatgtatagttcacttaactgaaaaggtccagggagttgagttttaggcaaaactgaatacaggggcttgaatcttgttaaatggtttctctccatctcttggctctacttttttctatggtgacttcactctcaggcagggtcttcccatgtgataccggctattggcagactcagatctgtagccttataatttcacaaccccagcagagagagagagggctgctattactgaacagtccttgcagagggctggcaatgatttgcccagtttgggtcccatgaacacggtacaggtactgtgccagatgaactgctggaattggctacgctagggtcacatggccagctctgcagctggggatggagtcacccttattttcatggaccaagtatggagagtgaggtgatttcccaaagacccactaggacactggtatgtggagaacatgagagatggcaggtagacagaaggacaggtacctactacgagcacctgccattgtatgcaagctctgcctagttctcctgcaggaagttcaggagtgaataattcagttcctatccccaagatgctcacagggtaccagggatgcagatacatacatataagcctttttcacgtgagcccacctgtgaagagtgccctgatttgatggcatgtccagcaccaggaagctctgactgcttttactcaaatggcacctggggccaaggcacatgttttctcacatttctattttaagagtcaataaatcatttctggtaccttaactggatattaaatcagggtgtttttcttgtcccctaatacagggccaagatgtctaaagttgaccttcagtctagtccaacatctggaaatgagtactaaagccaccagcacagacaaaaatggagaacaggtggacctggggaacagtctggggaaggaggggttccacatgagaagttacctgcagggagcagttgggtggcttgagttccagcctgagaatgattgtaatgtatctccttaaatccgtgtatgtaggtggcactctgttcctccttatccttgtatttcatctgctctcagggctgtgtttctttgcttcttgtgggcttttgcttttcagttcagcacatatttattgaacctttttgtggggactggctagttattcaccagctctcttccttctttgtcttgggaacatagctaggttatattccccagcctcccttaagttctctgtgactggattctggtctgtgggatgtgggatgatgtaaagtccaccttacttcagcaaaacctcctgtgaagttctccatgcaaatttgccctattcctctgtctgccacctggaagaagaggatctggtgggggacagtggagccacaagatggaaagaggagtctaggttcctaaatgacagcaaggagttgtcaatcatccaaactcctgtgcaaatacaaaactccacaccagattgcgacaggagtgaaagataaatctttacaatgttcacttgttgaaattttggagttattttctttttgtttttgctttagaatatagaatttagcctaccttgagtaatcagagttaaaaaaaatataagaaattgtgccatgtgctaggttctcagtgttgagcaaagcaggtgctgctctggccttgatggagttttcagtcttacctgttattttttctattcccactccgtcttccactccttgcaggcaataacagatgatgttgggggcaatagtcttgaaataactctggtaagtgcccagcagagccagatgctgggctgagttttgaaaatgaacaacttcattggtactctctgagcctttcttggagtggggcttgtctgtgggtcacagcctgatcctttaggccttgtgaagcttgaaagatcctacaattgtgcagggtaaagaggttttttgttatatacacaaattgtactttttcttatttctcatttttgttctcagacaagtccttctaattagttagaatttcattaatccagtcatccttccatccatctatccatctatgcatccttccgtccatccatctatccatccatccatccatatatttattctttagaggtagttttattaataatagttgtcttttgtcaaatgctcatttgccaggtgccatgctattgatatgactagtcctttttaattcaaatgacagtcctacaaggcaggtgccatgattatcacttaataaatgataaactgaggccttgagacatttcttcagagtatgatcccatatatgttttggtagagcctagattcatagtcatgatgctgtccttcattctacatttattgggatgccctcaaatgccatgtctgatggaggcatccccacctagagtagctgacttgaaggagttcacactgtatgtgtgtgcacatgtgtgaagatggatagtcaaaagagactgtcatgtaaacaagtaatgcaattggaaaggtgctgtgcaaagtagctgagagaatcacagggccctgtgagagactggaaggcacccagatgatccaaggtgatggccaaacctacaaacaggggagccagggacaagagcagggatgattgaatctagagtcagactgatcgtacaccctcagtcttccagttggatgtccttggctgggtcagccattctctctgtgactcagcttccccacctataaaatcaggataatttagctcatacttaaagggtagttttaaagattaaataagatggcttcttaaggattaactgagataatacattttaaatagggcttggcaatactaagttcttgataaatattagcttattttgtgataatgatggtcatggtgatggtgatgatggtgttgatggttgtgcggatggtgatggtgatgttgatggtcatggtgatggtgatgatgacagttgtgctaatggcgatgatgatgatttggaactagaatcaaaagaatgttttcctgctgtttccctcattgcaaataacgtacatatgtctctttccccatactcgttattgtctctcaagttctgaattgtcccagctctatcaccaaaccaggtttgtggccttgggcagagcataaaagatgtcttggcttattgttctctctatagtgagggagaatagtgggttctggagctggactgtctggcttacaagctagctccaccacttagcagcaggatacccttgaggaagtcatgcaactcctcagagccccagctttctcatctgaaaaatggggatgaaaatagtaactgccacatttaggtgttttaaggaatggtaaaatgatctgcataaaactataagcctcattcctggcacatggtgacctcttaatgaatgctagatatcctcattttgaaattaagaggtgccttcaactttacttggtggcttttctctatacattgtacctttatttttactttggaaagttgtatgcagtgccccgaatgctgacttgtaaactgatttgaacaccatcctcattccttttggctctctgagaaatgttcttttttaatgaatatgatagcaagacttacttattaccaggttatttcaggcaagagtgatttttaactcattaaccagataattattgcagttctccagttacctttctgttcatagacttaataaggcctgaggttatgtggcagagttttcttggctaagatgggagaattattaaagctctcaggtgaaggtgtgaaacctttggtgcacagagggtggccgtgccattcaagcagtccgtgatggtgagagggagctcagctgcttagggaactggtacagggtttcattaatcatgggacatttctggtgtacttgaaaatgttagttttacttatgggaaagatatccagacgtaaatgtgtgtgtgctgtgtgcatgtgcgcacggtaggttatacagcaccaaggggtcaaatagactggttgactgtatcctgtagtggtttggagcaggtgttggcaaacttttcctgtaaagtaaatattttagccttggcaagctataagatcttcatcacagctactcaattcagccaatatagtataaaagcagcaagaagatacatataagtgaggatgtgactgtgttccaacaaaactttattgtggacattgcagctggaatttcatataattttcatggaccacaaactgttactttcttttgacatttttctactgtttacaagataaaaaccattcttttctcatgagctgttcaaaaacaggtggtaggtgggatcttgctggtgggctgttgtttgctgacctctggattacagtctgcatctgttgcagcttatttcaagcaccgcttgtttcattatttactttatcgccttgggcacactccataagtagtcagtgcctcagtctcctcttctgcaaaagagaaatcagagacttcctatgttggtagagaaaatttgtaagagttagcagagattaagtgccttaaacagtatctggtgcgtagcacccccttgagaaatactagcttttattgttttcattgaattactgtctcatggaattcttacaactacatcatgaggaaaatagtattaatagtattatccccatttcccagatgaaaacactgaggcacagagctgtattctgtctgaggccagagttagaccatgacttacttatttacacaaagcagcagggacctgtctttgatgatgaacaagtccaaattactacaaaactgcttttgttcttcttctaatgaagtgcccaggattcccatccatcagaaattgcctgtgcctattagaaactgtcatttggcaaggggatgagggcggcggcggtggtggggttacaagatgcgcaggtggtatagggaaggagtggcaaatcaaatgacagcaacagagcagccgttactgcattttatttttttggcattttcttccattgttctcctttgtggacacactctggtgtttgcactgggggcatccctgttgtatttgtaaatccctggaggttgcagttgtaaaatgtgcctttatcctctcccattgcattttttttcctctctaatgcaccaaattagaagattgactgattttcgttttccctggaaggtaaaatttcagcttaaatcacaaatgtctgtgatgcacttagcagccaccgcagcttctaaccagtaaccattcctccttattccctctctacccaggagaatattcaggtctattgtgatttcgagatgcattagccgcacttagagttaaggatcaactttggcttctgtggaagctgctgagatttaaagggtaagagctcatcccatttagaacatggtgtattctttccctccttgctcatatcatttatgaaaggataaaagactggagaaagtgtcagagtagattctggaggtacttatattgctaggacaaaaaaaagaaatcacattaccagtagctggcttagttctgcatgttactatgtgatcagtttccaaagttcttcgtcttggaagacaggcagccccaacctatgggaatctgctcaccctacaatggtgagcagacccactccacccatctttgccattcaagtctacagcatttgaacagatcagcccgttctgtgtcaagaaactccttatgcatgttctggacacagccctgtgtctctgcaggttcaaattcccctgaatgagagaaaagttagaatcttcccttcgtatctcagcttctctactcattactcaaacccttgggaaagctgctctattacttattatgtctgcttcctctggaaaatggcagggtaatatgaataccttatttatagggctgctgtgagaatcaatatttgtaaaacacctggaagagagcttgacacatacaaagcactccaaaaatgttctctggcattaaaaacatttgataatatgggctgggagggatcacactgcttctcagatgcaatccttcaatggcaccccatttcttgtaaaaataaatactaatctcctcaacctggcttacaaggccttgttcagtttacccttatgggcttgttctatccatccacttttcctccccagcgacacggtacaggcacacctcagagatattgcaggtttggttctagaccacagcaataaagtgaatattacaataaagagaggcatacaattttttttttgtttcccagtgcatataaataataaactacagttacgctgtagtctattaagtttgaaatagtattatgtctaaaacgtgtgcataccttaatttaaaaatactttattgctacaaaatatgaatgatcatttgagccttcagggagtcataatctttttgctgattgagggtcttgccttgatgtgacattgatggtttctggctgatcagggtgggggttgctgaaggctaaggtgaattggcagtttctaaaaagaagaccacaatgaagttgtctgcatcaactgactgtttcttttacaaaaactttctgtaaaaattttgtatagcatgtgatgctgtttgatagcattttacccacagtagaacttctttcaaaattggagtctaccctctcaagccctgctactgctttgtcaactggtttaggtactgttttaaatcttttgttgtcatttcaacaatgttcacagtatcttcccaaggaatagaatccatctcaagaaaccactttcttggctcatctataagaagcaactcctcatctgttcaagttttatcatgagatttcagcaattcagtcacatcttcaggctctatttctaattatagttgtctttcagtttccaccacatctgccgttacttcctctactgaagtcataaagccctgaaagtcatctatgaaggctagaatcaacttcttccaaactccttttaatgttgacactttgacctccttccatgaatcatgaatatttttaatggcttctagaatggtgaatccttttcagaaggttttcagttcactttgccccgatccatcagaggaattactatctctagcagcaacagccttacaaaatgttatttctttaataataagacttgaaagttgaagtcacttctagatccatgggctgcgcaatagatgttacattaacaggcatgaaaaaactagtctcgtacatctctattagagctcttgggtgaccagctgcattgtcaataggcagtgatattttggaaggaatttttttttttttctgagcagtaggtctcaacaatgggattaaaatattcagtaaagcatgctgtaaacagatgtgctgttagacaggctttttaaaagtagcactgcaagagtaatttaggatgattatttagggccctaggattttcagaatggtcaatgagcattggcttcaactaaaagtcactggctgtttagcccctaacaagagagtcagcctgtcctttgaagctttgaagccaggcagtgacttctctctatctaggcaattcctagatggcatcttcttccagtataaagatgttttatctacacgaaaaatctgtttagtgtagccacctttgtcgatgatcttagctagatcttctggaaaacttgttgcaactctctacatcagctcttgctgcttcatcttacactcttatgttatgaagaaagctttctttaaacctcatgaaccaaactctgctagctttcaacctttcttctgtagttccttacctctctcagccttcagaaaattgaagagtgttagggctgtggattaggtgttggcttaagggaatgctgtggctggattgatcttctattcagaccacttagactttctccccatcagcaataggactgtcttacttttatatcatttgagttttcactggaatggcactttttatttcattcaagagctttcttttgcattcacaacttggttgattggcctaagaggcctagcttttggccggtcttggctttcaacatactttcctcactaagaagcttaatcattctagcttttgatttaaagtgagaggtatgcaactcttccttttccttgagcatttagagaccattgtagggttattcattggccaaatttcattattatgtgtctcaggtaatagaaaggcctgaggaaagggagagagagggagaggaaaggctggttggtggagcagtaaggccatacacatacaacatttacctattacgttagccttcttgtatgggcatggtttgtggcatcccaaaacagttacaatagtaacatcaaagatcactgatcacagatcaccatgacagatatcataataatttgaaagtttgaaatattgcaggaaagaccaaaatgtgacacagacaagaagtgagcacattctgttggaaaaatgacaccaatacacttgctcaatgcagggttgccagaaaccttcaatttgtaaaatatgcagtatctgcaaaatgaaataaagtgaagcacaatcaaacaaggtacacctgatgtctttcagttggcttaaggtaataattgctgcagccagctcagtccagcccagatttgttacattttcatgaatttttcaaatgttttgttaaatacagctatcattaaaaattaaattgcatcaacttataattaagttatattaaaagaagggtaatatgggcacaaaactgaccatttcctgattattttactacattttactattttctatgcttatttagtcctattatttatgtatggtgaaatctatataatggggaacagctgctcatagctgccagcacttcattcagtgaagtcacattggcagcttgaagctggccatgccgggagtatttatatgacaggaactggcaaacacctcagggctagatgtcttgtttttgaactagaatggcagtcagcaaacttttttctgtaaaaagctagaggagtatcctaggctttgtgggcaccgaaccctctgttgcaattactcaaccctgcagctgaagagtggaaaacagtcatagaatatacatatataaataaatgagtatggctgtgtttcaataaaactttatttaccaaaacaacaggctcacagtttgctgaactctagtctagacttacaaaagtgatagagaaaacataaagaatgcaaattaaattttaaaaatgtgttgattctggtagctgttacattgtatattgccccccagaacacaggacatattctttaaacatctgaaaagtattttgggattcagcaaagaagctgctcaagacattgacaaataagtgaaattctgacttaggtcattggtttattttcaatcttgcttgttcatttaaatggaaatggcaatcaacattgatatgggaaccacacttgctcatcagttctaactgtaagttggctacaagtgtaagagtttggaaaaaaatcaacaaaagcattctgtgagaatcaattggctgtgtgtacaatttacaatatagaaaattgtgtgttttattatttgtaaattatgtgttacttatctttgatatcagtgaaatacataatcaacatatatgtgcctggacatgcctatattggtttttgtgtagagccaattattaacattaccagaatatcactgcttgaatggggcatgttctctttagcttccaggcctttgagtggttcctccacctgaaacaatctcttcttccctttgcctacctaactcctccttctttgatctgcagcttaaatgtgacttcttcaaaaaagacttctttgatcccttcagtaccaaatgagttcttccctttatgcacatttttccttgtgacacttgacttaattatagttaaatgatgaattatgtgctggcttattacttcctttttaccaaaagactgcacgcttccccaggtagataggtccatcttctttatcatcgtgtctttggagtcttacgcagtttgttgaaatattatgtttgtagctgaactgaattgtgatttaaaaaaaaataggtctgtatttaaaagttttagtgtcagctccatccagcccaagttaagtactaattcagcaagttagttaagtaataaatggctgtcactcaactacaacatatttgaattcagttttgaggccccagtagttgctaaaaatcaatgcccactttctccaggtatagtaattatttctcatattgttattgactgtctctttaaagaccagccaggacaaatctatttctgaagctgttgtaaatgatttgaaacaggaagatgaatggaatggaatgagggttgtttaaaagagatttatccctcttattcttgctcaagaaatgagtggccagttgctaccagcctatcccaaaagccaagagataaaagccagcagcagttaattttctagtccgtgtgctagtgaccacagatatctaaccactgatttccaaaggcttactattattcatacatatttactatggtaaatagctcatgttttcaggaacactgaggatctgtttagtcactttggatttctggtttcatcaagagtttgtgtccgacatctggggatgagtgagggttccggatacccattacagaggaagagtctgatggggaaactagagggaattcctatctggaatttaaatttaagtttaggatctcagaaagacaaatggagttgaagctgtgtcaggcagaagagatatctccatttgtttttctgctttctcaacataaggcaaatgtcagtagtaaccaggtttattccacaggcatactctgcaatgtgtgggtaattgtgcctatcgattgtgacaaagtcttcaagcatgaggcagagaagtttgctatccaactggatgccctcaacaatgtttgcatctcaacaatgtgtcctcacattggctggctttacatatgcagacaagtgaggacatgcagaaaatcatttcactggtcctccccattgcattgtcgattgtgtggaggctaacatgtaaagttatcagcccagcagcagacacggagtgagttgtccataaatagtcattctaattgttctgtttttcttattataatttatttttgctatgtaaaaaaaaatcaaatgatctattgcgtgtatatgtgagtttttgtttaaaggcatatgacccaatttgtaaacatgatcattatcttctctgggaagaatactaaccaagggaaagagttcatgatttggctgtgtagagctctcattaagtgataggtgactggttctgtgctgagtgtttttcatcatcttgatcctatgagacattcaacattccatcttcatcttacaaatgagaaaactgaggcttagtgaggttctatagatgctcaaggtcacagacccaacaggtgactgagctggggtttaaatctccagggggtcttttagtaaggcttatgcttttaagcaccaaactctaccaggatataaatggcaaaaggaactgcttaagatatgaagagaaaagaaacacactacttaacacaaaacaaaaactggataaaatacccagttgcctgaatatgtatgcacttattcttgcattcagcaaataagtacatagcacctatcatgaaccagtgactttgcttaggaacacaaagcaagcaaaatccctgccttgatggcacttacttcttagggaaaagagaggatgacagaactgtagagaaaacagagtataccagatagcaatgagggctgtggagaaaataaggtgggaagagaactaatattggagctgggatttcagaaggaagaaagtgtttgagttgagacctgaaggaggtgcaggaaccacaggaccatctggggtcatggtcagcaacatggccaatgggccaactttggcccactacttgttttcatgaataaagttccattggatctcagccaggcccattagtttatgcactatctgtgtctgtttttgtgttcaaatggcagagttaagcagttgcaatcctgtggcccagaaaaacttaaatgtttactatttggccttttatagaaaaaaaaaatgtgtccacctacatctagaagaagagttttccagggagaggggacaggcagcacataggagtctcaggatgggaatatgcctagtgtgtttgaggaggcaggtgcgcctgcaacagaatgggcaaaggggtgagtggagggcagggcctgggcacgtgggggccactgtaggggagagagggaggattctgcagagtgttaacaggaggactctcgctctttgtgatacatccactgtcttaggttgaagaagcaactctgagatggagtttagcattcagggccaacacctatggaaagcaggggcaggaagcaggagtgagcagagggagaagtccagctatgatacagaccaatggcaaccttggccactctctaggagcttcagaattgaccctgtttggcccaagacagacaggcctttatactccagtgttgatcggtcattgaatataggtctttcaatggcaacaacagttacaaggaaggagcatcacctgggtgattgttgagaagctgagagccgagggctgcctgctgaccgcactcccagcagctggtgccatgggtcctgcattgaagtaggatcttgggggcacatcacaatgtccagcacatagaggatgtagggagtaacagctaaagcaagactaattaggaggctactccggaaatctaactgagagatgaaggtggcttgaaccaggaggtggccaagagttggcagactctctcttttgaaggtaaagctttcatatattctccatggcctaagatcaccttaaaggagcaaagtaaaaggaaacaagccaaggggaaaggcttcaaagattcagtctatgttattaaatctccccacccattgattatcatccatgacagtctttgcttagcttaggtttacctgtgctcatcattttccagggtgtacagaaggaacactatttaatcacaaacgttccaatcacaaatgcttcagtgacaggaatagaagctgtcacaccagacagggcagataagtccttgtcacatggctgggtctgtccctgcagtgactgtgctattcatagcaagaatgttgtgttgctaaacttggcatgaaacaatacagttatttatgcgacttcatgaactagagtatcgccttggatttgagattctgctaaagctacatgagtgggcaaatcaagaaattgtattccataatttgtttccaatctgacagagtactatgtgtaatagatgaataagcttatagattttagcacatttattgcagtgtgatgtggtttgacacagtgtctatgagctgtgtggggtgaaatggaaggtttaaatggattccagcttcattatcccactgtgatctgaggaaagcgagaccacaatgttgccatccagtaaagcactttatcacattccttcccaagttgaacagcagcgttctgccaaagaaaagctatttgctgggtagactctttagcaagtttcatttttaacttgggtgccaagccagccaatagaatctaatgggctttgcttacaatgtgcatggcttggctatttacatgagattgacagcacgagaaaaaccagacgctatactcactaggctgatttagaggtttctctgctcatttgaattcagccaagctagtcagtctagccctgggaaaacctgcaagagtaaaaagagaaccaataaaagcgattcatgaaaaacctgaagtgcataagaaattaattcccctgagtttccaaactagtcagtaagctgcgctgaggttttgctttctatgtttctcctttgcttagggactggtcaaaatctcgaagccacttgttgatttttctctctttaaactgctttgatggaagaacacccagggtgtaatgggcacctgggtgggtggatgcctaactaaatatatttatataatccttgaaacatgtttaactctggaggttaaggaaggcccaaagacaaagcggagttgttaagggaagaaaaaaacagaacttcttaaaggttgacacggtgccactcattaattctagaaaagtttgcaggggctgttacatgtcagacacaatgctagccttcccagatgcattgatgaacaagttgcaattcttgctgtggtgagctaatggtaaaaataaacagagcactgccacacacagacataagagccatggggcagcatcccattccaatgcctggtacatattaggaacccactaaatacttgttaaggttcattttgtgatggtatttttttcctctctccgctagcttaaatctgttcaagtctcccatggttaatacgataatttttctgatgtttatcaccaataaatttttagaaaaatcaggctacacagtcactctctccaccttcttaggatacactcactctcttaccctttcactccttcgggcaatttgatctgctatcttttcccaccactttaagagaaggactcttgatggggttcccacacctggtcagatggcctctcttggttgtcttcctcaatcctttcattgtgttgtagttgggcagttcctccacctttcacttctcagatgcagcataatcgtgtttcttcctcccctctgaatattccttttctgcctctctgcattccttttcctcttcccaacacctaagtgattcttaaaaatattctctgactttctatgccttctccatcagtgttagtttcaagttatcttgtcatagtttcatttaggagataatgcctgaatctttatcttaagccttgaaccctctagaacaatttcatttgtgtgctgggcacctggatgtcccaaaggcatgtgaactcatcatatcaggagtcaaactcattctgactaattttatttaatgctatttccattcacttggtcatccaggtggagacctgagggtcaagatggagccctctcccatgtctctctctttgctgctctcagatggacccaggggtcatgtgctgtcaactcatccatcactatatttttctcctttgcccttccatgttatttccatttcacccaccgttgtgtgataccacagcgtctgttttacctcccactgaacaaaagaaatataatccttgaaacgtgctccttagtgtggaagagaggggtggtctgatgacttgtttcaaaatgatctcaatatcaaccactgccccaacggtcttgcatttcatacttaagcaacatatttcaatgcagagaaggtttatagtgtggtggggatttgagggtagcttttcaattctgctctgtttgatttttgactgatgaccccagacacagagatttggcctggcagaacctgcccttagttctatagaggacaccttccccatacttttttctccttttcctcttcctctataaactctaggttctttcactgcatttcttttttgtaaacagctttactgaggtataattgacctacaaaaaattgctccggtttaatgtatacagtgtgatgagtttggatatatacaagcactggtgaaaccatcagcttcataatcaaggcttccaatatcattcacctccaaacgtttccttatgcccctccagtgtttgttgatttgtttgtggtaagaacacccaccatgcaatctaccctcttaataaaatgtttaagtgcacaatgcagtactgtcaattacaggcgctgtgttgtacagcagacctctagagcttactgatcttgctaaactagccacttgtcacacattcgttaggtttcatgacagtctgtcctctgagatgggctaagagttagtctgctctcaaagagtttcttgcaagaatatgatgggtgctttgtggtgaaaagtgaaatagcaataaaaaaaatcagtcacttccattgtaaaaataaacgtaactgcatggccaatatgttattctaaaacagaagttggcttcttacctggctttaccgtgcacggaggactttaatttgtgttcctgtcaaactctaggaatgtgaaaatgtggaaagcccatcccaaacaaaaataagcctcttgccggagtcctcacctgaaatctctctcattctcacccattcacctttcaaatctgtgcttttagcacatcacctttctgccctaaaacgtttagtggctcacaagctagtttccaaattccttagcttagtagttagccctccgctaccttttcttaatgcacttttacacttttctccatgctgtaactaaacagcactacctactaaaatagaaagatacctttcaggttcctgacctcatgccagtatctaccatttccttttcctagaattctctctttctccttatttaaatcctgtgcattctctagtgcatttgggggaaaatgtcatctctttctgtaggcattaactctctatgccctaaaatttcatataaccttggtggttccttttatctcacacatttcgcttatttctttgactaatgttattcatgaacatgtcttaccatttattctgctgcacctacaacccctggtggccagtggctgtcttactaacttttgtgttccctgtgcctcacacatcacagactttccagaaccttttagtggataaagttaatgcagaaatgagttaaatattcaaagaagcagtgagcaagatacgttttttattcttcctttcggaaatgaatccttgctcttccccacccctgggaactgtgccctggttatgattgagatctcatagtcactcatcattcattctttagttagaattgcataacattttattctttacaataaagataacttgttaattgcttaaccagatgtgattttactattatattttttagtaattacataaatcagaggaaaaatccttttcagatgatatgcccttatgtgtgatttagacaagctgaccacctacttttagataaagaaatcatcttctgccaagatggggctagatgtgagggaagagaagtttcctaccaagaatttccatttaaattcaaatttagaagctttcttagtccctgagtcttattccacttcagacttgttgaaattttcctcatgaaatatgctttagttgtcttggtaaattttaagagtgagagaagaccaagtaacagtttacaaaggtaagaatcatttaaacctacttactctccctgtttaagcaatgaggaggattctgtttatttatttttaaaaagtgttaagggaagaagtgctatttcaaattaaatgaagacacgggaatttgcctttaattatttaaaatagtttaaatcttgttgttcaaacaacaccttgtctctacaaaagaaaaaggaaaatacgatgacactcagactttgtcaactttttccaaatattagcaagttaaaaaaaactattggttctgaatggtgagataaatatatgccacctgtaatatttacctgaatagtatatattcagaatgcaatattgtgtaatctcttttaacttcaaaataacccttctttgccctgcaaagatacttgaactcttggtgttggctacctatgaaattatgtcaaacacatagattctacatctccagatattcaaaactaattatcccttaatttgcaagtgaaagcaaaataccacctaatagaccatttctctggtaaacctttctttatcttaatgagcagaatgtggacgcctattacaacctgattttaaaacctccgtgccactcaacagcttactcataagactgaccagaaggaggcaacaaagatgtaaatattcttatttacaatatggactgagctcatatctgtctatttagcattttattataatgcatgccatcccaacagaatcaatagttgattgatttcttatgtaagagacttgagtactttaattctggatggaaactcatcagcaacttccagttgatgagatgacgttctccatttggtgaaactgggctacatttaatcatcacaaacttcaaattgtattatcccactttccagataatgtacagcgtattagcccaacccgctttcttcagaagtgtctttaaacagagatgggctgtatctagataggggtggaatatgccagtgtatcggttagccgttcctataataatgctgcataacaagccatgctaaaattccatggcttacacattgctccataggctgaggggttggctgatctaggctgggctcagctgggcttgactccagactgtgggtttcattcaggtctgctccatggacgtctcattcttctgaggacagcgtgctccttcggaaacattcttttcctgatggagactgaaagtttccaggttagcatatagaaacacatgatgcttcttgaagtctaggtaggaactggtgctcagtcacttccacccactgggcaaagcaagtccaatatcaatgggggaacattctgtttggaagaacttcaaagcctcatagcaaaagcctccatatggggagtagtgaaaaattgggaaaaataatacattcgatcacagctgctttgttttagggtttatataaaagaaataactttaaaaggggttacctccttctcatgcctatatttttaaaagtaagtgtattactctacattgaataacccaagctaaaagtattttatagttaaccttgacctagtatacatactctctcactctcactctccccacacccccaaacccaacaatgaccacagatcttcctttccttccactttcacaacccaaaacttgtcctgttcattctctgctcaaaagcccatcagtgaatccctgttgccattgatatagctcaaaccctcggctagctttacaataaccttcacagtgtgtggtttgtctcttccatcattctgtgtgaatttacttgtctgtctttccacatgttatttcctttgctgggacactctcttttctctctcccacctgcctggtgaattgatgtttattcgtcagagcccagctcaaactttacaacgtctgcacatccttcactaatcccctgcaggcttttctgtttccttatctgtggtttacaagcattttatacatatggctataaagcacttataataatagactggaattagtcattcatgcgccttttgctgctagcctgtgaaatccttgaagatgggggtccatgcctcattcattttctatcgttagcattcatctccatgcctgtaacatggtaggcttcaaataaggtggttggattgaaaagaaggagattttaaaaataagcatttaagaaataaaaaggagaaacagccatggcacaaacagttatgttcaacctcgccattaattaaagacactataaacaaataaaaattatagatcaatttttatttttcaaatagggaattatgtttttagaaagacaagacatagtattgaaaaaaacatggatatctggcattgccaactggagtctaactgacaactttcagggatttttatcatttctctttctcaagtacttaaatatattcatatgtgttgacccagaaatttgattttaaataatttatcaagtggaaataaagatgtgaaaaaattacataggattgctgattatagcatcatttatagtaggaaaaaattgaaacactctaaatttcttacaatatcagcccggttatataaaatcatggtgtagatataacattgggccaaaacgtctgccattattagaggcacagttaataaaatgggaaaaggtttaccatgtatgttccaacataagaaattaagagcacaagaaatgagaatcttgtaaaatataagggctattgttagttacatcccatgtacgccaaaaactgaatttgaaagaaatacaggaaaatattaatagtgattacatttggatgtaataatcacaggatgatcttatttttatttttttctttttgcctttctctagtttccaaattttctacaatgaacatacatagcatttatagtaaatgaaaagatctaaaaatattttaaagatataattatgatacagtaacttgtactgttaactgggcttgtgtgagctctaagttattgattatgtatagctctttatgtgagtttctgctacttttgagccttgacttgtttatctttagattgggttccatttctcttttgtaattaactaagaactgaaatgaattttctaaatagaattgttcttaatttaaatatgaaattctgttttctctaatgtaattgtacctgagtgaaagtaactgcaatgaggactataaaggaagataaagtaggaatatgatgtataatttccctttgcataattgtaactctgaagaacgcatgctcccagcagaaaagtaatttaaattatatcacaacaaatgccatattttaaaatagaaactatccatcatgtactgagtaaagctggtggcaacctatacatctcaaaaatatactgaaaatccctccatgagtccattaaaaacaaattgattggtttaattccagcacatgctgaaggaaagtataagtgacattaatgtaattttaagtgcataaaattactaattacatatttagaaaaaaattatgtaagagaataaccatgagaaataatttttattataaaatattgaaatgtgtacaatgtgaacagaatagtataataaatcccatgtatgtagcgcccacaacaccttttatttctcagtacaatttttattttggaaatgatttttaaaaatgtagaacaatacttttgtctttatcttctgggcaaaaccagttttgaacaacagtgaacattttaataattgtagaccagtgctaatatgttttttgtttttgagacagggtctcgctctgctgcccaggctggagcgcggtggcactctctcagctcactgcagcctcagacttcccgggcttaggcgatcctcccacctcagccttttaggtagtggggcctacaggcgcagaccacggcacctggctaatttttgcatttttttgtagtgacagggtctcaccgtattgcccaggatagtctcaaacgatccactcacccacttcagcctcccaaaatggtgagattacaggcattagccactgcacccatctactaatacatattttgaaggcataatttgaaatctgttggaacaaatgctccagcaaagacattaaaatatatttttcacctagacagagaatagacatacctttcatgtacacaatttaaaatacagacccaacactcagcattcttttccttggtcagcataaagcgtgtgaatatggaaaacatgtcaagtgttgcttgtcccccactgttaatgttttctcacattcctgtccagagatagttctctgcatcttttacattaaaaatcttgccataagtgtatttttaatacaaatattttctattttataaatatgacatagaaaaatttcaagctattcaggtgtatgtaattaaatttgattttttacaggaaattttgaaattgttatagtgattaattgatttgttcatctggcatgtattaggcacctactatataccaggtgctcttttagactttggagaaaacagtgaacaagatggataagggatcccatttttaaagcacaaagttttctccagctatttcttaatggagagattaaagaaatcttcgcctccaagaagtctggatctaagtcatctccctttacttgatcaggcccatttccaccccctagttcagttgacagagataggatggcagcctctgccagcatgtttcaggatatacccaggaagcaaatacctggttggaataacaaagtccaaagcgaagcaagagggtgattgttaaatgagtaattagaataaacactgaaaaatggtatctgcctgggcctctatttttctcgcttttgtagtcgtttttcataggttggacttcttgcccttcagagataatgaaccacaatatgcatctatctgtgggtagcagtagcttgagtttgggattgttcctcgggttcctagggatttttttgaaaaccaggagaggattttctgaacccaattggtccagttaatgtatctatacgtcttacttctctcttttccaggcataaatctctgggctggcttctagaataccaggtccctttcccctcagttcctgtgtatcctgtgttatagctccaagaaggagctataacagggttagaacaaagatctcccctccctactactcctggataaaaatcacagctaagctgtgacttttgagtgcttagcacatgctaggcactgcagtgaatacttctatacacatgatcgcatttaagctccaccacctatttcgagggctggatgaatttatgtttcttgtgctacatatgaggaaactgaggcacaaatagcctcggccatttgtacaaggtgcagagcctgtaaaatggcagcttggcagtgatacccagttgtatcactctaatccccagagcctgtggccaccatacagggctgcctctcacaacacacataaatagccatatgtctcataggtagcattgacagagtcaattcttttccagtacggagagcggtgaattttgagaagtgactttttggcagaaatgcaatctagtgacaaatcagcaaaaggttagagttcagattaaaactcagaatctctgacttcagagtctacaagttaatctgtgacactttaaaggctctgggaaacaaaagaatactgttgaatctggttaccccctcagactcaggctgacttggagttgtgtgcgtggggcgatgccattccaatggtagccgctttgctttatggggttttaggaagaaatccaagcttcagtagcctttcccaaccgaatgcattattaaagatacaacgtgtaactcaggactgattttgacattttaaacatgatttttctccattaatagagtaccataaagtcagcagtaacaacattacagaaagctgagaaagaaaatacggtgaaaccccgtctctactaaaaatacaaaaaattagccgggcatggtggcgggcgcctgtaaccccagctactcaggaggctgaggcaggagaatcacttgaacacgggaggtggaggttgcagtgagccaagatcacgccactgaactccagcctgggtgacagagcgagactctgtctcaaaaaaaagtcttactgtaccatatgtatgtggttccatcatacatcatcgtaggtcatcgtcacctttttctcccttaggtataagccttttcttatgttattgtctcttttcataaataggatttttcatagtgacatacacatcattgaattaataaaccacaatttaagtaactatttccacattactgaatatttagcttgttcttttagtcccctccagtttgacactgcaaacaccaaatttggtcctctgttattttacttccagaaaataattttttagaactaagattaccaagtcactaatatttttgtggttcttaatggatatatattgccaactgcttttcaaaactattgttatatttaataccatcaaaatatatccattcacaagtttaattacactgtcttcatcattagtcataacgttttaaaaacataattgccagcataagagggaatctatctatgtctttctatttctctctctctatatatacatacattttatatacatataagcacacatcaaacatactatatactatatacatactatatattatatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatgatagtactttgacatttctttaaaatctaggcaaacctgagatgcttttatcattgaaagtagaaggtgtccccattactggcagggaaatagattccagaatttcatattctctccaggtcagccactacaaatgagaactgaagaattaatctaagacttttttcatttttaaaaatcgggttattactttagcagaaatatgactttatgccttcataactaattgtactaatttatgaataaagtacatttttatttaaaaaaccaagaggcatactagaagaaattaatccacttattttcttctcaagtaagtggtttacttaagcatacatatatatacaatttcattttcctaagacctagaaaaaattcccaaactgatttcttaaaatttttacttgaaaaaaatttcagcttataaagaagttgcaagagtcgtaccatagttggaaatactctgaatcatttgctttgttttggtgtgatagagattttttgtaacgatcacttataatgtaactccctggaatattaaaacaattgttaaggacctgatgttgtgattagagcagccctgtttctttcgtttttatattcctgacagtgaaaattgctgtgcaaatagtagaaactcagaatgtgttgttgaattgaattgttagattgtcttagtcctcttctattcaggcattttctaagacaatgtgattgatacaaacaagtagaaaatatgctttctcaatacaatgagttttatttccagtgggactgtttaatcagaatgaaatgttgttgtaccatgatgactgccctgcccttagaagtcaattattttatgatggagaaaaaactgtggtccgtagatcagtagaatcagcatacctgggacctggttagaaattcataatctgtagccaaaacctatggaattggaatctacaattagaagaccctcaggagtatgcacgttaaagtttgaggtgtttaaagttaaagtatgcactttaaagtttgaggtgtgtttattcaggtagctttcctttcttctcatatagtttttaggtataaatgaaaggtctggattatttcacgtattggcagatgtgtatttattttttagtgcagtgcttctcaaagtatggtccctggaccagcagcatctgcattacctgagaacttatttgaaatgcaaattcttgggtccttcctcaggtccgaatcagaaactttggagaatggcactactgtttaacgagaccttcaagtaattctgatggctagagtttgaggaccactgctttaatgcttacgagagttgaattagttgtttaaacagaaatcttagaggctttgaatccacttacaaattagtcttttcaaaggtgtactttttaagtgtctgcataatgcgaatgttgtgaagtatgtcaactcttgggatttaggaatagcagagtattagtattccagaggcaaaattgtaattggccttttcacttgcattttccccacaagtgacaaaaggctaaaattaacaatagaaaggcatttgtttacatccaggcaaccttcttttttaaaaaccaaggcacaattttagatagttgataatacctggaaaagcttgggctcaacttgaggaagtagattccattttacttttcctttatttcccagatacagagaaatccatgttaaatgccttccgtgggtccagaacttcttgcttgttctctttgcccccagtctcctatttgacagagcagctgcactataataaatgactccctggcatttcagcatcatagctggggactctgccaaagccctggccacgtctctgtagtgggacgtacaacaacgaagaaaagaggctggatccacaaaccccacaggaaattagtctcattattgcaactcaattcatgttcccatccagaagagggcttcattgcacatggcaattaatttactatgcagagtgtgttttgcttggtatcagcttttattctgacttccaggacaaaatggttgcctgagttcttaatcgtgtgtgtgatttgacagtcaagatgggctatgggaatcatctcttggtagtgtcatcagcagaaagaaaattcttttctgaattgagctttggttgtatgggatagatatctgttctgttggtggtggtggttgtggtggttttgtgttttaatttttggattgtgacctcagtttgagtgagcaatgtgatgaagctgctaacaaaaaaatcaaagagaaaactctaaactctgttaataattgtacattgtaaggtagtaaggcatgttagcctcactgtgcttgtcacagatcagaatctacctagagagctggggtacacgtagaagcccaagagtactagatgatctcctataaagagccaggatggtagaagacctgtggattggccttctgctatgtttctgtttcccagcatcttttccctcctgccactgcctattttaagcaattttacttgaactttcaaatatgtgccttggtcatcccaacagatacctgcacctagttggccaatcagatcactaattgtccggtctcagcgattgatctagacacatttatgaccaatatatggcaaatgagagttctttgggggaaattaatttgaatgttgcagagtgttggccttctcactcccctgaaatatgagttccaaagacaaggtgaatctggaattgtggggtccaatttttttttcaaatggacacagtgagttggataaaaagcccgacagagccaagaaatgcagagagaaagagagagagagagacagagagagagaaggaggaaggtgggaagagagtgacagaccttacggtgttattcaaatccctggatccagctgtacctaaagcccataccttgagcttccccattacatgcaccaatatattatctgtttaatgagtttgtttgcattacattcaatgaggcttcacttacatagcccaggagtctcacttacgagtaatagtttgaagagagaggtaaccctgatggagaaaaaatgaagatttatcgtgacaggagtggggcaggaaaacccacttcccttcacatatctccaggttcggaactcatctattcctcctaacagtgctctgaagtattacctagcctgtgctacagatacaaaaactcaatgtaaggctctaacttgtttaaagtcacatacagagtgagagagctgggactggaacccatgttcatgcgattgttttaaataggtgtccctacttctgagtttccattgcattatgtatatattttccttgaacctccttaaacttaacgtattataaatgtttgtagagtctactaggctatgccttgacagtcattttttgcttccctcctttccttccttcctcacttgtttctttgcctccctcattttctcccttcttcctcctttcctttatgttcaccagcacctaacatacatttatgcctattggaggtgtcagtgatgttatttttgccaatgactgaatgaaagaaaaaaatgtataagttgaaggctcctgtctctagaaacatggaactaaaggcaagtcgatttttgtttaggcattatggggagggtattcctgggtggggccaaagatcagattaagaatcccccataaccctttaaagtcaacagtccatggaggagttgcaccaaaaagagactctccttctaaacatctgtgtgtgattcctggaggacataagttgagcggggtgcttttggaggttaactccaaaagcagcgatgcttcagagggcagcggttgtaaacagaaatcaggaagcagatggtgggggtatctgtggccagaaataagaatatctttattgctgagtaaataaacaagccacatcctgactaaatgggtggaaatttcctgaacatccaggaaggatgtctggtctttaatctgtttttggaaagtcaacctcagagcactaagcccaagtgtgtgcctctaccagcctcaatctttatcttgtgatttatcacccactctctccttctttagggagcttgttggttattctgcttatggactcacagaagagaacaattcttcctccctttgcccattcaattccaatctgaatgttagtaccagactaatgatctgacatagactgaagaaggttccaaggacttttctgaaagctgagcccatttttgttcaccattctcttaaagtctcaggtggagaaggaagaccttaaataatagcttttcttttataatgaaaggggaaaaatatctgaaagaatgcttccagctgatagaggttggacagaacagtaaggagaaattctctaagtccacctggagcttattaagattgaaaattgcaagagattggcttaagctgattttttttttcccaacagcctaggcaaagactctgatttccaattttctgttatggttgagtgcattcttccggcaaatatttagtaggcactcttaatgctaggactggtcacttaaaacaagtgtctttaaatattcttaatttagacacataatcttcaaaccacaacagtgatggaatgaaagctagtcatcagcagtttgcaaaaattatggcgctggtcctctccccagccaacttaactgggcttctaccatcctcctccttcctgatctttcttttctcttcctgagcatctatccagttccctatttaatcatatgtaatcttcagtatgtgcttttatgtggaaagccagatgtgtaccagttgatgtcaccatgatggacaagaaaaagggaagcttacagagaagggcagattcatgggcttgcaacatgtacaattgcatagggccctgtgcttaacaggagggcccatgcgtgcgagttaatgctctgtcatcactaccctgaaattcttaatagatttttttttgtgttttgtaaatgaagcccaaaggaacaatggagcatgagctggggcttggagcctcacttcacagacagccccacctcctcctgcctcctcacttccctgggagaggtctttagccacctgatccctgaccttgccctacacaaggcacacactgacctcctactacagcacctcattgcaactagcatggaccagagctctggggcagggaggtttttgtcaggtgcatgtaacccacatgcagaattataggacagagccccaggttcctggaaaggtcagacttatccttcatatattccatgcctgagagagcacaatattaaatagcaaataaaaaacaccatgacagattgagagaaagaccatggaaaacaggtaaaaaaaaaaaaaaaaagttttgtctgctttttagacaagagatcgcacgttttcgttttgtacctagctctgcaaattatgttgcaggctctggttacatacagcctttagtttatcagcacacagtgttggtgagcggatgagaaatgtggatcctcccgcaggtgagtataaggatgtctgaatgtacagaaagcagcctgatgtaggccagccccatacttaactgacgaatttatcggttgtatctgtcttccagaaacatacaggctaaacgccaacaaacaatgaccatgtctaagcatctgaatattcctctaagaaatcaactgacaaatttgggggaaacaagatgatagctgaaattaacagaatatcccccaaagcagcagcatgggaaacaagtgttatttataccataagctaacaaggcaggcctgggacaatcaatacatgagcctcctttccaccaaattctcttctcattatgtaaataggatggcctgaggtgcaagaacaatgaatagaataataatcggaaatgtaatggaactaatagtggatttctccggactgttaacttctgttcaaagagcccgccaatgatggatagagagcggcgtgcagaaaggaatctttccctggttcagcttgggtgcactgccttgtgctgactctgtcccctcccctacccaccacaccccatgtgtctagaacaatctcctctgcagtacttcatttcctaaatgaattagtccagagccctgttttgaacagatgcctgtacagttcttgattggttgaggcaagtctaaactgacataagccctaactctgaaacatgtgactttttactttgaaaatgtccaattctcagttgtgagctattcatgtgcaagtaacaaacacctactcaaacaagcttaagaaaagcagggaattcctgggaggatgcaggagcaggaaattgagccagtcgttccaaagggccagaaccagaaggcagaccactgggtcccagacagatgggtcatctctttccactgtgattcaagccctgatttgtggcctttgcctattttcatgatatcaatacctccaccgtggctgattgcaagctaccaatgacgtatcatagaatgtggcactggggagggatgtgcagccgcaccccattattgtaccccattatgtagtacttctgccatgcagatataatagataaataatcttaaaagcatagataacagtcaaatacatttgtaaaagagttaagaagtgatgcattttgagtattcattgcctttgcttttaagattattgaatcatgagtgcatgtaatgtctaataacatcaatgtttaactggcttagaaaaatcctgaaatttcaaaagtgacctcttacaaacagtacgtgtcagctcctacttattattcctcctcatgagtccatggaaacagcctctctgggaagaaggcagagagcaggagacaggtcgtggtacagaaggaagtgactggcagaagtacatggatggcatctcagttcaatctctctttattattttggcataattcaaagttcatatctcacttcatctcaaaaacaatatgcatatctgtccttggcttcattttcctcctacctcttcagacatctcttctctggctcttccccttaacccctaactgggggctttctaccctgtctttgcacaccatttatcctctctataatgacaactcctaaatctaagaaatgggcacatttcccctgctaagctacagacctgtgtatttacgtacttcctagatattgccccatgcatggcccaccatcaccttaaattcaagatatccaaaacaattctccatcaaaaaaaaattctttatagccaaatggaagtgtgctgtaatgagaggcatggactttgattctagtgccaaattgtaggtcttaatgagcttgctgactgtgagcacgtcactgattctccctcatctcagagttttgccatctcataaacaggcttgacctcgattaatgggttttactccacaatccatggggccctttattctgtgggtccacctcagaagctgtccaaacatcaagagagaagtggccttggtccagtcctgggcaccccatctcccatcaccaagggccatctgtctttcatcttttcatatgttaaagttccatgaactatttcttctctgaagtagtcatccactaattcattgattcactgtgaatcatgaataagatcatgatcactcaggaaccctctaggtctagcattccgtgattcttcggttagtgctcacgcttctggaatgaaaagtacaaaggtacaggggcagcagctggagatgacagcacagtctgttgccatgtgtagttcatggcgcagggtcagggcagaaactccttaatattaaacttagtgtacagtaactctaatgcctgatatttgatttgcattaagcactgacaagaacctttcatgtctatttctgccctggggtcctaaaacataaattttaacattccttgcttctccttgatgatcattcccacatagaaatggaactgcattaataatgattgttgaaaaaatgaataaatgattgttgaatgaataaccgaatgaatgccaccagggaaaattattgtctccatttcattttagggcctgaactttaggagaataaagttatcctaaagagagctgttggaacctgcctttctaaccagcttcctattttctagaaaaggggtcactgtttgtaggaattgtctaggattcctgagaactgccatcaaacattcattttgcttttcctattgctaagcattatcagacagagacacagcttctacacaaaggaagatggtagggcattgtctgttcagggctgctagatcaatattatagttttatttatctattaatttatttggatttctaagcagctctaccttttgttacgatgattatatggcaaaatgcaaaacaacttgacaggactttgctatctagacttttgataatgatctctaaaagccaactcatttcatttgcgtccttttatgaataatacaaaaaaatccaaaccttaactagtgtttgtcacagtcagtgggtacttcatgagccaagagtgcatagaaaggtatttttggttcattactaggtttctataattgacctgacattttgtgagagcaatcatgtttgttaaggagaaactcaagccaatgctgtagttgcaaagttctccttactattaccctgggaaacaaattcatcagaagtgtgcagatgtgttttatgtgtgcgtacacacatacatccctatgcatacacaagcatgtacacacattggcatgggtcgacctgataaaatatatgcagtgttctctttgtccaaatccagctggtcatctagggactgtatagaaaatttgccagtgcctgcagccctactccatgtttccctttttctctgcagcttgagcctcaccttaaggcctaagtgagatatgcattctgtcccaaatgatggctcatggggacagaacatttctgagtcttcctttctgaccctctagttatatggcagtgattgcactgagggaaaaccaggaaataacaaaggaaactgcttaagcaagttgtgtttgggaagattagaaaagggagtgcacaggaggatgaagctgaagtctctgaggaggtaatcttgttcaaataatagcttttcttgtaaccatattttgtcaaattggttatttctgatgatgtatccccaattttctgaaatgttttaaaacttacattgtagctttctctcatttccttattcctatgttctcattctggtccatcatctgttcatttattcagtccattctttgtgtattcattcaattattctttcaagtgacatttactgataattaaaactgttaaaatcactgacgtcaaggtctatgagcaaaactgaaccaaaccaaaacaagaactaaactagaatccgttgtggcgggattgaccactaggtggtatgtccattctttggccttactggggatttaggcatttgttttggttatgtgccttgttaaatattcatcatgtcaaaatggtggtagtaacatgaacacaatcaagaaaatatgaagagagtgatataaattatatttggagctcagagaggggccaggaagactttacatgttggattgcttctgccttaggcagaaaagaagttgcagagcgttctaggaggagtgaaatacttgagtaggggctgggaagcaataaagcaagtggtattttcaagtttatgcatccacaagatcagtgttcaatatttaaaatgttcaatgtgtaaactctatcatggaaagatttttgaggaagtagcttgtaaaaagttgcatatttctatttgttgctagggttacctaaccaacaggttcttggctaagcaaaaaactacagtctgtaaattagatattctggaataaaaaatttggggaaagaggaaaaggactcatgctcccaagaaggccaagtgaaaagtgatatccttctgatagggaaagaagtcatgagtcattagtctggactgctatagtaatgataataatagtaagaataataatagccaccatttgtggatcacttactgcaaaccaggaactgtgttaaatccttctcatgtgcaagctgctcctttaacctgcgtggcaacccggggtgactagctgttagtatagcagttccttgcccaagtttctcagtatctttcagcctcagtttcctgttgggcaaaatagagattacgggacagtgggaacattaaatgaggctatgcttgttatgtggttagcatggtgtcaagcagggagtaacaggtcagtgagaattatagtattagctactattagcatttctccttcctcgttagtatttttccttccctgaggaggaaacagagaattaggaggaccaagctgaatataagcagtacctgagagcattcttggaagattatgctttcgtgagctcctcttagaactgaaaattgatgatgagagagacagactgtcaccaatgcatgactatcaccttgtcattattaaagcactttccactagtttatattattttattctcataagctctgtgagggccaggatttgggtcttctcttgtcccttgctacatcctcatctatatcagtggctggcacattatctttgttgacgactgacctttccttttcctctttctttgcctggcaaactgttacttgcccatcaggatccatggggacattgacgctcctccatcactctcacctccagtcctctcttcccacacaactcttagttcatacagtggtcacagtacctccatgctgtattgtatcctatctactctcctgtttgtctcttgctgcagactcctctaaggcagggaccacttttcaccacctttccatgcccctggatccttgttcagatttggcttgatgtacgcactttgaagatacttgaatgagtgaccacaaatatcttcatttgcatctgaacaattttcttgatatttgaacttcttacccaaacccccaagtccaaaggcccttgtcttgagcttacaggttttcaaagaatgctttacctgggtatagggcagctctcacatgcctgggaggaagccttggagcaaaaacaaatcgatggctctgaaagaattatgtcaacatttaattgcaagagatagctgctctgcccagagggcttccggaacaccttagcttttggtttaaagctcaattttaggtaactgatcaggtagaagctagtttgactaccgcagcttgcaaatgcaagctttggtaataacgccatagctttttttttgttttttttttttttggggacagagtctctctctgtctccaggctggagcgcagtggtgcgatcttggttcactgcaacctctgcagcggattcaagcgattatcctggctcagctttcggagtagctgggactataggcgtgtgccaccacgcccagctaggccagctaatttttgtatttttagtagagacagagtttcaccacgttacacaagatggtctcgatttcttgacctcgtgatccgcccgcctcggcctcccaaagtgctgagattacaggcgtgagtcaccgcacctggccgccacagcttcttaaaatgtcactatcaatccattctgaggctagaaatctctctggcaagtgtgtgaatgcaaaggtaatggctttacctttcaggttagttgtagataatctcatctttgttcatgaccggtgagtgccaagcccccagcattgagtatgtagtctccaagggacattttccttggaccaattgggaaaagacctggtcaaaattgaggaatgggcaatactcacctggtattttgagctataatttggttctttgagctatgagaaaaaaaagggacacgggctatgttgaagtaacaggaatttgagaagtaagggtgatgagaatctcagaaaacttgcaacagctggacatccaggtctcctggaaatgggaagttgattgaggaactggagggaaagttaaggtcctaactttagtgattgggtttctgtgtcaccaccttggcccaggagactgttgatacccccccccctttgctttgtctccccatttcttttagtgtctctttccagctgagcagtcttctgactcccactagttcaagtttctgagggagaagctgattgagcggagctgtgcattagacagcttatagatgggtgctcttaggtcacatgttcccagtgagccaatcagcagcctctagaggagaggtcacgcggcacagaatatggccgcctatgcttaaggcattacagagggcatcttcctctggaggggtagtaaatgtaggcactttcttctaaatgggctatgggtgtaacaggcattaggctgcttctattttatcagaggatggggccatgattagcccaatgaacatttactaatcattgaaatttaagcatggcagcctggtgtgtaaccattgtttgagttagcatacttcagttttcccctgttgatttagtctcatgtaaatctctgaagcctcggccagtcttttcttaaatacacgtaacagctaccataattctctttctgctagtcctttggtccacctaagttcacctagtcaaggtagacagtctgcagccactatccttcttcactttctaagggctttctcagcattgggggcttattaagcagcaagcaagtcagtcctgtaaatgtggggaagctggctccctggggtctctcttaactgttgagagtcagtggataaatggcccggcttcctgtgagacaattgtgagtcaggttccacacagctccttagagtgtccccactgggagtgagcagaaacctgatttttaatataaactttatttgtgtatctcccttctctgcctcatttttcacacctcctcacttgtacttcccaaatatattctctgctccaaaatccttgcctcaggctttgcttttgggattattcaaactgagacaataaaatactacacccattttagggaagatcaggagctaacagtgtagggaccaatgcattatggtcttcatctaaatgaagtctgtttctaatatactgaatgtttctgtaaggcaaaaactcataggtaattggttaaataggggattgtatattaatatgtagtaatatatacatatatgtatatgtataatataacatgaatataatatacatatgtatacacatatataatatatatgtataatataacataaaaatgactttggtccatatgcagtattccatagaaaattgatattttgccttaacaagaagcggcaattaaaggaatgtatactaatatagctgaatgcagcacacctcaaaagaatagagaatggtctatagaattcaaataggttctgcctcttgactcacttgccaaatcctctgtcttagaagtgcttattgagtaattctcccctatcctgacgcactgcgcctctgttgccataattcagcagattcaccctttccttataacccgtctaccaagccccaatccacattttttaaagggaaagccttatatttactgtaagttttcatttatcaacaatttatgtcttctcaaacacaccaggtttaaaaattatgattataattattatttgcaataattatgtgattacaaagttgcaaagatctggagcattctactctaatcttgtcttttccaaaatccttatgattttattgcacaattttcctaagcatagagtttttctggaacacaaatattttccagaacacctatttcagggctgctccacacataggcatatctgtgccagttagacataagcacccggctcattgcgggtacttactgagggggtagaaggaacatagtaccgcccccgcaaaaatgcaattagcctgttatcaaaataacagggagagatgaattcttatctttttgctggaaggtcggaagaggcattgggcttaggaagtggccacatcatagtcatttgatacactgtcatttgcatctagtgtaaaattcaccattgtttatcttatgattttatgagtagagaccaactgaaaaattttgtacttttattaatattatggcattacaacaccttactttaggagattcatagtttggaccctgtttacaaaaatgtaccagttatatggtatttattgagtgtctttactgcatactaggaatcatacaagagggaaacagaagttatttctatatgactctgatagcacctgtatttgtcccttttgtgttgctataaaggaatacctgaggccgcgtaatatttacagaaacgaggtttatttggcttacggttctgcaggctgtacaagaagcatggtgccagcatctgtttctggtgagggcctcaggcagtttacaatcatggtgtaaggtgaagggggagcaggcatgtcacatggtgagagagagagcaagagagaggaggaagtgccaggcccttttcaacaatcagatcttgcagtaactaatagagggagaactcactcatgatcgcagggttggcaggaagccattcaggagggatctacccccataagccaaatatctcccaccagcctccacctccaactctggggttcacatttctttctttctttttttttttttttttttttttttttttggagtctcactctgtcacccagactggagtgcagtggcatgatcttagctcactgcaacctctgccttccaggttcaagtgaatctcctgcctcatcctcccaagtaactgggagtacaggcatgtgctaccacacctggccaatttttgtatttttgacggggtttcaccatattggccaggctggtcttgaactcctgacctcaggtgatctgccctcctcggcctcccaaagtgctgggattacagacgtgagccgccatgcccggcacatttcaacacatgagatttggaggtgacaaatatccaaatcatgtcacaaccagtaggataaatactacttatttttcattcctcagatgagaacatttagtcacagagtgtggggcagccagccaacttctgatgttcagagtcagtgctgtctaaacttagctttcatgttctttctacctcagaaggctacttctcaatcaattatttgggatcagttggtttcatcacatggcattgcatcatgaatatgctgaacaaggccaagggaaggcaacaattaactggcagtttgtaggcttgtgattagatataattaaaagtcacataaagttccaaaaaatatttttcacttgtttcatatctcaacaacttccacttgtttaagttagtgtttttccaagttgcattgtgatgaggagaatttgacatatttttgagggctaagagtgagaatgattcaaagctgtgagatttgaagtgatgtctaaaagatttttttatcatgacttatgattttttatacacacacacagacacatacacacacatcctagtaggaaaaatatcaaaatataataactttagataataagaaaaatggtttctgtttacactgagttttcacaggtgagatatgcattaaaggcacaaaagctaaaagacaaagagaaatggcaatttaagcacttgaaagccttgctgaattttttacagactgtgtcaagtggagctggaaagtgaaaccacaaatcggaagctagaaaggaagcagctaggcaagagagagtaccttggactgctggctgcagtccccttcttttcccccaagtgacctgcacatcggacttcaccctgctactctctcttcccaaagatgaaatgaagaggttgaatgtaatgattactaagattctctttctgctcccacgatgatctgatgctgaggatttttaagacttctgtgccgttagaattgattacttctaaattgttatctactattcataaaaagaaaattattcaagcttgtacttcttggcacaaaatatacctgtgattttctaaaatattatctcttaatgcacaaagttctcaagtgctgtagctaaagggagctaccacagagtattaatagaaaatgtatgtgagaggatgttatttaataaacccctaagtcagtaattctaatgattcaaaatgactttaactttctactaattagaagccagactctcagctttgcttcttgatctgcacttctccccatcttggtgttcttggtgatggtcatgttcctggctgggtcactgcttccatgactgtttattaaaatcccctggccaaacagtgggcgtactggacttcctggaggggttccctggaatgccttgagcaaaacttgggtgccaaaagcaaagacctgctgtgttggagaaagaggaagagaagagttctgctgtctttgcatgtgtttggaaatgtctttctcatcaacagattctcatgcttggggatgccaggggtggtttgggtgggcactctcttcattaatagccattattgtggagtccttaaagtggattaatgatgttttttaggaaagataattatctcctatgctttccgggaggtacatgaactgctctaagattgcaagtacaaaacaggacattcgtggtgctactgtgtgaaaaaataaccagcagtaccttgacatttatagattttatataagcatgtgagtatggaccttgggcctcaccagccccagaacaccccaggcgtccttgtaccgcagggcctttgtatgtgctgctcttgctgcttgacctgccccacccagtatctgtaagccttgctctttctttcaattagaatctttacttaaacatcctctttttgcacaggttaccctacataaatcaacgtgcctcctgtctcctatcactctctgtccctttatcctgctttgctttttcttcacagcacttatttcctgacacagtaaatcatttataagttgcttattttccacctcctcctctggaatacatgctctgtgaatacaggctctctgcttgtcttggtctctgtttaattcctaatcctggcagagcacctgtgacatagtgaacactcaacaactgtttgctgaatgaaagaaaaaatgaaaaggttcacatggagatgagagccactggccaacaatttcagtcaaaacatattatttacttaaaaatgcaatgtctgcatatatttgacaatgataatttattgaaaacaacaacagtgaatacatgagttgatatctgtcttttcaatagatatataatgagcctctggattttatttttatttttattactcacgtattttttgaaacagagtctcactattatcacccaggctggagcacagtgtgcgatcacagctcactgcagcctcctctgcccaggctcaggtgatcctcccacctcagcctccccagtagctgggactataggtgcacaccaccacgcccaggtaattttttgtagatagggttttgccatgttgtccaagctggtcttgaactcctgggctcaagcaatccatcttccttggcctccaaaagtgctgggattacgggtgtgagccactgtgcctggccatccctggatttgaaaaggaaaggggtagagtgacaaggactggttgcatctcacattccaaactgcttgttttagtatgcgctaatgcatcaaccttttattactgcccagaccgtagacctggcttgttccttttcacatgttattctcaccagaagctacaaagtaggtgttatttgtattattattgctgttgttgttgttagaatacatattcctcatttacagacaagtacacaggctaagcatgactgcaacttttgaattgtcatgcagctcagaactgggggatctagaaactgaattcagcagctgattatttggttcccaataccatggtcttgctacttacctactagaaaggattctcatttgtctatttaagttcttctcctctactctctgaggaggattctttcagctcttagtgaaataaaactagaaatggaaagggaagtctcaaatctatgttcagaagagggaagaggtttaacctgggggtgggagggaagcagatagatgtgctagcagagcaagcagtttgagatctaatatacagccttagtgggattaaaaatatgaggtataatttgtgttcatttattctacagatgtattttgagaacatagtgaaggcatgatgcctggcccacagtaggtgctcaataaacgtgtgttgaataatacatgaaggacacgaataaatgtgtgttgaataatgaatgaaagacacaaattcaggaggtaattttgtttgctggtttgtgtccctttatctctttatcttgtgatgtggaaccacactcacagagtcccttcatcttcattcatttcattcattcttttttttttttttttgagatggagtttcactcttgtcatccagtctggagtgcaatgttgtaatcttggctcactgaaacctctgcctcccaggttcaagcgattctcctgcctcagcctcccgagtagctgaaactacagacgtgtgccactatgcctggctaatttcttgtatttttagtagaaacagggtttcaccatgttggccaggcaggtctcaaactcctgacctcagatgatctgcctaccttggcctcccaaagtgcactgccttcattcattcttaaatcattcatttctttgtggaagccccttagctccatgtagtttatggatgtgtcagaacaaactgaatattgtttattcttttactttttaaagagatgagtatttgagtcctctgattcacagtgaatttcagaattctatcagctaaatacctcttgaagctccgattaccaagactataagcccttctacagcattaagggattgctcgtaaagatactgctattatgcatctggtgtaaagcctcctcatctttagctcaattcaacaagtttccattcagtgcccagctctaaaagtcttaaatggaaattgattccctactccttctattttaactgtcaaaatcatagactgcattgtttccaactgaaaatccgctgacagctccccaccaaccaccccgtgagccttcctagggctggcgttgatgatgctgctatcaatggggaatctacattgtgcacgggtatttatgatgagaaaatcatgtggcataaaagagaataattgccttcataagtgtataattttttatactataagcttctcaatgaaaaagcattctaagggaggcataattgctaattttcggtgttaaacatacctctgaagagtatttcacagtctaactctctgagtgtcatgtcttcctgtggcccggggaagagagtgggaaggaaataaaatttcattgagcatctacataggaccaggccctgtaagttcttggatattggtttcttcttataatgacttgagaattacatggaattatccccattatatgagaagacagagtctcacaggagttaaatcacttctcataaaatcatctctcatagttatgtgagttcagaatgcacgtctatgctaccccaaagtccaagcttaatagagaaatctacagcaactctttatattctggagaggttttattactaagcttaagaattgaggtgccctaagaacgggctgcccccaaaatattttcctcaccacctcacttctgtttccagaagcccaacatgaaaatcactcttctgaaataagtcctggagtcttctttaggcttctgctaaaaagtcttattcgtgagatgtctagcgtaacttctttttttaagtcaaggaaaatgtgtagaatttaggtcaagatgcactgagaataatttgcaaaacccgtaaatccgtagctgatatatttaacaccaggtccaaactgtttctgaaggattgaatctcttgcctgaatactgaagaaaatggaggcatgatctgaggttggggaatattctaccttgccaaggataactgtagagtattgtgacaaagtgcaaagatgccacatggattctggatcagtcagacctgggttggaatcctgattctgccagtacacctttctgcctggttagcttggaacaaagcagttaatctattgagcttcattatctctctcctgaggctcttgtgaggactaaatgagacaatacctaatgcttcatacagagacagtggtcactctatcataataataggagccctcattgtttatgtctttaccatatatcattatccaatatattcctttatatcattatccaaataaatacatctgatcaaatcccccaaattgctttcttctcagcattcctcggtgcaaaatatgagatgtcctttgactatataatataaaatatactataacatataatattgaccttatattgaagatgtatttgtacccgacatacaatatttttagaaataatgtttcattataaaattttttacacgtacagaaaagtttaattttgcagtgagcactcatgtacccaccacctagattctaccgttaccatttaatccacgcattttaccacctatctttccttctgtgtgtctcccgtccatccactaatctacctcatgttttcgattggacacatttcaaaataaattgtagatatgctctccctctaaatacttcagcatgcatatttttcagtagagttcaatatttgcttacatattgtttctcttttgatgtaaaatttacacacagtgaaatgcataaatcttaagtgtgtattctgagttctaacaaatacacacatctgtgtaacccaaagcattgccaaaatgcagaattactgcagaaagttccctcaagcctcttccgagtcaattctgactcctaccacagcaaaagtaaccattgctctgattgttttctatcttggattagttttatctgttctagaacttgatataaatagaatcatgcagcacatactcttttatgtaaggcttccttgactcaacatgttgtttttaggatccttgcatgttgttgcaccgatgtgctttctgaatcgggaaaaacaaatatttttgtgtttgtagaagtctagcttaccctgatgccagatttaaattccctgtgccaaacacattgtgtgctcctggtccctgccccctttaacttccccagcatagtgcctttgttcatgttctttctttccatcactccctggactctggctgttcatattctgcccttcctctggagatcagctccaatcccaaacttttccaaagtctgcattgactcccttgggtttctgcctgagctctctctcctttggacactggactgccatcccattaactgttgatgttgtcatcagtgatcagctcctggtcataaactaaggaagagttaggtgggagcactggcactgagggtccatgtgctcacttagctttccagggaggggctagaccacaggtactcttcaccccacgagccaaaaggagtggatctagagtgaccattgcaaggcctcaaagagaaacgaagagtgaggagtgatggggaaagagccaaggggaccatccctgagtcatgggcgtgccttgggttgaggctaaaggttcaagagggaggagtaaagaagggaaggaaactgtcaggagtgattgctgtcatgtggaagaagcctaaacatgaagtcatgagagacgcaccttgtggctggtgggaatgctacacaatcatgcaacatgtgcctaattttctcaactaaattgcaagctgatgtcttactattgacaggaataaagtttcataaggtgttccctgcagtggcctgactgtgcaaggtgctgatagatacctgctagttgataatgatgcctctcacatggccagtcattttagcaattagtttcattgatattgtgggactgggcttattggagatttgactgaattgaccatttcagccactacagcctttgcagaatttgtgtctgtcaacctggccttcccaaggaaatggaggttaggcaataaggaatgtgttcattttattgccattttactaccacagcatggtagattccagctattaatcctcatggtataaggtgctttttatatcttcaaaaatagggtatagccttgatctctcttcttgctgctctggaattaaaatagaaatctttatccctatctcaaaatctttggggcaggttaggagagctgggcttcaggatcatccagcctagtgcttaggtctgtttacagctcagcaacatttccattggttgagggatattgttcagcagccactgaacatcaggctctgacctcttgtttctttgctgtctaacccagcagaccatcctcggttaatacttactctgattcagcctagcaaagaagatcagaagcaattctgtgtccgcaggctccctttcacacctttaatattttgtattttgcaaacattttgagttagttagcaggtctcttgctttctcttgagggctgggcacaaatgttcaagaataatcattgtaatggcatctctctgattaaaaagacagctggcaagattgagatagaacatcaaattctgaaacatcattagcaggattctattttggttaggtataatcttctgtgaggtcatcatgttgtcttcgatgagtctaaccattttatatcatttagatctaaacagacccatcatgtcacaggcaaatggctttatcatatttaattaacccaacaccatgtaataatctccctggtaattatccctcactagtgcttgaaagcgtgctgcaacaaataaatcatcaaagttgcaggtatacttaaactgttatttggtgccgtggcagaagaatattgacaagtcacagtgcaatcctaattatactaagaaaatgtaaatggcttcatcaaaaaaagaaagagccagatggcaggttttatatactgtatcctcctgtgttagaaaatggggtattaaaaaggcttcatgccctcagcatcagggaagaagaagaaataaaggctgatacctctgtctttatggaggccacgttgaacctctaattctggagaatggtaacattgaagaggacattagtggccattgacgtttatgtctcctgatgccaccctacatataagtgaatgaatattaccaggatgaatgctacttttcttatgataggaattgattgaggaggataggagcaattccatgatgccctagattttactttatgtttgcaaatgacaaattattcacagaaagacatgtgcccaccaggtggtgaatcaatgtgtttccattgacctggcttttctaatgcatcagcaagaacacatttaccggaatgcattgcaattaaaaagcaaaattcagttggaaacaatggacttaaacctacgaaatgtgacaggataagtcagagaggaaatttgatttcaatggtgagattaacgagcccatgaatgcatggtgcatacggcacagacaaagataactgaattggattttcaataagcatagagttctagatttccctgttcttgaattgtgtaccgtaccacccagctgctgtccccagctaattttgccagagctggatgtcagccaaagcacaactgtctatggcttgggaagttctcctttgagtcagattatttagttagctcaggctggtaactgccacagaacctggctgtgatttggtcttattagaaaacaaatttggaaagtattagagaatagtgttcgaatagtaatgttttcccttgctttccttaatatttcctttgtgtgagtgtgtgtttttgtgcacattgcactgttgttacccaaccaatcagaaattctgtttattataaaagtaattctccttaattagagaaaatttggaacgtaaaaaaggaaaaggaagaaaattgctcaaagtttgcagtccaattataatggttcttgaccgtttagttatttagtctttttcctttatgcatacattttgaaattgttggtttagtttttttatagtttgactcatcaaaaatcatatattcactatcctgcttaaaaaatcatcataagtttaatctatatagttacatattcaatcattatgctttgagttatattgacattccatagacagatgtcatttcatgatttttaagcagtcaattttcaattactgcataatattcttccatttggagatacatattttagttcagtattattgtggcacacttattttctatatttcctttttttctggagacagagtctcagtctgttgcccaagctggagtgcagtggcgtgatctcggctcactgcaacctccgcctcccaagttcaagcaattcgcctgcctcagcctcccgagtagctgggactaaaagcgcacactgccatgcccggctaatgttttgtattttagtagagatggggtttcaccacattgcccaggctggtcttgaactactaagctctgagctcaggcaatccccccgcttcggcctcccaaagtgctaggattacagccgtgagccaacacacctggcccaatagttccaattttttatgtgtatatttttaaaaaattaagttgtgactttagcgtgaattgaaatttgtttgactatacttcataaacccttttatattgttttataattttttgcaaacataatttttaacaatgcataacttgtttatcacaagtcagacccagaatatttagctcttcctttgtgttcattcactgaaatcaaggtgctttccagttttttacaatgataaataatactttgacttatcaattaattaaaatgtgttatatgtcaattatatacagagcactgggctaaactggttatctgtgtacataaactttccaagtttgggattgtctgcttagaaaggatatattaaattggtaccattggacccaatatgactggtgtttgtaagggtctaggtagaggctgcttgatagcatttgtaaagggcaattaatctattctgccgtcagcattacagctcgcttcaccacacctgtgcactcaacgactcttcctccccgaaagtggagacagtgaggcaaaggacatggagaaacggaggctcggagagtttcagtaactttccccagtccaccagcttgtatcggaattgggatttgagctcaggtctgtccagctttagaatgcaaactcttaagtgctgccttaagtttgcttccccagaagaaggtcctgggatgagaatttgtgttaaagtgatgtatcggaaaggttgctaggaaaaacgtatagggaagtgggaactgagtttggcaagagggagactgagcaagggtgtcatctcaagcgaagttccattgagataactttggcctcatcttccagggagactgggaatgatgtgatttgcacttcagtgctggcccctttggggcaaggcaacttgagtatttataactcttgacccacaagtccttggttaaaggctgctgggatagtgggcaggcaggggcacaagttgtcagatgcttctgtacttcatgtgttacagacaaagcagatccactagatgcagccttttggaaaaagacacagatgcccttgatgtgctggtgtcggttagcaatggcttggaagagctggatgttaaattgttaggaattttgcaatctggttgaccccactgacagcttgaaatcagccatggtgagagtatctacaccatggaaattggccaacattacaaattagggctcccttccctccacccagaagtgttcagtaaatatttactggcatactaccggagctgctggcctttgggaatggaagcatactgggggtccgtgtgcactaaaatggcaaagaaaatctaggggatgtggatggtgcagggacagcatctactgcagcactcatgtataccagctgcaatatggtaggaaacctgcccctgcccacacaggctaggcagaggtgtgtgagaaaaagggaactggtgagagggaggggaacatgctggatttcagagcaaggtctctcaacctgaggtggcctgggtatgagacatgctacgcagaaaaaaacctagaaataactgagattaaaatagctaactaagctactgaatacttgcactgccaggcactgagctagatgctttactttggctaatcttcataggagccctaggaggtagatttcatcatcatcatcctcactctaactattattatcatctttgtcatccttcttctacagatgataaaattgagatttagagaagtaaagtaatatgtctaacatcatagtgggatggctgagctctgaacccattcaatctgactccaaatgcaaagattgaataactttgacagaataggtcccacttcctatggactgagtacacatggttgtgggggcataggttgcttcagtggccatcaggatgacctgggagtaacctaattttacgtgattataggcttaaccatctggttatcaggaaaaaaaaccatgtagagagcgcacgagagcccagaatcagtagctgggcctcctggtgtggaaaggatagaactcaaatctcatcgagggatggaagtctggatacactcctttcatctctcagaatcagctccaggctggcccaaaacaaatgatacagaggctgagaaaggcagagcaaacctgggacatggggctgagccagcagaatcattagcagtcaggctgtgtgaatttttttgtggtaagagagataaatgtccctcttgttctttgtggtttcctttgccataagagccactgctttgtgaaagttcttctttcctttctctggcttgcccatccctggattgatgtagtagccagcagcaaggacatatgaagggtctggaagtggaaggctgccacccctgccctgctcccacttctgggcccccagggatcccctgacataaacagtcctgcaggaggaaataataggtggacttgtccctgtgacacagtggaggtaggtctggaagtttcctttgaacattaggtaggtctcagctttgtatttcaggtgcttttatcatgtgttttatcctgtaacagtacattctagagctacctttcaagtgtcatcaatctccaattcattttatattttcctctatgtatgtacatttgtatgtatgtgtgttcagttaccattatgaagtaactgacctgaagcaaactgaaaataaatcttgccttatgttgccaacattgcatttttttttctttttcttaatttatctgtgaatattgtttttcttcttcttcttctttttttttttaaatggagtttcacactgtcacccaggctggagtgcaattgcgcgatctcagctcactgcaacctccgcctcccgggttcaagcaattctcctgcttcagcctcccaagtagctgggattacagccacccaccaccacccctggctgattttttgtgtttttgggagagacagggtttcactatgttggccaggctggtctcaatctcctgacctcgtgatccacctgccttggcctcccaaagtgctgggactacaggagtaagacaccgtgcccggccagtattgttcttctttatacctaattactcatcattggaattctctttaaaaaaaaaatgtgcttccctaattggttgccaacagagaggctacatcatagtggttaagaatataggctcttttcccttgactgaagcagtgattaaaacaaaaaaataagaaagaatataggctctggtgtcatactgcctgggttggagacccagctcttcaatttacatctgtatgacttcagttcatttttttttttttttcatttctacatggcttggtttccccatctgtaaattgtggatacttacactagctatctcataggttattgtgagaaataagtgagtctgtatgtatgaagcccatagaaatatacataacatagaggaagcactacctagtgtcagggtctaccactgtgtattctttaggaggtttcaatcttgaccttcagaaaaagaattatttcattcaacaagcatttattgaaaatttccttggtgctcatctctgtgccatgtcctttcatatagattttatctgacataacttaattcttaccatcaccctgtgttaaagttatggtgttcattttctagggtttaagttctggaaatgctgtgtgctcactgtatccaccaggataggtgaggctctgctgcattcatgaacagtcacagatctcagagcctgtgagcgggtttaattctccttcatgagaagccccctggtcagggtgtgttcctgcacctggtggggcagcatggtgggctatcccctcctatggctcctctgttaccaaacaagctcttcctatagctgcagctgaggaataaaaatgctggagaatcttggcggttaaatgctttgacttggaaataaaatggatcagttctacctgcagcccaggagcaagattgggttgcagactctacctaatggccctagagactgtaatcctcccacgtgctggaaggagagtagaatagggtatggtgaacaggagatgtctctaccactcacttgggactgtgagcacctgtctatacctcggctgtcttatctgtgaaatgaggatgacagctgtacctactgcatatagttgtgatagagtgaatagataaatgcatgtaaagctcttagcacactatatggcactcagaacatagtcaaaatggggtcactgtaatcatgatatacaagaaagtcagcggagcctcctaatacagtaaagtaaccattgttttgaatagtcacgtgtggatatcaagtccagttatattacttaccagctgtatgtatgagcatggggaagttatttaccttctctgacttttacttttctcttacgtaaaatggtgtgggatcacactcaccccataggctgcatcaagggttaaatcgctaacatttactgacaccttggaaagatgagctaagcgtttaaaacctgttggctcatttatgtctatgtcaatgctatgggaaaggtactctgttatcccccattttatagcagaggaaactaagcctcagagaggttaagtaatgtacccaggcctctctaactgctaagtggtagagcaaaaagtgaaacccaggcattttgtcttctcaattaatgatcttaatacgcattacagcctccctgagatcagttgggtaaagctctgagcacagggccaggcacagtgtacacccttgcaaaaatattaatttgcctgggtgcaaggtgagggacatatccttttcctattctgaaactctactctgcttaggatgcatactgatggctctttttttgtgaatggatggaagtatgaaaggagcagtaagaaagggcactatcaggctgcatgcagtggctcacatctggaatcccagcactttggaaagctgaggccagcagatcacttgaggccaggagttcaagaccagtctggccaatgtggcaaaacactctctctcctaaaaatacaaaaattagctgaggacagtggtgcatgcctataatcccagctacttgggtgggtgaggcatgagaatcgcttgaacccaggaggcagaggttgcagtgagccgtgattgtgccactgcattccagcttgggtaacagagcaagactgttgaagaaaggaaggaagggatgaaggaaggaaggaagggattaagggagggagggagggaggagagggaagaaaaagaaggaaggaaggaaagaaggagagaaaagagaaaagaaaagaaaaggcactatctatgccatatgcttttgtgagactatcaaggcctgcatgcaaaaaaacccagtgcagagttggtggtcaattagctggagtgctttattatttttaataatcagccatgcttagtgggagtctctgaatctgtagttatgactgtagtaaatgggacacaaagggagcagctggacataccggcaagtattataatgtgcagacaacctgcaaatatgaaccttcttttcaaataagaatctcagtgctgtcactatttgttttaggaagtgctggttttaactgaatgaggaagttaaacgcatgttctgttttttgttttcattgcgcccacatgggttgactgtgggttcggttttctctccagattgaacacttagtacttaatgggggaaccaccttggaaaagcagaactgatttgaggtggcttcatccctctcttctcccaccagaaagagatgggagcttccacttcaacctggggtgaagacagagaacaaggtgtcccagcattttgcacagaaccaaagccctggaaattctggtggaagctagacattcagagtcatcaagctaacagtcacttcctgctatgtgccagatactatgcttttcacagacatctcatttacatttcccagaacatcaggttggagtgcagtgacgtgatgcaatcatagtttcctgcagccttgaacttctgagttcaaatgatccttctgcctcagcctcccaggtagctaggactacagacatacactaccacacctggctgagtttgtttgtttgtttgtgtgtttgtttgtttattttgtagcaatagcatttcactgtgttacccagagtggtctccaactcctggcctcaagcaatcctctcgcctccactttccaaagtgctaggattacaggcacgagccactgtgcccaaaagttaagattcttgtagctgctttatagaagatgaactgaggatcaagaaggtgagacttgatgtgagtcagatagtgaatatgctatagaaaactaaacccagttcctttggggacttggaatttggcatcaatattgtcaccgggctttaattttgcttaactccacactgtggtctttgtgaatggtgcctccaagagttgtgcccctgggtgggcctgagctgaaacatcaggtagatgcaataggccttgtcttttgtgacagttctgtaccatcgtctataatatatctgtattagtaatctatggttatacaacaaatcaccccaaaacttagcagcttaaaaccatatttattattccacaatttctgtgcagcaagaatatgggtgcagcttagctgggtctttgggccataatcaaggctaaaatcaaggtgtcaactgaggcagcagtcatcctaagacttgactgggcatgggttggctcctgagctcattcatgggattgctggcaggattctgctttttcaggctgctggactgagggctttgcttccttgctggctattggatggaagaaccctttaattccttgccttttggacagctccagagggaagctcacaacaggacaacttgattcgtcagagaaaataggtgagaagagccagaaagccagagggccaagaaaacagaagccacagtttttgataacagtcatagaagagatgccctgacacttttgttgccttctatgctttagaagcgagtcagtaagtccaccccaccctcagtggaggggattacacaaggacatgcatatgaggaggcagggttcactgggagccagccactgcctactacaagaaccgtgattattttaacgcaaaatgatgggtcaaattccttttattgggtagaattgtccctccagaaaaatctcttttgtcttgaatattcatgcatgctctggtacctctctttctgtgataaggacgttccagtttgaaaaacctgagtttattagtcaaattgtgctggtgtagaaatattccctctctttcaaataactttgcatccacctgctttgactcatgatgttgaatctaattttattacagagttttggatggtgggggcatttccacgttgctgctatgtactttctatacaaataagtgttgacctttgaagtagtctccctggaatagaaggttttaaactcattgatgatgcaaactttgcttaagaccttgttgtagcttctctttgggaatggcctttggaatcacgaccagaaaaaaaaaaaaaaaaaaaaaaaggtctgctttatctattctcactacacagcatttattagatatggctgccagggagatatctccttcctcactgattgttattctatgcattttcttcctaaaactagtagatttgaactcatacctatctagagccctcattatgaacaacagctttaaagcacgcaaggcactaggaacccctatttaatcatttacagaaaaaacatggcaaagaccaccacctccttccttaattccatggtggatttaaaatgcttagattagctgagtcttaggaactgaagtatccttggtgtttcatttgtgataattttaaatacaagtgttggtctgaagaaaggaaatgatcaggaattagccctggagcctgctgtgtatattaaatcaatctcagatggaagaattgagatcccggaaagcaaagaaatggctggacttagagaggaaagataatctagaagtgtaaagttagggtgggagggagaagggtaaagcttgagtaatgagtccactgaaaactattttttaaatgtaataaatacgtaagtagcagttactgtatgctagatatccttctaagtgcttgacaaatttactccttagaagctaagtactattttccccattttctagatgagaaaaccgaggtgtagggaagttgagggacatgtccaagatcacacagatagtaggcagtccagcttcagaatctgtggtctctaccagtgcactttgccacttcacagaactatccagccagaaagagcagaggccgctttgagaatttctgtgcaggtccaagcgtccacttaaatcagggctcctaacacagcagttctccaatgtcctgtagaaaacattcttgttcccttgggacaagagaaatctgaactcagttgtgcaaaaaagagggtctgggaatgaaccaagagggatggtcagtggctccaaggggcggagcgggagaaggcaaaggagaggggccaggagagaatgccaggaaaaaccagaagaaagatttaaacaaacctcataatttacctgtaaccgacagctctccttggatagtttatctgggcactctattccaccagaaccagattgttggagttgtttcaacagaggaatgcagagcttaagtgtgtctgtgctgtgtgaatatacctttgtgtatctgtgtagcaggtagtggtagaaagattttggaagtcgagggagatgactgaagtagagggaaaggtgggaggtcatggctctcatagtattttgtcacgaggtaactttgacaacccctgagaatcgatcagtcccccaagaagtcaaatacatctgcacatgtgtatcatgttactgcatcttaccttgacaggcgcactttaggggatgcagtctctgcccttttgtgccaggagcaaatccattttgcccatgatttcaggtacacaggtgatttcgccaaacaaaacaagcacagctgaaatctgtgacttaaatcaagcaacggtgtctgcaatagtctcattgcagagacttctgctcccttgttgcttgtaggaatgggggtggggaaaggtcaggactatatatttaagaaaaaaaccccacatatgtcgacccacaagtggttacaacaacattggtttacttgaaagctctgtctccactctccctacaaaaattcaagtaagaacctggaatgcaaggaggtggaagagttttctctccttgccaatctctcccttgctctctgataaaaggtgcggcaaacagggtagaaatgactgcacgggaccagaggatgtaaatattcagtcatgacagtccccataggataaatgacagcagcccatgcaatgtgccttctgcacattttcaactgactcttcccctctgcagccaagttgacatattagtaaattgattccaggtgatgctgacattttgtaattatcactatctataattttcatcttatcccatttaatattttgatcatttaaaatagagtagcatacctaatagtggtcattagtttagctcaagggaagattcatggtttaataaacttacattagaaataacttactaaaattacaattggcatgattagctacttttttaaataaaacataacagagtgactttacccatgctgacagcttttttctttcacgctggttcattgttctattgttgtcttggaggaagaaaagacatgtataacacagaagttgtaataaaaactgtaataacccgatacacaaaaacaagggttatatttcattctacatttgacagtagctgagtagtgtactttttcttgttttctgactggactggagggaggaaatcactgtgactttgaatcagggtcacatttggggtagctgtcctcttctcctgctgtctggagagactgtgaggttgcctgaaaggcagtgggatttaggcttgacttccttatttccctaggcattgattttttttaagtgtatcttctgaagtttgcctctaggttcacttgaggtatcatttctgaagaataaaagtggcagttttaatatgcaggcaattttttaaaacaatgaaatagagatgtgattattgccagggcaaggctgtttagttgccacagggaaacattataccaattggcctatagcttgaaattacagcattctctatattcgtccagctttagggaaatgcagaccacaagggtcctgcctaccgttctgcttgctggtggttcaggttttgtgaacttatacaagggcttggtatttgaatgctatcttaatgagaataagcttttttgttgtgtacattggcaacttgatggctaaggtcattctccatccatttgtctagctacccacacacctatacatccatctacccatctgtccacccactcacccatctattcacctatccatccacccagctatttatctatcatccatccatccacccacctacccacttattcaccaatccacctattaatctatccatctacccatccattcagctattcatctacctatcagtccatctatctattcaacctttcacatatccacccacttacctcccctctcatccatcaatatagccttgtatccatccacgtaaccactcatccttaaacaaaaatcagttggcaaaactgtaagcattggtaataaagagacatataagtcgcagttctgtccttaaagagcttaggatctagtacgggagtatatgtaaaccaaaaattacacaacagtgtgctcagtgcacctacagagaactgtgccgtgttgctgtgggaactctaaagaaagaatggtttactgtgtctgaaggattcaaagaaggaggcacacatgtgaacctaaatgtcatatgtggtaaaagaggaagtaaccagccaggggtgaggaacacaacagcaggaaattaagtagctgatgaatattcagacttgaagttcctcctaaagtgcccatttgttgtttggtagaaatatggatatgtaggagggggcctctaccagggtgcagaacatatggtggtattattagggcaccaggcaggagctgaagtaggggctcagaaagccaatcacaagaaccaggattcagggtgggcctgtggttttgaatggaagaaaggagaaaagagtaaacaaatgggctgggcacaatggctcacgcctgtaatcccagcactttgggaggctgaggtgggtggatcacgaggtcaggagttggagaccagcctggccaacatggtgaaactctgtctttactaaaaatacaaacattagccaggcaagtgcctgtaatcctagctactggggaggctgaggcaggagagtcacttgaactcgggaggcggaggttgcagtgagccaagatcgtaccactgcactccagcctgggcgacagtgccagactccatctcaaaaaaaaaaaaaaataataataaacaaatggatgcatgaacaagtgcataataggtagataaatacaccttaggagacagatcaaaatgcagacttgaatttaattggcacagacacttaattatgcatcttgacatctttgaccaaaaacaaaatgccaagaacaaaagcagcttcacgaccaagcacatgctggaatccggccttctgtctgccttactcccgctgctggtgaagctgcaggaatcctgacaggagcaggctgcctttcagctccaagttcctggcactaagttctgcgcaggggcctgggcgaggtctttatgactttccagaggcttccaggtctctattgaaatgcaacagctgttactaggggcaactctacttcccaaacaagaacatagactttgtggagctttcccaggtgctgtgaacccagcattgccaaacaatgcctgggacccacagcgtctccttcccccatggagtttaaatagattggaagcaaatgcttgttgacaacaggtgtggctcaatgtgagcaaacgttccattccgttattgcagggttggcaccgagggacatttcctgtgaaagaaacaggcttccaggagcatgggcaatccatactcatagccagacctgctcagctcctccccttcagggccaaagaccgcaaagctccgtgaacaggtgctcctaataaatgcagagttttccatagcccaagcaaggctagcagggaggggaggggtccctggccacaaagctccaaccagccaactgatcaggctttctgcgatgatggaagtggctgcatcatcattaactcagctagattaacctgttcagcagaagcttgcagagctgcgtgagcctgccttccactcagcttgaattaaagagattgggctgcaaggacacagagaggtgagccccaggaggtggggtcccagtcctgagattagtgacagcagccctgaggatgtagagaaaaacttcttactcctttgaaaaatgtgtgcagtgattcttttcctccctgagctgtcttggagccaaagtaagttcttcacggaactaaatggagttgcttgttcaatgagattctaatttcagtgagaggacttctcggctacatatgtattgctttgggaagtcctcccttccgaggcaagggcttctccacacctaggatttgatgtagaattactagggcagtatgtaaggacagagaaagaacagaggcagcggcaggcttctgacaagggaatactggtaatcaggctctctgcataatttttggagatttggagatggagttagtggagggaaagaaagaaacggatataattagaaaaagaaaaaaatactaatgtcttcacaatacttaatgttagaaattcaatttgtttttttcttctacctccgcaggctctacatgttcctggaggtgtgtgtggctgggcaattatcctttttcactcttgcccagtgcttgttttgaatgcaaatgtattagttcagatgggccaagttgcagtaaaagaaatccacccccaaatttcggtggtttaacagaacagatgttcttatcctgcttacccaacagctctagtgggtgtttcttctatgaagctgctcagaaactcaggctgatgggtgaccctgccattttcaacatctggtcttcaaagtgaccttagacgttgacatccctgtcggccagaatgcagaagtatcacggcgcagcatgtgggagaggttcttatggactgtgcctggaagtggcagacattgtccccatcacttggtcaaatgaccacacctaccagcaagggcaatgaggaaatgtggtccagctgtgtgtgtacaggaagaagggacagcgaatgctctcccccacaccctgctttcagggtttatccttgtcatttattgagggcctgctatgtgccctacattgtcctaggagctgaggatacagctgtccacagaatacccacggtccttgcccacacatggttagaacctagtgagggaagaagaagaattaatacctctttataaaattaattaattacactttggataagggtcataggggaaaacttcagggcaccatgagagctggtaactctctctatggtgaggtgaaggggaagtagaggaggtttctgggaaacagtgacattcaaactggcaaaaagaaagcaaaacagacttaaccaggcagatgcacagcagggtggcattttaggaagtgggaccagcagctgaaaagtccttaggcagaaaataatttcaaacattttagacccttcctccaaagggcagcgaggctgatgcacattgaagaggccagagagcgccttgaaatgagacagaagagctgctccgggctgagatggaagtcatcttcctggactcagacagttagggctactccttagcagtagtgggggcccgctcatgggtgtaagaaagaatgtagcatgatcagctgtgcttgtcaaaaatctgctctgcctgatgaagtctgaaggagggagggtactgcagtctttcaggggagagacgggggcttgcgttcggggctggcagttgaaacggagagacataagatagattgttgaaataggaaggggaagacatgagactctcttatgtctaaatgtctaacatgggttggaaaggctgcccaccagtcccaggtatgcaggcttggcacttggctcatttgaaagagagacaactaagccataactggtttatccttttcctctgcagttttatggccttcttgacttcaggcctatttaataaaatgcagctctttaaaatggatgttcagtggagctcaaattcaccctcaatgtgcacttctgcggactttgattagtatgcataatagagcagcacacctgatgtccgcagcaggcagttctaatgccggtggagagaggtacaagataaatcactccaagtaaatgactaattaatcatgcacttgattttaataacatataccatctggctcaagatttgtctgtctacaatcttgtattccattctagagatttgataatcagtaaaaccacccatggattcctaattgaggacaatttctttcctttcttttagaaaacttaggaatcaaagtgtattccagtaactgcatggaaggggctggagggagaaggttattgttatatataaagtcgcggtaccgcaaaagaaatagcagtcgaatataaaattttatttttaattctcagcaaggcaagttacttctatatagaagggtgcacccttacagatggaactatggtgagcccacatttggacaagagaggggaaggggttcttatccctgatgcacgtggcccctgctactgtgtggttcccctgttggctagggttagaccacacaggctaaactaattccgactggcaaatttaaagagaatgatggagtgagtgctttggcaggagtcaaggcagagcaggtagcaagtaatctgaatgagttagggtgagcaagtgatcagaatgagttagggtggagcaggtgatcagaatgagtcagggtggagtaggtaatggaaaacggttgctttacgaggaagttaagtttagaagtagaaggcaaagaattgcacatactgacatattctttgaaaagaaatttagaagtcatatcttacagttaaggtttgattttttttttaaatcttaaaaccatcatagatatttcaggataatttatgggacaaaatggacactatcccaatgaaaacgtgtaaaatcacttccaaaagtgtctatgccagagggcttacttgcaatgatcctttgatcctccaaatcagaaaacagttttttttttttttttttttccatagtctcatctatgcctttttggtttttcttcttcttttgtgtgtgtgtgtgtgtgttttattatactttaagttctagggtacatgtgcacaatgtgcaggttttttatgtatgtatacatgtgccatgttggtgtgctgcacccgttacctcatcatttacattaggtatatctcctaatgctatccctccccctccccccaccccacaacagggcccagtgtgtgatgttccccaccctgtgtccaagcgttctcattgttcaattcccacctatgagtgagaacatgcggtgtttggttttctgtccttgcaatcgtttgctcagaatgatggtttccagcttcattcatgtccctacaaaggtcatgaactcatccttttctatggctgcatagtattccatggtgtgtatgtgccacatagaaaacagttgtttttaagggtattggacaagggtcatgactgcttagcaaggaagcatcctctacttgtgcatggcttcaaacgcttctaaattaacaggagtatgaaccatctgaggattcacaatttccagtgagtcttggctctacttatttgaaatggatagcttcctaaagtaacatataattcacctataaaatactattttatctcataagacaaaatgagtccatggtcttattatgtaagactgttttccattggggctggtctcaggctaggcaaggtgagtatctgtaggtggaattctcctgagaacagatgctctaaactttttaaataattgatttgacttcttcaccatgtccatgtatacagctgagcatggccaatctactggtttgtattatactgtcaaaaaacaaacaactttccctaacaaaataaacagtatctcaaacagcagcacatatgtcctggggggtaaacagaaaacttgtcccatttgactcatttcattatttggaagaaatttccgtcacagaaggcagatgtcggtggactgataccagatagtagagaaattctgagtgtttactgtgtgcaaaaaaatgctgcattggggggctttaatcagaaatccatgaaaaatagtgtaagtacaatttatcgagcatttattgtatgctagacatatgcatcacctcacttcagaattagcctatgaagtagaattattattgtcctaaatggacaggtgggacctaggttgcccagagaggtgaatgggctttcacagggtttcacaaccagtgggaaaaggctggactcaatcccaaattaggctcattaatcatgctcttgattttaataacaattttgtttgttttttctctagaaaagttacgaattaagttgtattccacggactgtatggaggggggtgaagggaggaagtgtgtgtgtgatctcaaaagccatcatacatctttccggagagtttgaaaataataatctgaaaatccaaaggctgactcacaactcctgggctgtacctacgatacagtaagtaagaggatggtgtcactgtgtcctcccttctgtcctgaagcattccatgctacacaccattcataagatttaaaatcatcttcaagaagtgccctgttggaataataagtcagtgctctctggaggctataaccaaatataatttgccacataaacatgaaatgtgtgtccaagaaactagtaggaatgcatctaggaaccaaagtgtctccttcctagagagagaggaaaaaaacaaagtgaggatggtcctctgcacaggcgttgtatattttgttctcaaatccagcagccttgacttgacatgggatggttgggatggttctccacgtagccacataagctcgttactacccattacatctgcctgtacctccagcaggtgcccaggagatggctgagtcccaagagccatgcaggcctcctggacgaccgccctgatgtggtccacgtgactcttaacaggtatcatggccttggcacatgttgggcattttccagcgtcactctcagaagaccctccctccatgagttcaccactgctggtctttaactctcagcttagggaatcagactgaattagttctttgtgttattaaccggaggaacacttacattttctgacaactctaatcttggagctcagggaatagcacagagcatttgtatgaaattacccctcgttctatctataggcctaacagccagcatttgtgaatttggcagaagccagcagatctcacagttaatgtcttcctctcctgccaggatctttggaacaaggtgcttagagtgccacatgacaaagagccggacagatcctgggatgtggagcccaggtgatgttatttgcatccaattaaagaagcaggaatgggtagcataattgacatgcatgactcttaatgccttttggttcattaagcctttggatcaacttttgtaggaagacatttaaaagaaactgagcaggacttgggcacaggtagaggtgagcttccgggctgaatcccctactaggccgttagtcaattgtatgtttcctttttggactcacctctgggttgcaaaggaggttgctctgattgtttcttgttataccataaagataaggagcttgagttactttccagctgataaggcaattttcacctttttccatttgtcttggaatttcacaccccaccccatcctacccttaaggtgccctggaggggttgaagggccattcttggtcatccagtctctgtgtggttgggttgatcacagaaactagagaagtcacgaagagtaggtgttcctcaggttaattacacaaagaactaattcagtctgattccttaagctcggagttaaaaacagtgattgtgaactcatgaagggagggtcttctgagagatataaagaggctgatatatgctctttatatctcacctttgatgatacacagctcacctttgatggtcactctgaatcacatcaaggcgatgacaagaacaactgtctagacttagtggtgtggctttgaaacgacacttcgccattcagggattcaattgttttccagttttataatgagggagctgagcaagagaaatattttcaaaggccattctgggctgcacaaggatagaaacaaatgggaggtccattgggcaggacacacctgtttctacaagagcaacctacttttttgttttgttttaatcaagggagtgtcaagcaattgcttatttcataaacagggctgtgctgctatttttacacagtgtgaagtccacaggtctgaataatttcttcttgctccaagagttcctaggtcctgtgttcagattttgagagccttcatgtctcaggtcccaatagcagtttctatgactgaccagcctgtccacagagcatctcctcactggacaggcattgtgggcacgctcctgcggaggaagaatcagggtggtgaggcaattagtaggtgttctacaatcctgacatctttctcagaccagcccccatctctgtctattggcgagatttcttctttagcttctgctcactatgacatgaaggacttcttcttacctagatattctggtgctataggggggtgctgatcagtggagcttagaattactttacacacacatgcctacaccccccctcgcaacacacacacgtaccttacaaaatttctaattataggccaggcgcggtatctcatacctataatcccagccctttgggaggccgaggcaggcagatcatgaggttaggagttcaagaccagcctgatcagcagggtgaaaccccatctctactaaaaacacaaaaattagctgggcatggtggtgtgcacctgtaatcctaactactcaggaggttgaggcaggagaattgcgtgaacccgggaggcagaggttgcagtgagccaagatcgcaccactgcactccagcctgggtgacagagtgagactctgtctcaaaaaagaaaaacagaaaaattgctaattatgctgattactttagataaacatttctcaatttgggcttcaaggcatattaatagacatacaaaaaaattatttggtcaagtgaaaataaagcatatcctgcgtcccatagtagggtagtgtattagtcccttctcacgttgctttaaggaaataccggagactaggtaatttataaaggaaagaggtttaattgactcacagttcaccatggctgggaaggcctcaggaaacttacaatcatagcagtggcagaaggcagccatgattgtttaccaggcagcaggaaggagagtgccaagggaagagggaggagtcccttataaaaccatcagatcttgtgagaactcactcactaccatgagaacagcatggggaaaactgcccccatgattcaattaactccacctggtctctcccttgacatatgtggattgtgggtgagagacaggactagctggatttcctaggccaactaagaattcctaagccagctgtgcctggtggctcacgcctgtaatcccagcactttgggaggccgaggcgggcagatcacgaggtcaggagatcgagaccatcctggctaacacagtgaaattccgtctttactaaaaatactaaatattagctgggcgtggtggcaggtgcctgcagttccagctactcgggaggctgaggcaggagaatggcatgaacccgggaggcggagcttgccgtgagcagagatcacgccactgcactccagcctgggcgacaaagcgagactccgtctccaaaaaaaaaaaaaaaaaaaaaattcctaagcctagctggggaaggtgaccacacccacttttaaacacggggcttgtaactcagctcacacccaacaaatcaggttgtaaagagggttcactaaaatacaaattaggctaaagcaggaggtaaagaagtagtcaaatcatatatcgcctgagaacacagggggagcgacaatgatcgggatataaacccaggcattcgagcagggtgtggtaaccccctttgggtcccctcccattgtatgggagctctgttttcactctgttaaatcttgcaagtgaacactcttctggtctgtgcttgttagggcttgagctgagctttcgctcaccatccaccactgttgtttgctgccgtcgcagacccgtggctgacttccacccctctggatccagcagggtgtccactgtgctcctgatccagcgaggctcccattgccactcccgactgggctaaaggcttgccattgttcccgcaaggctaagtgcctgggttcgtcctaactgggctgaacactagttgctgggctccgtggttttcttctgtgacccacggcttctaatagagctataacactcactgcatgtgccaaggttccattccctggaattcatgaggccaagatccccaggtcagagaacaaaaggcttgctgccatcttgggagcggcccgccccatcttgggagctctaagaacaaagacccgcccgtatcatggggattacaattcaagatgagatttgggtggggacacaaaggctttcatggtttttggcacccgctgctgtcccctccttttgagtgtgggacggatctgtgactggcttctagcccatagaatatggcaccttccttcacataaaccatccatctctgagccatccccggttccttgacttcatagactcacaattccagataagagatgattctaccaccttgctgtcctggcatcccgggattcctgccgcgtgggctgaactgtctgcctttcccagtatggaagtcatcacttactcattcaatcatttagcaccctttctcgcttgcttggaaaatacaaggtaaaaaacacactagcctactatttgatatttgtgcgtgggtgtgtgtgtggggcgtcatatatccctcttagcatctgataaaaaaaagatcaattcattacccagaaatatgtatctgcatgtgtgcaagtcccaatacacaattcagtacaattctgggggttctggactccctgaggaccatttataagttctctccaagtcattgaccccaggtttagttgcccctctagactataaggccccctagatagaaggcaagtgtcatatgccactgcatccccaactctgaggacaaagcctggtggcaggtggaccttcattcagggtgaattgagctgaattcggtacatggctctgtactcagaaggcctttatttatttcttgtgttcctcttatcttgtcacactccaaaatagaaatgtatacctctgctagttgaatgactgtttatttggaaatcatcacccaatgcccaactgcatccaggctgcgtgacatcattccagactacaaagtgccaagcgctaattgatttgtaagaaagtccacatgaaatgcctggcactctcccaaaggcacccatgggcttggagggacgacagcattggactgttatgcgaggaaataattcttgcttgcccgcctgggatggggtgacgttctggccaggaagcagaagcagacttgactttgggcagcagtctgcccctgatggagttattcacagatggctaagttaaatgcagccctcatagcactaaggcatttcaggggcgactaaacaagtggcccatgaaatggaggcaccagaagcctctggaagcggcatcagtgcatcacccagtgaagccattgtgtcgcctgttagtaatgagcatttgcaagggcagcatggggaatttcaatcaacctgtgagaagacaaggtgtgcagacattgtggatctgagcgagatggggagaaaaggcaataaaaagcagtagcaaaggggaaaagaaaagttcgggccaggagccaagaagatactttctgtggaaaagggagggaaaaaaaaaatcactccacccctcctgtccaaatgaaaaagcatttaattgaatgttctttatagaggtgaaaaaataccctgtggagttcccagtgtttcattatccgattgagttcggtacctcaagtttcaaagaccgttctcctgaatggttattctcatttccatgtcagtctgccgtgtgcttggtgaacccctgctgggccgcatcatttaaaactcaaaaccctgaaagtatttttatgcccgatatagtaacagagcaaaccctggtatcactcattttattctccgcagcctccttcctcttgtctgtgatgtagatgactgtgctgctcgagatgcttgcaatcaacagggcgctccccaagctctgaatgaggtgaatggcctcagaggaaaacagattagaaggcttagagatgactgcatctcaggtgcaacacttgaagcaggaagatgggagtctcagaattttccccttgcagttagaaaaatatgggacaggctggggcagtaggagtggatttaagtaagtgagacagtggatcaggaaaggccaggcttttactgggtggaaatagcctggatgcaattatctgctacaagccccaccaagaagagcctccctgctggaggaaagcagaaagggaactggggtataaccaagcttgtccaatccgaggcccgtgggtcacatgctgctgagggaggatgactttgaatgaggcccaacacaagttcgtaaagtttcttaaaaggttatgaaatttttttgcaattttttttcttttcttttctttttttttttagttcatcagctgtcgttagtgttattttatgtgttgccaaagatcattcttcttcttccactgtggcccagggaagccaaaaatttgaaaacccctggtttaaatcctctctacaaactcgccagctctgcaaaataatcatctttgttggtcttaagaacactttaaatcaggtttaaatcatctgaacatcagaaaggaatttttttttcttttcttttcttttgttttttttctcccttgagagggaaatctaggggtggagtagagaatcatttaaaatatttcccttcagagaccaacggctaggaatagctgataaataacataaaagagcggtttaatagtttcatgtttgacccatgtaataccccgcacatttggttaatttagaaaatatttgacgacaacggaatccaatctcattttctcaaacagaagcttaatttctctttgactgaaatgaatagttatgttgccatgccttagccaaacaccctataaatataataccccttcagccttaatatttcaaaaactatggttttcagtttgagctgttataatgttttatctcagaagttgtagaataatttaaaccagtttttcctactttggttccttggaggctgattcttctgcctgaattcctctcacagaacatataaaccccttttacctccctcactggcacaaaagcaacttgtttccaagattcaggacttaaagaaatggctgtgggttggtctacgaaaaccattatgctgcatcctcccagtcctgagagattctgaagagaagcaggccctggcttcagagttgaagaaatgataccttccctcctttgcctcatagtctcattcatgatgtttgcttcccatactcatctccaactggctcacacattccttcaccagatagtgtgggaaggagtccatctttctgcagttggctaatccaggtgttggcatggaagttttagctctggtctgagagttctagtcatggacaattgtccatgtctattggaatgaataattttccaatggacatggacagttgtcccaggggactggaaatcaagggtgctgagtaaactcagcctcagtggaccacctgtgtgagttaatacagagaccacattctgcatcttagcaacctaaacaaaggagaggcacagcaaggtgagaagcttcaaaaggcagtcagccaatgcatcaacctgggcccggaggggtcggggaacctcaaattgtcatccttatgtaacagtgacaactaacatttttcaaggctcgttaccatgccctggccacctgtcccacattattttatggaatgctcagtcaaccctatgaattacatactatattatccccattttacagactacaaaatgaaggtttaaggagaagcttacacacctcacccaaggtcctacagttgttaagtagggggacagagacctgcatttatctgtagaccctccactcttaaccaccctattgacccagttcctaatccagctcacttctgagctctggacgtccaccaggaagaaaacaatggctgtagtggtgcagtgacccttctttgccagtttgtcttgggtcctgatgagctgccaggctcagtctggaaaagtgccctcaatccctgcatctccatctctcataggcattgtgggaccccacaaagactctgtctctattcgcttaacacagtggaaaaaaaggccacccttcattctttttttttttttttttcattcaacaaacatttattgatcttctaatgttttttcaagaatgcttttgggcctgggatacaaactaatggacccaacagatgagtcccttgccctattggcacttactggttcatgtcaggttcctgtgcctctcctggagaagcaggtgataaggtctctgtgttaaaggaggaaaccaaggttctaggcagcctcgtgggtaatacagccagtaaattgcaaagctgggtgaactcaattgacaggactctagccagaaactggttctttgccattagtctctactgacccctatggatgtatggagggagtatggggtacctgggaaacatcaagccttacctagaatcatctttccaatctcgctcttctcttccatttagaaccaccttcaacatctccccagggtacattccctaaatagccccgattattcattattttatggaactaccagatactgaattcctgttctgggccatgcactctaggagctgtgatttcaacagtgaaggaggacagggtggaccccaccatcgtggaatttacattctaaagggcacagtttttctgttgagtcttcccaggaggtgtctttttatttcatacctttgaccttcagatccattcatgatactttggcttatgggtgttccacacttgattccaagggtgatattccatatgtgtaatgcctcgctcaatcagaatggacactggccctagtggccacccaagatggattcttggagcttctttgctgtgacaaataatgaccttttagttgacgaattataaggaagttatgggagatcccagaggaaggctttaagacaggggaattcagagagcttggagcagcagctctttacgtagggccacagtgtatttcagtgtttctccaacggctgcacctgtggacctatgtgtactgggagactattgactctgctcagattacatgggtaagtttgctccttacaactagactgaatgcccattggaggcaggatcctatcaactttttcttctgccaaaccagcctgacacagtatacattgcatacgattcttccatgactatgtacttgtcatgagttattcctcatcattctaaaatttgacctcaaagctgagcaaagtctagatgaaatgaggttctagtttttataataatgttcaatagtttttcctatacgtcactctttcagtgtggggaggaatggtgacttttcagttgcttctgaatacggtttgctgtacactgtgtgttaccagtgtgatttgctataacccagctcttggagcctcatatggtatgtggttcaacagtacagtggtcagtcaagaataaatacagagcaagtactacggtagctgcagaaagagcatcgccaccatgcatcattagtgcagagccctggaccaaaggactcgagctgccgccagacctttacccattccaagtgcagactttgctaattcatcactgccttcctcaagaccccagcaagcttctcatcacatcacttttggcacttatctgatctttcaatgatctgagttagctcaagaaattacatctagttaccataccatgtcaagactgctatttaactagaaaacaaagagacttcctccactccatgcaaacacatgttgattctcatttacctgtttaggaaaaaaaaatttagattcaggctcatatactaattttattcagtgcttaaggtatgtctgttatttgggatagaattcagtgaacaatgctaaggtttacaagggcccatgtatgactttagggccgtgtgtgtgtgtgtgtgtgtgtgtgtgtgtgtgtatacatgtgtatgtgtacatacttttccccctgtaataggatttctttagatctgatgcttaataagacagaaagacaccacagccttctcagaagacctttgcaatatgtccttactactggtttgtgctttcaaagttcatgtgtgtagtggtctctcctgtcaccacgatggatccagatttaagatgtcattgagccatcacaaagtaaagagacactttctaccccaggttgctctggggtgagaaaactttgatgactaaactaaaggtaaaatcaattgcagatgcagtgtctgaattggatatgaaagaaaagaggctggcatttattagctgtctaccggaaaccaggttgctcttgaaacaccgtctcatttaatcagaaaaatgaccgcttgcagtggatatcatcctctccagtttacaaatctagaaaacaagtacatcaaagcagttaagcattttcgtaggagccgcacactcagtaagctaatattagaactcaggtctgtctgatttcagagctctttccacactacctaaaatattcatgcaccagatgaaagctttcttttttcccctagactgtttcttaaatttgtagttctgctttcaatacagggtttcttgaaatgtgatggtgtgattagacttctggttattactctccaaccatcatttctaagagaattggtgtgtgaggctgaagggatgatagtagggtgagccgtaaatacaggttaactgtcttaatgtggcctgggcaatgtctaattactcagggctgtttttggaagacacttccccattctaggataggggttacaagcacaaatgtccataggagctgggtagttactgtgaataagtgccataggctagcctgtttgggtttggggagctgagtgaggctgtactgggaaacacatgccccaggtagagctgggggttggtgtctttgctccgttaagacgattgcaagatcccagcaagggatcttgaatatttgcaggttctgggttctgtgttgagtgcttaaatggatatcttatttaataataacaggaacccttggaagtgagcacaggtttgattctcactttgcagataaagaaactgaggcccagaaaggtgcccaaggaagcagagttatttaggacctgacagaggtaggattccaacctgggcagtctatcaccagagtccttgtttaatcactaaattttgtacctcttaggactattcaaacccagcaatttgtctctgagaatgatagataaacatgaagatactggagaagtcaattatatatccccctaaaatgccttcagcgtgttcaaaagcaccgagctctccgccatgatgtttgtaagggggtgacgttagatagtgatcaaagaaaagtctaatacatgttattttttgttgtacagttcagttccttgtacataattcatgtgtcaattgatactcatgaaagttggtcttgaaatattgtatacagcccaaattaagagcttggcacccaatccccacttggactacaaatcacttcctcttgccaaattagagtctagagtaatttaccgtaagatgggcttttaaccctaatttctagacatactcagcagtctgctttgaaagctcatcagcttctagaagcagctcatcgttaaggagataccatcagggtaaacacatcagtttagtcttttttgcaacattgctaattccacgttgtaatcaaggagaaataaatggaaaactcttacttagtattagtttatttagacccatttatttccatcagtgaccttgggagatagttggttcagcacattttctcatattcggcctctaattcagtgtgggattttgtgtttttataattaacagagacatttacaaatagaaaaaaatatatttgtgcttttgggaaaagtgccaacaatgtggctatggaatttgattttctaaatggagactacacaaagtgtagattttttatttctaatgtatgtctctgcctatctactgatgatggattttggctttatggcaacccactaccaggcttttagctgtcagaattggacaacgtattgactcctaggtaggaaccgtggaaccactgcgttatcatgataagctggtacaagcagagaggatctattttctaagcagatgtttactaagggactactacactcgaatgacatcacatctttgttagcagttgtggttggtgccatgtttattaaaagacaggaagaccctttggttggctgttaactattgcatatttgtctgtcttgtcaataagcatttttttaaaggttacttttcctttatgtgtttacttggggttaaaattttgggattatgacaaaggccatattttgagattatgacaaaaaataattcaaaaatgaattattgaatgaggaagttgggtctcattcagtaggttaggtctcctttaaaattgtatttttctcgtatgaagacccagttcaatgggtttcatagccagtctgaggcaaaagctggctatttacttccaaaaggacttctcctcaaggaagagaccccctagtgatacccaaatcataaatcagagttcttaacttgggatctatggaacagagatcagggagtgagtcttagaaggcccgttaacctcccagtatgtggaaaaatgcttcagatgttgacacatttcacagaagtgtcatcacattaacaaagggctcataacccataaaagttaagaaccattaattttcaggtaattcttctaaataatgggtcctggccagctctacatgatttggagcatatttacatacatttgcatactgcttgtccttggtcatgccattcaactgccacacacctcattatagaaaagagaaagaacaggatttacctaaagctcaaaggaatagtgatcctgtgctaattaaaatttgttctggtatttgggagtctcagatgagaaatctggagtcatgttgagtttggttattttactcatttgtagtcagtattcaattattttaatttagcttgtgcattttcatgcaccttatttcctttttcctcctttcgactccatttggtacatttcatctcactaaacaaggagaaaaaaagggaataggagttcttgaaactcaaaagcagcattaagttcttgtctgtgacccttattgagcaaagattaggaccagtgtttacaaatttttcaagtactctcaggagctcttgatgcttagactctagaaaatgttgggtttgttcttaagaaacagaaagtgtccaaatcccacttggcttcctaacctctcagactcactctctgccctacagagccttagaaggatggccaccaacacctatgagatttactcctgaatcatttgtctcaagccatttcccactctgctatcagcctgtttctgttaacctggctggtgattccacgaatcattgtcccctttgaagatctatctaacctcctggcttgatgctcctcgagggacctctagcttctgtggattcaaatgctttaaggaaaaatactcagtctaatccacactgtctctagaaccagctagctttgtgcaatcattcaggaacatctctggccctccccacccacacactttccatcaatccagaaatgatcagattcagcccttgctcacagatgtgaagccacaaacggcagctagggtcaagaacagcaaggttactactggatgctgactcaaggcaagaagaggagtcaggcacaaaattctgaaattagtcattgagggaagtacaaagcttaaccgtagacaggaacctggaaatgctgggtcagcctcttcgtctacccgtacatgacatacaaaattattccatgttacttcaatacttttacccagagccttgtaacaatcttcttgaactgttgaatctatacaggtgtagattgggtcaggagatagctttaaaagtttgttgttcacgttcgtgccaactcctggtgtcttagattttgttcccaaacactcattatgacaaaaggatttaagtgcattctatttatttgtgaagtgatgcaggaaactacagtaaggagtgcggatgtgaataagtggaaggcaatacagtgtgtgtgaatggtaatgtcacctccatgggcgggtggggctcagttccgttgaggatctctggaagactacatataggctggctcagagctgtgccccactggggcagctcactgggttatttatctatcatctccctctcattggttggagcctgcttctaaggggcataatattcaggtgctttccacctgccaagagaggaggccaagcatgctccagtggccgcagaaagtcctcagcagaatcccagggtcttctaagaagaagacgtggagatcgtgagaatagtgagtgctcacagtatgtagcggggacaacaacagtgtctcccacaaccagcattacagataaccaggagtcgaccctgatgaagctggtggctttctcagctttacagaatgctcttttctgcttcgcctggcaaaacaggaggatatctgtctcaaagttttcaaagaaaggacattcagtgatctgttgagagattcagaggttctccttttctctggtggtgctctatcagggacagataggtccctaagacttagcagcaaaagggactctccctgcagaagcatgtgcatgatgtgagtaggtgtgcccacagcccagggttcatactctggggcttcatgcccttttcctattctttgtctccaaccgcatcttataagaagtgcatgttaggaaagagtacactaaagacaggaacagttactggattaatataactttaaaggtgagcatactggggaaaagtgaacagcaacccttaccagaatgtttaggtacatttctgcctccctcttcaagctgccaggaaagtgcactgtaagttaccaaggagcaaacttcagcgcttttccaacagtcacaaaggactctctgccaccatctgtgttgcatgtgtgctttacctttgctgtcctccttactttgaaataaatcccacccactacggtgtcccatttcagaaactctaaaatacttacttgaatccctggaatggattcatccaaccctgttcggttttcttccttccagtgtgctattctatagtagaaacagtgccaggccatgggatttagacatcagaggcatttccaggtttataaaaaggcgaagactgtattaaagtatttgcttttaagtttgttggccagttcttctcactgaccctggataggtctaggctactctcagcttacctaccatgtctttgtaagatgtgtagtccatggtgcttgaatagcaccacaaagacgtggagaggtaaaagacataagatgatctcaattttgaataattctccttgaggggcaattatatatttttggaaagttcattcttatttattgggccttctttatctcagaattcaggaaggggcagagtgttttcttcccaagttactgactttcttagcatgcgaggctcaaatgacaatgattatttagaatctctgagcagctcagactcagttttttttgtaatgccagcatataggtcaaatgtgaattccttacaattttttctgaatgggaagtttagggaacgactccaatgttcctgtagtcgctctaagtcgtttaggtgtgctataggatgaaaagaagaataatgaaactgtggtatatgcatgccgtgggatatcattcagtcatacaaaagaagaaagtcctaccatttgtgacaatatggatgaacctgcaggatattatgctaagtgaaataagacagtcacagaaggacagaaactgcaggattccacttatatgaggtatctaaaatagtcagactaatagaagcagagtagaatggtgatttgggggagcagaaaggggaaatttattgctcagtgggtataaagcatcaattatatgggaagaaaaagttctagagatgttttgtacaacttagtgcttttaggtaacaaaactgtaatgtgcacttaaaaatgtgttcagaggctgggcgccatggctgatgcctgtaatcccagcactttgggaggctgaggtgggcagatcacgaggtcaagagatcgagaccagcctgaccaacatggtaaaaccttgtctctactaaaaatataaaaattagctgggcgtggtggtgcgcgcctgtagtcccagctactcaggaggctgaggcaagagaatcgcttgaacccaggaggtggaggttgcagtgagctgagatcacgctactgcactccagcctggtgacagagtgagacttcatctcaaaaaaaaaaatgtgtttagagtttagatctcaggttaggggatcttgctacacacacacacacacacacacacacacacacacacgcacacacatacaaatacaaagaaatacaatgaagcttttagaggtgatggatatatttactaccttgattgtggtgatggtatcacaggtatatgcatatataaaacatatcaaattgtatacatttaacatgtgcagttttattgcacgttaaagatactttaataaagctattaagaaaaagaaataaaaacgtttgctttcatatcctcaggtcatcatggattcggatcctagttctcttgtgtgaacatcttcctcattttccccatatgaaaaatagtggatttaatatatgccttatcacatcagtttgtggattaggagacactgtatgtatgaaacaccacagtcaataattggtaggaatctccttacccttcttcccttggtatgtagcaacttcatgaatgaaaacactttccccaaataggtatctcacagagaagaaaacactatgaattcatgacccatttgcatagttttaggggttaaaagagctgtatataaattgtaaaacatattaagaaatttagagaaataatctaagggttatcaaagaatgttcaaattccctcagattttgtttttcaccttatctaaattcatattttcatccctattttaagcagaattattcatagttatctacttagcagatgttcaaggatgatattctctttgtatccatctttccttatccagaggcgtaaaggaaaagcatgaagataagggacacggcatcgttaagtatcccgggtttgttaacagtagaagagagtgtggacttgcttttcactttcattgtgtgtgtttctaggagatcctctatcttcatgctcagcccccaggtccatgtgtccttctctctaataggactgtgctatgatagctgttggtgggagagaggtcttgcaacctaaaaggaaggagagccatatgcagaagagagaagtgattagatgataaagctgaatggtgactctgaaaaacaaagtaactgtaaatttgtggaacttttggtctttcttctcatttgatgattagaaattttttagctgtccaaatccagtccttgtcttatctcagctatgcagagtggcatggctggttcaagctttcagtgaagaaacagatgtatgaggccaaatcttgcaaaatgccagaagagtgtatttgggcagaataccaaaatgagttcgggggcctatatggaactgcgggcagggccaatgacagatagttgaggactgcaatgagagatgcccaaatataagtatgacaagcaggaatgtcattctgtgagtcagagtcaaagtcaaaaagactttgtaaaaatctactttggagactaggtgtgggtgtctgatttagaacccttctcatagtctggtgatttctaatggtgcttttgccgaaggaattcttaggagcatccaagttccatcttaaagacatggctttgccagtctgttgtgggtgtgctataccatatcagacagagaaataaggatgtgtgtgaaggtatgaatctccggttgacgaactctagtgtgcaaataagacaactgtctgtcttttaacatggtacgcacatttctgttttgatcaccctttctaccagttggtgaaaactttagcaaagtccattcattgtctccataatcccctaggtttctatctaattttcattgagcttacaaggcacatggcaggtgggaggcactctggcatccactgagatgttagtgaacccatctggtcttcatttgtttccttccaagctcaagggtgattgagtttgccagccttctctccactgttttagtcttttcccaaagcatataaggactcttctcttgcttccttgctgaactgggcttggagatgcagctcagagagaagacatgcccttgtcccttcataataaaccatcaacatgtccctttttacatgtctgctatttgtctcctcttctttccagcccagggagtctttatctagataataggtcgagtaacctggaccacagtccattcttccctgtctaccattgaaggtacaaaacgtataccagacacctttaagatttagaatttgaaatacaagaatgtgggttcttacaaaacaaaacttggaattttaaagttaatttttgttattcttgagctctctgttttttgttttgttttgttttgtttttgtaacattatctctctcctgaggcaattaaacagaaaaggagtaatgagcagagtgaaagttaaggaaaggtcttatttaattcctgcccaaactttcagactgcctgatgggaaccccagttgaataatggtgggatttttgttgttgttgttgttgttaagcaaagatgatttccaagctctgcagggcagggagagctggagagttcacatgtttgtatttgaactcacatgaaacaatgaagagtgaaatacagtcctgtttctctagcagtgaaatttcagatccacagagaaacaaggctttcattctaccataaagaaggacaaaacataactgagaaatacagtgtaaaaggaggaatttgcaaagaataatatgctctagcatattccagcaaggagtgatcagatgtgggcatagcagtcatcattggggtgaaatccaagacaactatgggtagcaaaggaagcagctatctttgagaaagtaagactgataaggttttcagtccaaatgacaagtaacttctagtttctaagtataagcttttgcagttgggatcatgcctttttttttttttttcttaagaaaaaacttaaattgcttttactgacaacagacattgccagatttatccacacaaccagtgttccaaatgtcatataaaaatgcaatgcagcaattggccagattgttaagtaacgtgctataattgtttttatttgttttaatccctgtgaacaaacattttattttttgtccaaaagacaaaaaggagttgaaattttatcgttgtttttccaggcaaaagaaaatagggtatttgttgactgaagaaatgagatatttctctttggcagtttgggcggcctaattgataggaagaggtctggtagctgagaatagcagggttagaacaatagaggattccaagatcaaggggaagggtcagaggttcacaattcccaactggagtgggtgagtgggagagaactttacaaaagaaataagagcaaaaccatctgggtaaaaatgacaccatgtcttgatctctgggctaaggacccctggaagtgcaaccatttacactcgctcttgaaaatgcctcattgtgggttcagggataataacccttaagctaaagcctttatgagttggaagaagagaaaatgtgcttcctgtttcttacagaggatgaaagaagcagttaattcccaaatccagcctccaaacaccacaatggagcattttatatgtggaggaaaattgctaaaggttatttacaattagatccataaaaataattactggggacttttaacaaactttatttaggctcttccatacttaagacacaattctcaagaatatcttgggtaattttcaaactgttcttttccttaaaacgatcaaagggaattggttattatccaaggtcaacttattaacgagagacagaatattccccaattacagtatttctccagcgcagttcttactgagctctaggcaaggggcaaaatggggaggagagagtgtagtcagaagtcccagggtcttacttgggtctccagctaactagctcagtgagcctgggcaacacccctgacctgtctgcatatgtttccttgtttgcaaaatgaaatgagaggggataattctaaaaatcctttctttgtgctcttcctaattttttttagaactgctaaatcattgcacgcatgaaatgatttgcttttgttctctttgaaataatggagctcattgtctaggatctccagcttctatttctgtgaagcaagatctaacagcctttgatacctctctgtctactttctagggaattacagatataatttgtggagacacttagtcaaaaattgtcactgaatgccttatgcttttccacaatgctttcagagctgaatccttataggaggcaagtcagagatgaaataagaaggactgacaggaaggagaggtgtaaacagagctcgtgaacacacatgaaaaggcaagtgataggtacacaaggacatcaccaagaagaaggctctttttctgcccttgcagtataaaaatagttatttattttttcataagatgatgttggaaaagtttcaaaggaaaggcttctagtgtttgatgagcacctgctgtgtaacgggcacaggttaggcaattttatacaagataaagatgtttgtacccacttaatggataagaaaattgaggcacaaaggggttaagcagtcttcccaaacttacccagttattcattttaactgctgtgtcatgttcctggtgtgagtctgccaaaaattaattcatttaacctttttactattgtttttcatgattacaagcgtttctgtagtgagcatccttatacctgccctcatgtttacacataagagtatattttttaggtaggtgcaataaactaagcatgtatctgtagatatgtgtatatgtatgggtatatatacacgttatatatatgattgtgaacatgcatatacatatgtatgaatacatatgtgtttgtatatcagtgtatgtatctacatatatgtatttttctaagatcctgccaaattatcattgcaaagtggctctgtaaaatttcactcctccccaacattgaatgaaaatatctgtttcctcatactgtcaccagtgtttcgtgtcaccatattttaaacatttgccaagctattattacattattttttcatgttcatttcttcaatcacaagtgagtttgaccacctctcaagttatttacgtccaaaaaaaaaaaatcactgtaaatgaaaaatgagtagtttagccttgccctgtgctgtgcagaaagccggtgagtttcttcctgaagaggatgctgcagggtcatttgacttggagaggagggagtggtaagatcacattatcattaagaattcgctcagggcatgtaaagatggctgagcagcttctttaagcgtgtaagtgatgacgctcaaatctatcagaatactaaccctgaaatcaggtctgagtttacagccattatatctttctttggatttggttttatgtttttacccttgatttatgtacgtacttcccttagcatcccatatctcaagcaacataaaggtattaaagtgatgggatttagcaaatatgttatggttaccatctttgttcccaagagggaatttggaaatctgacaagtattatacctttcattttcaagacccgttttctgagccgtttcgctaacaagtcccctgatttaccatgccattaacaaaaataattctttctggacagcagtaaaagaagtggattagaacaatttacagccttctcaagatacatataaggtgcctgttaagaaaaaaaaagggacagatttttgattaactgatacgtagacttgcttttaaaacatgtcagttcattctctgtatgcccatctattaagggcaatgtccctcatggaggaagcctgccatcgcccggtgccttagcacgctctcatgtttgccaacagtgattaggaattacttagttgctgacaaccctccatcattgatcgaagtaagaaaccttttctgcttcaaggtaaggacatggtgcctactttctaaatgagatgttatccagagacaacattttgaatctgtaggcaaaaacgtatccagttcaacaaaagaataacctgcaataagcagagatagaatgggtgaggacctaggacagcggctcattaggcagaacccgtcctttctctttgctaaagttagggaggaaacaaatgcctgccgaacagaaggaggagatgagaggatctgtcagccagggagaggtacagctaccagaaaagcactggacagtttcctctaatccttgggaactttaatcgtctcctcaataattctcattttgagaggatctcaaagtggagggatccattagtaagttccactttggcctggaatgagagatgccgaaaatgacaagggtgcttttctgtggtggtgtaagtagcgtggccgtggatgtgggcaattggcttactccagtctgtggcattagttagcatctctgaaaccctgagacatgattctcagcccccatggctggtcaagggattaccagagaagattttcaagtacatgggattggggggtgctcccaacccttcagtcagctgtgggttttgcgtgtgaagagcataagaggggagagagaggaaatgagagaagctggaccatgcagagccttgtaggtgatgggaaggattttgctttcatcctaagaagagtgagaagccattaataggattcggggtgattgtgagtcagggggaaatggggggaggtatcaggacatggaggtctttgcaattattagttggagaacagcaatggttcttagctgcttcgtgtgccctggacccttctctcagtctgctgaagcctgggcagtccatctcagatcctgttcaggtgcatagattaaaatattttaaattacgatataagctacttatgctataccatatttatactatatcattgtggtaataaagaatttgtcatagattaatagacaggcataggtgtcctggaactggttctgtcttaccagcttgtcaaagctgattacgcgaatttctttccaaattcttactcagtgatgccaaattggtagcttgaaatcaagccacggtgagagaatttatatcatagaatatggaaaacattacagatcaggacttttcttctcaaaagtcagctgttaaacattgaccatcatagcactgtgtatatacttatgtatttaataataggctttggtggcaggtttagtaactattgcaattttgaagtagtgatgagtatgaatcccatttcaggatatttcccacaattgaaatgtgatataataacttttttcctataactggtgacaaacacaggttctgctaatactattgtgatttgttatctacattcatagttgaagaacctgcttaattttcgttagagggtaatgaaaataagggtgcatttttccattgaaagagcctctgaactacagtgtccagaaaatgagaaaaaagagggaccatagagaccaactagaaggtgatagcagtattccaaatgagttgccatggtgtcttgtattccagtgaggagatggaaaggtgtatatggaattggaaatggttagtagataaactctatgacaattgggtatgtatagacattggggtgaaggaagtgtcaggagtgacttatagggttatggcttacaccactcaacttaataaggatgagaatgccagaagggcccaggtttagggaagatgaccatgagtttggttagggcctgttgagtttgaagtgccttttgagtatcatggaaatattaaaaagatattgggacacatgcatttggaatagagacatgagtaggttctaccttcagccttggggtgggaccaggttacgaagggatgttattctttgatggatgagcagactacaaaaagctgtgccaccctttgtctctatgtattcacactgcttcccctagcacctcttctttatctcctaacaatcattgtgccaacagactgcctttagaaactggcagatggcccctcttcgaaggatcctgtgcatacagagtaactactttcccagtagctgcatggctatcttgctggatctgcaggtccagaggaggggctgggacagtagaggagcactaggaagtcattaggatatttgcaataattgaagcttgcatcctatttgaaacttccccaaagaaaaaaatgagcgagaagagtggtcagcaggaagccttgaggagttccaaaatcagtggccagcagaggtggaggagcctaaaaatgagactttggagggagcagccacaaagataggagaaaagccaggtgaggtggtggaggtgcagggaagacaagcagagagggtgcttcagtgagaagagaggagaggagtgaaactcaaagtcgcaagagaacactggaagttcttccctgcatctagtgacacggagggtgttaattttacacaggctgtgttggtggaggaaaccagatgggaggggaagaaatggagataacagttatagacacatcttttaagaagtttggcggctaaaaaggagacagatagtgaagtagttggaggtggatgtagagaaaacaaagttttttttttctttcttttttatttcctttccttctcttccttcctttttccttccttccttcctcccttccttcctcccttctttcctcccttctttcctgtaggagatactttctcataaggattcatttgagacagagagggtaggagagaagggatttatgatggcataaagcttctgagaaggtgggaaaggctagacttcaaaacataagagggacctgttaactttttaaacctgggagttgaatcaatgaaaaactgagtcaatgatgtaacacttttaaaggtagttgtttattgccccccatcttagagaagagccttttctggttacagaagacaaagtgatttaatgtgtgctgaagtaagctggaaattcaggtgttcagttgatgtttttggagtagactgtgaaattgaaattggagagacattatccaggcaggaaaactatgagttaagggctctggacaataaaaaaaataagggtgtcatccttggggaaggagatgggagatgctgatgcgtttagggcttcagagctgcacctgtgctcctcttgggatcagaactgcagtatctctgcagctgctgcaccttgtttttaacccctgcatccaagagctgagtgttgcatgactctcaagatgcagatattaaaaccttattgactgatgtagactcttctgtgcatcaaagggctcagaagtggtattagctggctgtctccttttaagtgcagagagtgcttttctgtagatagtgctatgagctacctggggttaagataaaaggcttcaaaaaggtagtgtcttcccggaggctgcttgtggccactcgctgtgtgtctgtggctatacagaccccagattgctggggctggactttgcatgtctctctctattaccttctagagcctgtgaggcccaggcttttaaagattcggcactgaaagaaactaaaaccaaacttttgagtttacaactgcctgaggctgcctccatctacaggacctttactaactgtgccattttggcgaaaagatagattttgaagttcaatcagtcttggtttcaagtattagctattcctcagatgattgtgggaccttgaacaagtctcttgccctctctgagtcagttttatcatccatgcaatagggataatattacctacctcataaaaccattgtcgagacccatctattcagcacatacttgagttcctattcaaataccggctgctgtgcttggctgtggagtctaactgcacaaaatggtcttgaccctgagggttttatagtttgagagtggatataccaaagtgcctggctgtgattattatattgtgatataataataaatacatatttggtctctgcccccagttctaatatttagtctgtgaacccagttcctggcagacagcatctaagagctttgtaatttcctgagtgacgggaacatctgacacagagctccgaaatcccttggtatttcctggctgataggagcatcttttgctctaatgagttgacttgtgctgggctcctggatacccccaggatgggtgctggtttccaggggaatcaaccatgtatttttagaaggttggggctttcatcatccaccccacctccagggaggaaagggaggctgaagactgagttgatcaccaacggtcagtgagatactcaatcgtgcctatgtaacaaagcctccatgataaccccaaaggacaggggttaaagggcttccaggttgctgaacccatggaggtttctggagggtggtgtgcccacagagggcatggaagctctgcatacctttccacatacctttccctatgcatctcttggtgtgactgttcatctatactctttgtaatattctttataataaatgcgtaaatataagtaaagtgttttcctgagcacttctgtgagtcactgtagcaaattaatagaagtcaaagagggggttgtgggaactccaatttatagtgggtcagtcagaagcacaggccacaacctgggccttgtgactggcatctgaagtaggggacagtcttggaggacctgtgggatgtggctttatctccaggtagatattactgaattgaattgaatcagaggattacccgctggtgtccactgaagaatggcttgatgtattggggaaaaacccactcatacttggtgtcaaaactgttgagtggtgtgtgacagtaggtaaaacattttgtttttttttctatccttcatattggcccagagagcttatttaataaatatctcattcatttcttttttcttatccattataccgtaggctcagctgaaaacatcgttcatgacccacctgaatgcacagtagggtacttagaaagtactgcatggttagcagacagctctgtagggagtcggaacagccacgcagtagagtcttggaagcagaagagagtaaggcacagagaccccgaatgagggccgagtgtggacatccacatcacagctccacccatgactagtcacaggaacagagacagtcgacttgcctctcactctctgcctcagtttcctcacctgcatgatggagacgataatggtacacaattctaaggtggttgtgaggattacacgagctggtggtgttgcgattctgaggtggttgtgaggattacacgagctggtagtgtgtgtcaggtgctcagaacaatgcgtggaacatggaaaacactccctacatgggagatattatttccatgttcagaaacaagctggtttcattaaagcccactgctctcaaaaggcaattcccatgggaatagtgatgacttgaaattctgtatcaaaatgctggtggatgctgcttcgtttgtagtttcttttcttttccagtctccacagggctctgttatttggatcctctaccatgaagaacagtgcccctaatcgtagactatcactttgttggccactgtgtgttgtccacccattatactgtgaggtctcaacagctttaatttcaataatttgaggtttgttcaatgcattatattccagatagttcacggatgcttttaatttaattataggcactttaacaccacagatgactgttggggaaacggaaaatgtcattctttctgaatgcaagacacgtgtttaggactgataaaatacataactgtgttttatttcagaataaaaagaaatgtattaccaagtatgtgacagtaggtagactgctgggaagcctgggtctgatacattgttgtcagaaacaggctcaattttggtgaagcgaagggtgtacggaggatgagccttgcaaacaagctaaggtgcccaaaggacagctcccccagtgacctcagggtcagcctctctcttacgtacatacaaggagcccctcctggaagcaaaccccactgcagccttccaacaggcacatccttgttcttcccactatcttattatttgtagcagcaattattcattgccatctgaattcactcagtaaatatttattgagtaccctgtatgtgtaggtagtggtgatacagcagtggacacacagacaaaaatccctactctgaaggagcttatattccggggggaaaaagagaggaaaataagtaaaatgtgtgctggttttgtgcatgaagatggcaaaggctatggagaaatcaaggaggatagagttggggaggaacagttgtaacttccatagtgtgggtggagaaggcctcactgaggcatcaacatttgagctaagtcttgaaagaggcaaaggaatgaaagaggtgccaggccaaggtaatagttcctataaaaatcctgagaatggagagtgcctggtgtgtctgaggaagcccaaggaggtcatcatggagtgagggggagataatagaagatgaacttcaaaaacgaagatgtgaaaaattgcattgatccttgtagtccatttggaagggtttagatgttttatcatcaccgtcgtcaccatcatcactaccacctgctagaaacttcggggggcggggggtgggggggaatgactcatcatctcatctctgcactcctgaagctccaactcagcacaggatacaacgaaaggataatgtgatgcttggtaccaagactttaaggacattcaggagcggacagaaaacatgacctaaaagagagggaaaaacagagactttttacagggtctcccttaggaaagggagctatcccttaggaggagatatctaagccactatgcagttgtgaggtctttagaaatcaaccaagtgcattggtcagattgaggctaagttttccaacacagagaaccctgaagtcccattctgtactttgtcttgactctcctttcatttctctttatcactcttcgccccccactgcaggtacctgttcctttttctgaccatgtctctggacttggagaaggttttctctcataagcttctatccagccctacacccagtggccatacaggtccacccctctgtatggctctgtgcattaatgagcagctcttcttagctcagcgtgctcactgtctttaggaatggtttctgctgaatccattgactgcacaataagcccagtggaatgtgtactctaggccccagttacctccaaggagaagggatgataaatataacagtgacaaaatactctcatacacacagaaatatatagttacacttaaatgcacacacatatatacatacaaatatagagtgggtgcagtggctcacacctgtaactccagcactttgggaggccgaggtgggtggatcacctgaggtcaggagttcaagaccagcctggccaaaatgatgaaaccctgtctttgctaaaaatacaaaaaaacagccaggtgtggtggtgcacacctgtagtcccagctactcaggaggctgaggtgggagaatcacttgaactcaggaggcagaggttgctgtaagccacagtcacaccactgcacttcagcctgggccacagagtgagactccatctcaaaaaatcaaatgaaaaaccacatatagttatatataaaagcatgcacgcatgcatgaatatacctatacatatacatctatgtttacatacaaatgcatgcatacatgcacatatgcacacacctataattataaatgcatgtatatatatatatgtatgtatacacacatacatttttatagaaatgcataggtatacacatgtatagagttgtagatgtatgcacatatttgcatgcatacatacatgactatacgcacaatgcacacatgtttatatatgaatgtattcactcatacatgtatggttgtgtgtgtgtgtgtgtgtgtgtgttttgggaagactaattactccaggagatttacatgtagtttcccttcttaagtagatcacaaccctgctctgcatttgctgccattgtttctgttacgtagatgaggaatttgagtctctaaaacttgaagttgcccggccaaggtcacgtagctagtaagttgtgaagctgatattcaaactaaggactaaaagataaaaaagaccactttcttccaatgcttaaaagatgttaacagaaagagagcaaagcaacaacaagaaagaaggaaccctaagtatgttcatcgagctactcacagaaaacagaaaatatgattacaacataaagtgataatttccataaaagaaaaagttacatgagcacatacaagagggaataacatttgaggaatctcttgaaggatgggtaggagttttttagaaaggggtggggaagcaaaaagattttgcttttcatttaaagttatgatagccaacatttaccttttagaggtgctcaaaaggcccactgtacctttggcttcatagctgtagaaatcgggcattttccaaaaaaaaggcagtgacggtgcctcacatctggccacaggcatctctcggcagcatgcaggtcatctagggcaagtctctgtaaaggcctttctctctggtgttgcatttgcgtattcatatgtctgcatacaaacaccaagtctgctgttagtggtgtcataactttgcaaaaggaagaaaacatggctaacggtaaaatgagttatgcctttataaaacattttcaatgacagaacttgctcccctctgagtgctttttgaggatcagtaatcataaactgtggctttgccaggaggtgctgtcgaagattgtgtggacattctttcagcaaaatcatctggcatgtgtgattgcttctatttattcaatactaaagaacagaagattgagttttatgagagagagaaaaatgcacattccacatagagattggataaatttcattgtttagagtgtttttattgccacaaagtaatcttctgattgctaggtgagtaatcctgtagttacaaaaacaatcaattaattgatctaaattaatcggataacatattttagcctgctaagcatgaaggcatatttcaagtaactttccagataaaggaggtattgaaccttttcagccaccagccagggacagtgacacagattctagtatcaaatgctgattctcaaattaacaaatgctggaattactatgagaaaggcatggactagggagtcatgaagtcctcccccttttgttatacaggaagcttctaagctgcctgtcccactgttcctccagctcttttgtcccaggcttggccctactgggaaggagacttccctaacttctgggctacccctccctttccctacctctagccacactgtgtttcagggagggcaacatgggagacagaggaaattaagacacctgcatgaaagttgacagagttacccaagaggagatgccactgggcagggactggagagcactcaagggaagggaggcaagtccgtcctttctcctcctttcttcttcaaaatgtattgaatgcctatgcttttccaggcagtttttaggcacttggaatacatcaatgaataaatacggcaaagatccctatgcttgtagaactgacattctagcagaagagacaactaatatataaataagtcacatagtattttagaaggtgatatatgcaatgggaatagaaaaagcagagccgaatgagggctagatggatgctgggatcctaggtggagcaactggctactgttaaaatttatctgagaagtggttccgagagacagcggcagcagtagaggagaacacagcagtcagacgagccaggagggttcctggctgttccctgcacatgtcattaatgtgaacactcaccagcatctcttagctccttcatctttaaaacagggataaggatatctgcaatgtggggaagtgggaatgattaaatatcattgatttgtttttactgctcctctttaaaatgacagcatcaccacaaaggagatgaaatagtcaatagtgaatggaaagcaccaagcacagagactggcacacaatgggtactgagtacacgtttacgttggtactcataaaagaccaggaagagcttatatgtggtgccctggtaatgcctcagatactgttctaaatgcttcatggatattagcacatttaatccttacaaccctttggggtaggaactaatttatgtccattttacaggtaatgaaactgaggcacagagaatttaagtaacctccccacagttttataattggttagtggtggaggcaggatttgaacacaggcatcctgcttctggaactgcactgcagttatttttagagcccaggctatggaaagaaaccattcatttattcacggaacacatttttattgattatctgctacatgacaggtctgtgatcagcactaaggctatagaaatgaaagacatagacagggttcctcccccaaaacattcttgatgtaaatgtgagactcacactataaccaccctaaggattttggtctgaaaagacattctttattaaggattatacatttatgtcctggatttcctagatctggccctgaaggtaaatattccattttcttattggagtataacaaccaacgtttgactgcaaaaaatgtggtagattattttcattcatatgaatatgcctgcccttttctctggtggagtctggcccggtaagtctgtgggacctgcctctaccaatgaggggtagagcttggtgacttttaacaatgatctcctcattagatgaggccatcagttacagcggaaatgatcattattggaaagctggagaccagctgctgtcagagagggatgggctcctgtggaagcttgcaaactgatgactacttaatccttgaacttcagcagcaacaacattagctgaaggtctgtaatgcattcacagttctcatctgacattttccccacatcattatttttctggttttacttttaaattccctataggaccattgacatgaaattctgagggggaatttggaacattaatgactgtttaaggcaaatgagtaagtgttctttccaagaggaaattgtctttataatattggcataaggctatttttaaaatttatactaatgagacgattcgaggcagataactgaatttcccaggcttgaagttggcctatgccccttggtgaattcagccttagggtgagctctgtggggccttgcaagtctggctctagatgcaagagatctgccctatccacattccttctttccataattggttagagccttgaccattcaaacctgggcttggatgttgggcttacaagtggcacagacagtcatggagcttgctgactacaagggaagaaagactttatcaaataacactacttatggatgtctcaactacaaacatgaatcaatgacttgaaagaaggagagtaatattccctgaccttaaacaataaaggactatgaccctgtttggggactggggatggtcattgagggctcccctaaaaataaatacttgctctgaacctcaaatgaagtgtaggatttagaaaggcaaggggccaggtgaaagaaaatggtttcaggaggagggaagaacaagggcttgaaggaatgtatggtccccttggaccatctatgcttcctaatcctggggattgcacctccagtgatataagaatgtgtggcaaagggaaccaggttcctcactgactttgttcccatccatagaaccaaaagggtcttccttagtaatgcctatggctattgggtattgagttcttactacaggatagaccctgctccaaggactttgtgtgaattaacttatttgacctcgacagacatttgcctcaccccactgaaacaagtgacattaacagcaatcaaaagattacccggggacacaaggctatgtaatacagcaatatatgcaatataaaaaaataaataaaacttgaatgcttccaaatgtctatcaaaagaacacaggttgaataaacaatggaatgtctacacaaatgagtactgtggagctctaaaagggaatgaggaatagggctataggctatttgggataatgttcggatatatttttaaggtagaaaaagtaagatggagaaaattgtgtgttatattactgcctgtctttgaggggatgcacattcacatacaaatttacttttttaaaaaataaaagttaggttaaatcatttttttaaaaaaatagttactgttccagttatcttttttctttgtataaacagggtctcattctgtcactcaggctggagtgcagtggtgcgatcaaagctcactgtagccttcaccttctgctcaagagatcctcctgccttagccttctgaatagctgagactacaggtgtgcaccgccacacctggctaatttttaatttttctgtagaaattgggtctccctgtgttacccaggttagtcttgaacttctgggctcaagccatcctcccaccttggcctcccaaagtgctgagattataggcataagccaccatgcccagtctatctacttattttgaagcaaattagtgccttaaaatgtcaacaccattttattatcgtctctcacagtgtagggattgtctgggctccgctaggtggatctcagggtttctgatgggcttgcagtcagtggccgaggctggagtcatctggaagtgcgctcgctcatagacctgggtgtggaacagagagacaaacctctgagggttgaggctggaactgctaaggctgccttgacatctctctatggtctctgcagcaccaaggcttacaggtagctgtatgttttacaagttggcctgaggctccaaagatgcctattccaagagagaggctggacaagctgtactaccttttatgacttagtgtcagaaggcacacagtgtcacctttgccacatttctttttttcttggcagataataaggcccacccaggttcaagaaaagtggggcagcaggggaaggggatggactttacctcctagtgagaagatgataaggtctggaagaggaggtatggcaaaaaatattgctgtggccgttactagaatatataatctgacgcagttacctaaagtgaaaagcgtgaaataaaggctgaagagatagggaaaaaaagtacatttaaaaaaaaagttgtttcatgaatttgaaaacaaaatgaaataaaaagcctattctaaaattcaaaagtcagagaaacaattgaacctaagtgtgtactcaagatgctggcataaccacttgataggaactacccctagttattttaaaacgcagttatttgactctgtccattaaagacaattgaaaaccaaaaaccaaaacaactgcaaagggaaatcttaaagtattttcaataatactgcttttggaggtagtgttggtatatttattgttatataaaatatagtataatattgtgtgtattgaaagataaatgtatatgttaatttggagaactagaatattgaagtatgggaggaagaagatgcagatataagaccagcgagattaatttaaaatgctagagaattggaagtgggattatacatatgaatttattaggtgttttatcttagaaattcatgtattctctttctactaaaaagccctagaaacagtgaccaacccaatagcaataaacttccttagcaaatagattatggtcactagtgatcattttctagcaaaagaaaccaagctgtcttgagaaaatgattgagtttatatttgaggcaggaaataaacaagaagaatctgtaaaatcttgtcataccaagaagcagagaggctatgagatgtcattagggtcatgtcatttaaagaagccagtatgagtagctcaaagatgagataatttgagcctcaaaacaaaataagtgatttcaatggatttaaatacactaaatctgtttaaatacataagttcataatgataggggaaaacaaaattatttataggttaccttacaaagatgatagaaaccatctcattattttagaaacggaaaggaaaaaaaaacataaacaactatcctgcctttgttttcagaattccttgtagaaataattaactagtggatgaagagagtttctctttctaggtaataagcaacgaaaaaatggcagaattagaatataatgaatttgcagttcttactaaattaatatatctaggcagtaaccatcaataaaaagaaagaccatatgacatttgtatgtcctgaagtaagttcacaacgccatctagtcttgagccaaaaatactgcacctgaatctgatccagcctccaggatgtatctatttataggaaacacagtggacaggcgaacatgttaaatgacaccacagagatgcaatctgcgaacttccactgtggaaacaatccaaatgattcaacacgatgttgcaaagacaaaagaattatacatgaacaggaggctggatgaattaaaaaacataagagatgtatcaatcataatctttggttctaatttggattctgatttaaaaatagactgcaaaaaaatttgttagaataatatgaacaaagactagatgtttgctgccatttagaaattctcattagtatttgttcagttatgataatgcatgctgcttctgttaaaaaaatacttttaatcttttacagataccttctaaatatttatagatgaaatcatatgatatctagaattttctttaagacaatctgtggaaggggtgagtggatgtgtgctcaggtgagctaatggtagccatgagtttaatattgaggttgagcgatggatacagagaagttcatcatacgaatctctccactttgatgttttcttgaactctccaatactaaaaatttagccaaaaaaattaacaggggcaacgaactttcttctttttccaagggctttttatcgatgattttaagaaaatggtcagacagcgcaggcgtgttttaccttagtccttccaaagcagtaaggtgcacccacttctcagccaccctccctgactttgttttcacaacccgaattcaccaggaaaataccaggagtctgctttgtattgtgccatcttttaaataatgcctcactttctagtagcaaagtacctcattctttttcttgatacttcaaaaaaacaaaatgaaacaagaacttctcattagctgaaagtgtttttatctagtgagaactgaaatcttcttggcttatttcctcttagatctaaacaatattaacttttttttttttttttttcccaaacagagtctccctctgttgccccggctggagtgactgcagtggcacgatcttggctcactgcaacctccacctcctgggttcagggaattctcctgcctcagcctcccaaatagctgggattacaagcatgcaccaccatgcccggctaattttttgtgttattagtagagatggggtttcaccatgttggccaggatggtctcaatttcctgagctcaggtgatccacctgcctcagcctcccacagtgcgaggattacaggcgcaagccactgtgcccagccttaacaatttttttttgtttgtttttgaggcaaactctgactctgacaccaggctggagtgcagtggtgcgatcttggctcactgcaacctctgcctcctgggttcaagtgattcccctgcctcaccctcccaagtagctgggactacacacgcaccccaccacaccgagctaattttttgtatttttttagtagagtcggggtttcaccatgttggccaggatggtcttgatctcctgacctcatgatctgcccacctcagcctcccaaagtgctggaattacaggcttgagccaccgcgtctggcccaacaaatatttttaagatgcattgtctactaacaggagatgcctctgattctgaagtactttgcgataaacagccacacaatagccaaatgaaatcttgaaatcagagggttgctttctcatgaagttagactgcttgagaattgcagtggcttctatatggcaggtgcttaaattgtccaagttgaaattctaatttttataatgagtagggatgagtgcatgaaatggttgtgtgtttttttatttcctacatacaatatcgaattcaatcccaaacttgaagcattgatgtaattgaaacatgttggtaattttaaatcgtgcagttctgtacatgatcagaatcctaatcattattaaaataggtgtttctattatatgcatatgtataaaaagtcctccaaaatgttaaattacctttctcatctcaggaatagagtcccaatcacttccagattgaagcacttacggggggaaaaggcgaagggctccagtaattttaaattgcttcgtacaatgaagagtgcctgtaaattactgaatgtggtaatttgttccataagcttttttgatttgtaagtaacttagtggatttgctggtgaaacagtttggcaggttcctcagataatttagagatattgagcatagacatctaaatgtgattaaaatgtggtattagcagacattgaccacaggaagggtgaggcaggttttcaagttacagcagctagagaagctgagaaagactacagtcgactctcaggggacttgggaaaggtactaagaatgcacaattgagctaattacaggaaaatgccacacggctggctttggaagaattcatccagcccctggcatgttttgcttatcctctgcctgatgataaaataggggttatttctatcagtggacacatttggcccatatcttaattcaggcaacacagccttagccttgttctgctagtgctaattatttttttgaaaaataatactgttaatatagtaaaatgtagttgttggactcttagaaatggataaagtttaggtttgtaatttcccagacagagagagagtggcataagcatcgtgtgaattcccttctaataggatgtcttcatctttactattttgcataataatgtattgtttggccataagagggatttaggtactggatctagaggcattgggtgtctttaaggtatgaaggggtcaagcaaatgtctgccactcacagagtgagggaggtggagccagaggttctgaacaaagaacctcaccaaatgatggggagaggctgtgatgcatttcatgaggcagtgatgatgtgagtcttgggctctgtaagtgagggtgcatagaagagtaggtcccgccctttttaggagtatactgtggactagagtcaatctgtagacaaagctaggctaacttcctactgggcaacgtctgacccctttcatctttgacctcaagaaagtcactattgttggtaaagtgaggaaggacatggaacctctggggagaatctgacctaaaatggcttcataaagattctcagcatgaatgcccttttttacttgatgaaaatagacctgatagtggttgggttatttgagcagaacaataatggtaaagggaaaatagtagtgagatttatggtgtaggatggtcagatgtggtatgagtatgacacggagccagaagtgcctggtcattcactgatttgtcacactaatggagttagaatactctaccttgcaaggcagagtaggagtagagtatccagtcatcctggtttgcccaattctgtcccacttttgacacagagagtctcacactccgggaaacctctcagttctagacaaacagagacagttggtcatcctattatgagaggttagagaggaagcactttctggatgggttgagtctgataggctctgttgtatttgattagacagctttctatgagatcaaggttttcaataccatcacagaaccatttctggagctgtgttgaggaagagagggcaagggttagagaaaagcttgggccgcagcattgcctctgccatgaagactctttacgtctgtttcacacacagtcagcccttcgtatccacaggctccacatctgcggattcaatgaactatggatcaaaagtatcctctggccgagtgtggtggctcacgcctgtaatcccaagactttgggaggccaaggcaaacagatgacttgaggccaggagttcaatactagcctggccaacatagtgaaaccccaattcactaaaaatagaaacctcagctaggagtgttggcgggcacctgtaatcccacctaatcccagctactcaggtggctgaggcatgagaattgcttgatcccgggaggcagaggttgcagtgagatcacaccactgcactccagcctgggcaacagaatgagggcctgtctaaaataaaaataaaaatagatgtgtttgtgtgtgtgtgtgtgtgtatatatatatatgtatacacaaacatatatatatacatatatacacacacacattcaaagaaaaaataatacaaataaaaatacagtacaactattttcatagcatttacattctattaggtattatataagtaatctagaaataatttaaagtatacaggaggatatgtatagattatatgcgaatactatgccattttacatagggtattttggtatttgagaaaaatcctggaatcagtccctcacagataccaagggacaattgtgctaaccttttagataaagtttcatagaccagagacttccacagtgaacacaagattagataccttaggctagagcgatgggttttagaaaaaaggtggacacatggaattcatggatatgaaacaatacattgtccagaagtaagggtggtccatggagactggttggagtggggtgggagaaccttttcttcatcagagtcaagtcattctgggttggcaatatatatacatgagtggactggagagactgaggaggcacaagtcgaggaggaacacatcttttattttgacttaattttctttttatcccctctccttctaccccagggttcttctccgtgtggatcacattaagggagcgtataacctttcataccgcctgactaggatgatggatgtggaaatacacagtttgggagccctgtctgcttgcctgttaagccattgactgttatatactcttgggcttgaaacaccttccaggctggaggggccagtattgcatttacttttatcccatttctgttttcacggctacccaagaggaaataatttgatttggggctgcagggggtagggtggaaaagtgcagtcggaagacagagaaaatcagcaagaagattactgaaagggaaagagggggaaaccaaccagctatatatttcctgcaacatgagttaatgaaattccgttccttcttacacagctgtattcggtttgttttacattgtttggtatgtgaaaggatttggctttgcgttacagaactaattgcttactagatattacatggatatcaaaatactttataaatattaattaatcttcacctaattccctggcaagcacaaataaccagtggcatatttattgaatgtgtaagcaataatctgattcttaaagatttgttttctctgctgaagctttctcatcatttccatttgtcaaaatgcctcatctcctttgaggaccatatcagatggtacttccataacaattgttaggaaaatagtaataaagacgatgtttagagtaaccaacattattatttgctgaactttcttcctttgccaagctcttgagtaaacatttcatagatatatctcatttaatcctacagcagtcctacaataaaaatgttattgttactacttttttttcccccagatgagggagcaaagtttttgaaagctgaatggtggcagggctgggatccatagcccattctgtccacgtgtgaaacttataataaaagccactatcttgccccttttctgattcacactacagggaggacacttggtacttatcaataactccattcatttatctattcaaaaatatgtgtttgaatgcaagtactattagaggtactgtgctaggctctgttatgacatacctggtgttgactcttgagtagggattacagagttgagcatcttttctctcctgagattcatcatggtccccatgggcagtgaacagtgttgttgtcacactatgaaatgggtatagtgcctggcacaatgaccatttcttgaacaaatggggagtgatacagtgaaagtaaaaagaggatctacagtgtcgtttgcttgtgaatggtgaggggtgggagcgcttagaagatgtaaggatgtgctctcttctttcctcacactcatcttatttgtaatgacattaatttgtgttcttacctgctcagtgtcttctcagtttgacatgccatgatggcatggactatgtctgtttcttctagcgcttcatagctgtattgacacatgtttgttgaatagaccaataccttgttttatgcataaaagaaggccagtaaaaatagtcttacatgcatattaccatgaccgtgaaaataatcccaccctgggcatagcctggctcttgtttgaaatgtgtggtacttctatgtgacaagatatagaataagtcattggaagaaaaactgtcctattactatattttatataaaagtgtatcttgtgttataatgggcctggtatacagagggtgcttagcaaatcttccgcagagctgaaactgagctgaagctacggcccccttctctgcttgctctcctttattctctagagtgctgcttcccaatgcgtggtccatggaccaagcagcttcagcatcacctgagcacttgtcagaaatgcagcacctaggcgccgcaccagacctgttgaataggaatctacattttcacaagattccagatgatttgcatacacagtggcatttgagaagcattaatccaggggcttctttgcagtcagtgatggtgatttgccaatcattagcatttcagaaaccccaggccgaaaccatacatttatccttagctaggtcggtatcaagtttctctgctttcatccagaatcctaacaattcagcttggttgattatctaagaagcttctatttgataattatatatctttcattttttttaaagtgctgggggttgggagatcctgggaaatggcataactattgcttaataaatgcagtttgcttggaagaccaaaatctttcaagtaatgagaagcagcaaaggaaacaactccaacaatgacacaaagatttcctgacaataaaggggctgaggtgaggaccccagctgtggaccacactacccgaagagaaccaacaaccaaatcaatatccaaaaaataacaataacgtccaggtcatttcacttatgagacagaagaggtaaaacaaattctcagatacaaatatttctgctgctccacattgttccatggggccaggattgtgaagtcaatcttcctaatgattaatggaatttctcaccttttgttcaaatgacttggcccctttggtttttaaatgacatctaagggcaaaacagacccaagactttgtggaatgactttccaggaaacaaccatatctaggtaaacccatgctcacaggttccctctgttaatggtgaaattacatcaaggatgaccttttgaaagaataaaactcattatcacatggaatatgatagctgtaaaagagcaacgcttggaagccaaagcaaagtcccgcatatgataaattaattagaatagaagttacataaaacctcgaccttctgtgtgacccttatcttataattacctcttctttaaaagcagaatgaaatattttatgtatgaagatgttactgttgaccctaaatgcattaagagtcaaggagacatttttcacgtattgaaaataagatttgattgagtgcttgcaagtggcctagtgaaatctcattaaaccactgtttaatactttataaatggcagaatattaaccattaattatgaacatgaaaccagtttgaaaataagttttgcaatatctaagcttgattttcaacccttattaatgcattgtctttttcatagttttcagtgttttacagcaagtaggtacttacgacttaggtgtgacttttcatctcttcttcctcctcctccttctctccttcctccttctcatcctccttattgtgttgctctaccaacatggttgtaaaaatctggatgaaaataagaaaatacagtctattaaacatagttataggctgtcactatccacagttataattagatttataaatcatgtgcaagattcccagcaaaaaaaaaaaaatgaatcttaaacattcttttcaactattatcaccccaaaatgaaacaaaacaaaatatagcaacgatatgaaattgtttcagtaacattgccatgttacagtaagcttttgcatctggatcagtcagcctggtacaaataactgtatattctgaaatgtaaatagataaaaagataatgaccttcttgagcatctactgggtgacaatcgttgaaatagtatctgaatttaactgcaccaaggaacataggcagattttgattcagatgacagcttccattatttggcagcagatgcttaagaggctgctttgggaggattctgatgttggatccagcctacatcatagaactgcagccatggattagcaatatgtgttatgtgagtgagctgcaaaaatatgccacaaaattcccatcttacagttatacctttttaccctgaaatgagtcagtgtgttatggtaacattcccagatggcagacagaaggagagccaatgtgagagaccagtgaactcagacccgtctcccaagagccttgtgtaagtcatctaaaaaacaaatgtttcggatattcagggttttctgatttcaaatgtgttcataccatgaataattgtgtagcactatcttactgtgtgctgaggacattaatgtgcttcttctttcatccttcgaatgatcctgcaaaataattctcactgacattttcgtggaggtatccaacttcagctcttatggaaaagaaagtgcctctgtggaagttgcatagatagtaaattgtggcgtggggactcaaagccaggtttgcttgacttcacagtctaaattcaacccaggaacccaacagcctgttgctgtgtgattctgatccccatgaattcactatgttgtcaaatgctgagtttgcaaagcatggtctgagtgcttcccttctggacctcccttaaccattccagggctttccattgcttgtgcagttaatgaagatggaaaatgattcccttccctcccgctctgttcttccatctgtccaggtaatagcctaatgtcaacctagtgacttcatggcatctgttttcaatctactgcctccttgtctggaattctcaggggacacttaagccagaactggggttgaaggaagccctggctctgtgcaagtccacagtacagcagctactggggagggaaaacggtgtgtggctacgctgagggtttcttcctggttgatgcgattataatgtgaaaagatcgacatgtgagcccagagcagatgcataataatgctactgcattttgtatttaacaaaacccctttctcgagaaatgtattacttaccttgtgggtggggaattgtctctgaacccaatcaggttagtcactggcccatgactatctcatttttaataaataataattttctcaattcagcgctagccagctcatctgctttcaaaagataagatatgattgctttgtattttttatattaataaccctcagcatgagaggattaactcttgatgcactaaaggcaaactaccggaccctgggagatccatttcttctcaccagataggctgacacatctttcagatgaatttaaaggtcaacgccttgtgcatgaaaagcaggggcctgcattagatggctgagctctagtcaattcttggtcatttgtactgaaacagaggcaagagagagatttcaaaaccaccacgaggaggcccctaaacatgcaggcatttctttcctttatctgtcgattcaaagagcatctattcagggccaagaaggagatcaggtttatctgacttagtcatacagccataagaaagtttccccctctaaaaaaaagaaaagagaaaaaataaagaggtgccttccattggtgaagcgtagtcattcagaacacaagctttgcagccacccacagcccacagcccacagcccacagccactgtgggtcgagttatactttgcctcttagcagctgaccagctttgggtctgagcctgtttcttcacagtggtcagcccccttgtctgcctgataaatgtctgtctgctcacgcacttggctccgcagaagtgagcttgctgggtccatggggatattcactggagattttgcacaatattatgctctggaaaggggtctgcaaactctgatctgagggccaaatccagcctgccacttgtgtgtggacaactagcaagctaaaatggtttttacatttttaagtggttgcatcttaaatgcttatataatggctacataaaatccttaattttgcctcttggcccacaaaacctaacatatttactactggctctttaagaaaatgtttgctcaggcctgctctggagtcctcaaagccacatatataattttaaattttctgatagctctgctaaaagaagtaaaaagaaacaggtgacgttaattgtagtgtgttttctttaacccaatatattcaagtagtatccctgcaacgtgtaggtaatatagaaattgcgaatgaaatattttacattcttttttcataccacgtctttaaaatccagtgtgcattttgcacttaacagcacctcttaatttggactcaccacatttcaggggtttaacaggcacatgtgaccggtggctgccgcattggacagtggcagctctagagagctggaaccaatttatgctccttctgacattcacagggaatgctccgtataaatcttggtctcttcttcctttttaaggtcacatagcacctggatttaaactccaaagctaccccaattttagctggagggaccatattccaagctgcaaatattgtacccacccagcaaatttcctgggatgtgcttcctggggaaagtgaattcagttgctgtagcccttgatttgataaaatgctcctctttctggccttacccttgctcaatcatttccaattccgctgctggttatttaacacgccaggggcagtaggtgcatacagtcctatgctcccagcttatgaggaaatgctctgtccctccacaggcttgatcagcggcctccctgctcctgttctctagatagaagtttccctagttttgctggtctcaactcatgcacaggaggaagccagaagtgccctgctgtgatgatcaatccatatgcatgtttgcctccagcaaaccaaggacatttaattcttggccagagtctcatcagctccatcagtctatgacaataaaatgaatgtatgtcttgatcacaccaggaagtctctgctaccaacacccccaggagaaaacagctccaggctcttgaggctcctcaagtagcaaagtctcatcgctcaggtctcgcatgtcagaatttgccatgattcactcacagcatgtgtcatgtgtatctggtagaatgtctgaaatgcattcttcccatatggcttttcagggccctaagtgtgaatatgaactttgcatgtgaaagatgcttcattttgcattttgtttgcttgtttttgtttttttgagatggagtttcactcttgttgcccagactggagtgcattggcgcccaggctggagtgcagtggcgcgatctcggctcactgcaacctccacctcctgggttcaagcgattctcctcccttagcttcccaagtagctgggattacaggtgcccaccaccacgcccagttatttttctgtatttttagtagagactgggtttcgccatgttaagcaggctggtcttgaactcctgacctcaggtgatccacccgccttggcctcccaaagtgctaggattacaggcatgagccgctgtgcctggccaagacgtaattattaaaattaacaatgttcatctcagtatactgcctaaaattacgtgatatgccaaagtgggtgtatgtatcccactttgaggaatactgatgagaaaggatgttaggcctacagagatcttcatcttcagaagagcacagataagttctggtataatggaaatgacagcgtcttggcattttttactgctgccttcaaacagcagacatcacagcccacgatgatgagcctgctgatgccgacttcctgcattctgtggtacacctgggctcagcttagaaaggctctaccccaactcatacttcttcatggcaagatgaggtgaattcatttctacccatagtcattctaatctgcattttcataacccacctttccattctccaagtgtgactttcatttttaggacagagttattcagtcggtgaatatgcagtccctttaaagggatatttatcacccttgaagaatcttattgccaaatcttaatagtctttcttataacaaaggctcaaattcactatcaagattaagaggtggagcttgaatgagctttgctggagcatctcatgataaaatagattaaagtcttaaaatgggcaacccatcgaggtggaagtcaaacaaatatgcaaaagcgtccctgtattttcctcaggcagtttgggcactgtgggtgagcccagagggtgaatggtgggaagtgggagttaggccacgtggattttccctcaggctcagcggggtgacctcccatgagaagctgaaactatcttaattactttgtctgtaaaatagtggtggtgagcatggggagagcttgcctacctcagaggcttgtggtgaggattacggggaaaagtccatgtaaagtgctcccccctggtttctggcacagaacaaatgaatgaaattcagatccatcatttatgtcagaggtccccaagaccacccccaggttccttgatccccaagtcctaggaagtcctagagtccccaaggccacccccagtttccttgatccccaaggaggactcatggttaagatttattacggtgaaaatatacaaaatgaaatcagcaaagggcaaaggcctgtgagcgaagtccggaggaaatcagttacaagatttccacaatcccctcccaatgcagtcacacaggatgtgcttaactcccccaagcaacatatggtgacaccgtgtgtgaaatggtttctacgagggaagctcactggaggctcagtgcccgagtttttactgggagctcatcgagctggtcacgtagacagcctctgcctgatacatagcaacattcctgactcccggaagaaaagcaagagttcagcataaaccgaatagttcatacaaacatgaggcacttggagccactcttaccagttatgggcatgggaatactctccaaacccaagttcccagatgccagccaagggccagcctttcaggcaggcctttccaacattgcagtctgcaatctgcttcgtaactcttttctgcccaggactagaggtcataaggcccctactaactctctggcttcatccccagtactacctgttaaccaacctgacattcctcccatcaccccgcagatcctggccccaaagccttaccttggtgctagcagctgcctctgttttgaaagctcttcccctgagttctccatgaccaagtcctcacccttttcattgcagatgcttgcgtgttcccatcactgagttctaatttctctaatggaagtatcattctaaagttatcctttgtccttcttttattcttgttcatgggtatctccactagaaggaggatatatttttctggcagaagaacatgcccgtcctatttattgtgttatcactagtgtccactatagggatggacaggtggtaggtgttcaatatttgcctcatggatattgggaattactatatttattgttctgtgtcccaaagaacaaatgaagcccccacacccttcctgtttattgacttaaagtattgtctttgaatgttgaaaaaagtttttagaaaatgctgaacttacagggaaattcaccaaagtaatagtaatatcatgaagatgctcattgcttctgggctttccaaatctcatctttcctcaattgtgccttctctgcatgagcctaatttgaaaaaaacctggttcacagagggctgcttaagaagttgatggttttgtttatactcaaagtcattgtggggacctctattttcaccttttttggcctaggttgtcccagtacttctctcattctgtgattgatgtcatacgtgacaagtgtgatgggtcacttcactggcctctccaggcggtttattctttagctgacttcaccttgctctggccttatgtaaaggtccctgccctctggcttttagtgggttcaacccacaagtctgcaaactttctcaaagagccagataataaattttcagacattgcaggccatccagtctctgggcagctacactactctactctgccattgtagcatgaaagcagacatacacaataggtaaaccaatgagcatggttgtgttccaataaaactttatttacaaaaactgacaataggctaagatgtggcccgtgggctttggtttgccaatcaatggtttagccagtggaggattgggacaagaactcagagggagagaggagaataaatctttgcaggctgctctgtccttccattgggggttacagttcttctcagggagccccctccatgtggccgcgtcttttgggtctggaaattgtttcctcccctggccctctaggcttagatgtgggaaaggtgccccattattactggcatgttgctttatgctgtgggccccttttccttgactctgactgtacttttgctggttcctgcgtccatctcttgtcacatagctcaatttgcgtgtgccatcaatttcctgctgggattaagatacctggcagtgcagggtttcctgggatatgggacctctaaaaccgaaacctagacagtcccagtaaatcaggaggattaatctccctaactggaacccagccctgtctcctcccttggccctgctccaattaccttcattctggccctcagtacccccaacttggataacggctttgctggccagtgactaaatacagtggccagatggggtctgtggccatcgccatgtgcacctctctgctagggcttatttgcccttggaacaaagtctgtagctgatgtttgacaagccaaggagactctagtgtagtcccccagcctactgtagaggctcttcacattatcatattttatactgcataatttttgaagatgatcccttttcttccaaattgtagtacaggagaggtatgctatttttccataagaaaaatcagacttactttgaaagagcagtaggattagcagacactttgaaatattacattaatccagcttgggttgaaaatatccaaaggactgactcatgaaatttcaagtaattgaacttctggactcaaacagacatgagaagaaaaagttatgttccttcaaactatttcagctcagatgattttttcctttttagttcaaaacctgacaaaggtttgcttgatgaggagaagagaccaccttccccacaatgaaagttaacgctataatgataataggagggcttatgactgaatctgtattcagatacaccgattttgtttgcttttagtggcaagcaggtttagcaggttagagaagagggtaatgttttgatactgtggtgaagctgaggagggcgatgtccttagtctgaggagaccagcatgaagccacctttattgccctaaaatgtctctgccttcaaacaagtgggctaaagagggagggcctgatgctctgaaaaggaaaaaaaaaaaaaaacttggccgggtgcagtggctcacacctgtaatcccagcactttgggaggcccaggtggacagatcatttgaggtcaggactttgagaccagcctgaccaacatggtgaaacctcgtctctactaaaaacacgaaagaaacagccaggtatggtggcacgtgcctgtaaccccagctacttgggtggctgaggcaggagaatcgcttaaactagggaggcggaggttgcagtgagctgagaccaccccactgcactgcagcctgggtgatggagtgagaatccatctcaaaaaaaaaaaaaaaaaagaaaaaaacttgcataatggagcaggctaattcaggttcccaggatctagatgacagtaaatatggaagctgctttaaggagatactggagacattttaatggtgttggccgtttcattgtaacacaaatgacttctctgcagctgttcaaggaagactcttttcctatgagtgttggtagatgaagagtggaaactcaggtgcttggcaaggtcagaaagttagtgtcaatgagtgaggaggcttgggtagaagaaaagtctgtatgaagacataagtacaaaccaaaaatcacttttagttgactatgaggcaaacagcagtgcaactgtgatgacagaaggcaaatggtacttgctggggacacatgggatgcatggcctgtggacatctagaaatgaggcctgtccatcaggaggtcaaccttaccatccacggagtgttgccctgtttgactccaagctcaaagctgtcccaaatccagatgctcggtgaaaatccctgatatttgaatggcagcctctgcaagctaaaggccatctagcagatacagtggccatatgggacgtgccagccatgattttttgcagcctctctgttagtgcttgcttgcccttggaacaaagcctgtggctggtgtttaactatcatgggagatactagtgtggctgaaaagtctgtgttctgaacagtactatggcactatagacaaactttcaaggtcaaattgattatcctgtagtttagcaaagcagcagctccctaattatgtcaggaggcaggattatctctgatcatttgagctaggactccagataaaacatcaaaagcaatatttaaataacacacagccatggttaaggattcattgcattttctcttactataaaaccaaaattgtggtggcccattttgttccattactggaagggttttccaggctgttttaactcatacatagtgtaaccctttcccttattacaaaatttcactctgggaaagagcaaagctgtactttgtggtacagtgttatgatggtttatgttcatgaaggtcctacaaaaattcagaaacattcttaatccaaatgatctagaaataggaactggaatacctactgtgctggagctgcttaacccatgaaagacagttgtacacagctcttcacaactccgtattcagtgatttcacattagtagcttgaaattagccatgatgggagcatttatgccctggacattgtcaaaactcagaaatcaagtcatttatttcttggggagctggtcattaaacactcactaggatgcccttgggtacccctcactgctagaagaattccctccctccctgtatttctcccttgaaatctgagccagtcttgcattctacatatatatatatatatatatgtatatatatatatatatatatatatacacatatatatatatatatatatatacacacacacacatatatatacacatatatgtatacacacacattcctatcttctcaaaaattcttgccttttaaaaagttgttatcaaagacaaggaattttttaatcatcagggtagctcagtcttgagacatctgagtccttctgagtagtaaccagtagctgcaccgaagagacagttcaaggactacaaatgatggtagtccttgaatttcaagtccttgggagttcaaggcctatcctcatttgtagttcttcacactgtaccactctttatttgtttaaaatataagagtgcacaggcaaaaatcagctaaatgggagttgtccagaacagtgctttctccagtgaccttactcacccctccatgaggactcagttaattctaatctctattttgctgtttctatgaggtcagaagtccccaactttttggcactaggactggtttcatggaagacaattttcccatgtaccagggacatgggggaggggaggatttggggatgattcaagcacattacatttatcgtacacttaatttctattattattaccttatataatgaaatagttatacaactcaccagagtgtagaatcagtgggagccctgaacttgttttcctgcaactagacagtctcatctagggtgatgggagacagtgacagatcatcaggcattagattttctgaaggagcatgcaacctagatccgttacatgtgtggttcacaaagcacctataagactctaatgttattgctggtctaacagaggtggagctcaggtggtaatgcaagtgctggggagcagctataaatacagacgcagctccactcatgggcccgccactcacctcttgctatgtggtccggttcctaaaaggctgcagatggatacccatccatggcctggggattgggcatccttgtattagattactaactccacccttaaactttttaagttgtgttttcaaagaaggtatcagcatgtcagtctttcctataatgttctgtgtttcttgaagatagggaccttgcctttttgtgtatattgacaattagtgtatattgtcttggcactgacacacagtaggcagtcagtagatgttacttgcatcaatgcatgagtccttcagaatacatccaattggcattcagtgagcagttgttcaaattccttttaattcaggatggtcaaatgtttgtatgaacatttggggaaacatcttaactgtctaccaggcagttagattttaaagaaaagacatgtattcatatactccgacccaggggaagatatgtggcattctgcttaacataatcagttccttgctttccacaccaatttgtgcttgatttgtttcttttcttctagaacttttcagagtgagaacctttagcagaaaaaaaaagcttaacaagatagacattttagttcaatagaagaatttttctggtgtgaaaaagtaaattacaaaaaggactttggttctgaaagataattaataaaaaccttcccatgtgatgacaaatctgacatcttgtctaatgtctggcagagaagaaagtgttgagagctgcacagttggaataaaatgttccactttacagcaaggccgggtaggatctgataattatttctaggcaacaaaagttcatagtctaattgttcaattgacacaacaccaggcctggctctgtgactatgcaccatcagtgaggtcttcgtttaggctttcctgatttcacaggtaaatattgccaggaatgtgggtgatcatggaatgactccctcgtggatattttggactacagctgtacttatagaactttcctttccctcttgtaagcttctcatgggctgtggtaggctgagtaatggtcccgtaataagtctacatcctcattttcagaatgtgtcaaggttacctgtatgacccagatgagtatgatgtaatcacaagcttacagaagggaagtaggaggagccagagttagaaacagaagacgatgtgatgaaggaagagagacagagaaaaacaggtgagaagaggccatgctgctggcttgaatgaagaaggaggctgtgaactaaaggatgtagatgacctagctggagaaaacacattctcctgaaggagttcagccctgtggcttcagactttagaactataaggtaataaaactctgggaggctgaggcaggcggatcacaaggtcaggaggtcaagaccatcctggctaacatggttaaaccgcctctctactaaaaatacaaaaaattagccgggcgtggtggcgggcgcctgtagtcccagctactcgggaggctgaggcaggagaatggcgtgaacccgggaggcggagtttgcagtgagccgagatcgcgccactgcactccagcctgggcgacagtgtgacactctgtctcggaaaaagaaaaaaaaaagaactataaggtaataaagtattttttttttttttttttgagacagagtctcgctctgtcacccaggctggagtgcggtgatgctatctcggctcactgtaagctccgcctcccgggttcacgctattctcctgcctcagcctcctgagtatctgggactacaggcgcccgccaccaagccctgctaatttttatttttattttttttttgtatctttagtggagatggaatttcaccgcgttagccagaatggtcttgatctcctgactttgtgatccgcctgcctcagtcccccaaagtgctgggattacaggcgtgaggcaccgcacctggccaataaagtatttttaagcctctcagattttagaactttgttacagcagcattatgaaattgatacacgcgggcatgttttcctgaaatcagagcctgagaggagaaccaggtacaggtagttttctttgggaggtgatccaggaagcaggagtaaggaaggatgagaaggcaggaaaggagagagaaccaatatattaaggaatccttgagctcactgctgtagacagccaggggccagtgcacagggacctcgagaggcacagggaatgactctcagacgtgtctgtctgcaagaaggcaggtgggagcattcagccagctgtcatttccaatgcactgagggctgtccataggagcattaactccccctcctttcccatctctgctttccctcacattagccaagctcctgcagtgtaggagaaagagccaaagcagaatgcaaagagactgagggcactctaaggggcaagcctgacttctttagaaactcatcgcagcagcaactgagatcagaggttggctgaggtattggctgcagccaccagcatcatcctctattgggctgacccctcagatgacagacctattcatttactgtttcccatcttttgtctctgtggattcaaggtttcttggtgtagaccagacaaggttcccagtgcctgccacatggtaggcattcattattttctcatttgaactccctgaggctactaaggcccacccaagagtacctcatataggggctcctttgtttgacttaagggaaacaggtattatatggcattcgacatcactaatttaattacaaaaaattcataaatagatgcaaataccaccaaccctgagcaggcacatcctctggtttctcctaagggccagccagcaagccaggcattcccagtgtagtaacttaaattcttacaaaactgtatttttccttttaagttttccaagtgagcccagtggcttaatcctggaatcttaatagtaaagagttaattccatttagacaaaaattgtgatttcactgagtgaattgttcttggctctgttttatccaaactgaaggagggcatgcatgagtcctattttgagacaaaacaccttcaaataatctggaaaacaacccagagtttatttctgccaaatggctccctgtttcttgaactggcatgctatggtgtttgcattgaccaaacttctgcgtggagcctttgttcttagaggttgtcatgtgaaaagtttcaatcatctttctaatatgtccttgtctgtgacatggtcccagtccttattttcatccaaagagcatgttgttccttcttctttatttccacaatactttatacataccctctatattaatataactataatattaatgtatacttattatataagaaatatatatcagctatcaatataaataataactagcacataacacctactgtgagccagtttctgtcctgaaacatttgatttgtgtttactcattgactcatacaaccaatgggagtagacacaattattagttgtgttttgcagatgaggaaactaaggcaaagagaatttaagtaacttgctcagggtcacatagaaactaactggaaaaattgagatttcgacccagttagtctagcctgcgaatctttactctgagctactttttaactgattctcaatgtatagtcacataggttgtagtttattatatgtccatgtgtctgtctttccttctagataataagttttttaagggttttattcatttttccatctctagtatctaggccagagcctggcagataatagaaatgttaaattttcactaagaaaatcaattttaaaatgaacctgatgatgctgtcataatggcagatcaaaatgtcccataatttgaaagaggcaattactaaaacaatagcaaaaaataaaataaaacaaaataaaataaaaaatgagagacaatgcttatttatgccaaggagaggagcacttaggacactcattgccacatcctgactctgacagccttgtcaaagcattccaaagccatgaccttcccttattctcccttccttccccacctcgccttcaaattccctctcctattcctttctaactcctctattttgccctcttcattggttttcccaaattatatttacatgttaaaataccaagtaaagggaacccatattttctgagtgtctattgtggggccaggctatagtagactgcattagttcccaatggctgctgtaacaaatgaccacaaatttagcaatttaaaacgaacatagtattgtacagttttgaatgtcagaagttcaaaatgggcttcactggactaaaatcaaggtgttggcagcgatgcattcttttctggagtctcatggggagaattccctttatgccatctccagtttctaggggccacccacattccttgactcctggccccttcctccatcttcaaagtcagcaatgtggggctgagttcatctcataacatatcactctgccctcaccttcatcatcacatctctttctcttatcctttcttccattttcaaagatacctgtgattacattgggtttacgtgattacataatccaggataagcatgctgttttaatgttagctgattcccaaccttaattaccctttgccatgtaatctaacatattcacaggtcctggggagtagggtgaggacatctttaggggactactgtctattctgtttgcgttatctcattaaagcttcccagtgaccgtttctctagcaaagagcatgtgaaggccattcactctgaattaatttaccaaaagccagagaaatcaccacacagccagaatttggacttaggttagttttggctttttgccccatgcttttccttgttttattgttttcttgtgcttcacttttttttttttttgtacttcacagatactgtatgttttacaaattgaagatttgtggtgttgaagtcaaaataaaaatgtagagatgaatctctaaatttagcatttcatttgggaagaaagacttgcaatttggggcatttatgcagattaaatagtctttggtatgttcaaagaacaaagagaaagttggaggttttgtaacaatgaaaaatgttatgtattgctctttgagaaagttcattgacactagtaaggttctgggaagctggcaagcttcagctggtgagtggcatcagtgagaaaattagtcctggagttgcagcaaattatcttgaagctatagataaaactgggttcaggttacagcagccaggcttgcagagaattacattgttggagcaatgctttgtgtccctagtgtgtttttgcctggcttcttgactttgctttagttgggtatgacaagaataacccaatttgtaggatcagctttcaccttgacaactctgcactgagcaagtttatgggtgctgtttttccaacagtatgtgatcactttgtgtctctgtctcatgttttgataattctcccggtttctttcctttttttaaattattactttgtctattttggtgatgtctgatcagtgacctttgatgttactattgtgatttttttttttttgggtggggggaggcaccacaaactgtgcccatataagatgccaaacttaattgataagtgcgtgttctgactgttccaccaactggccctttactcatctgtctccttctcctccaaacatcctatttcctgaaacacagcaatattgaagttaggccaatgaataagcctacaataaagtactttctttgcctctaagtgttcaagagaaaggaggagttgcatgtctctctctttaaatcaaacctagaaatgattaagctaagtgaggaaggcatgtcaaaagctgaggtaggctgaaagctaggtttcttgtgccaaagagtaaagttgtgaatgcaaaggaagagttcctgaaggaaactaaaggtgctactccactgaacatatgaatgataagaaagtaagacagccttattgctgacatggagaaagttttagtggtctgaatagatgatcaaaccagccgcaacgttccctcaaaccaaagcctaatcctgagcaaggccttaactctattcaattttctgaaggctgagaggtgaagaagctgcaggagaaaagttggaagctagcagaggttagtgtgtgacatttaagtaaagaaacgatccctataacataaaagtgtcaggtgaaagccaagcacagtggctcacacctgtgattccagcactttcggagaccaaagcaggtggatcacgaggtcaggagagcaacaccatcctggtcaacatggtgaagccctgtctctactaaaactacaaaaattagctgggtgtggtggcacgtacctgtaataccagctactcgggaggccaaggcaggagaatcggttgaaccagggagtaggaggtttcagtgagctgagatcacaccactgcactccagcctggtgacagagtgagactccgtctcaaaaaaataaataaataaaataaagtgtgaggtgaagcaggaagtgctgatatagaagctgcagcaagtcatccagaagatctagctaagatcattgatgaaggcggatacattaaataatacattttctacatggttaaaacattcttatactggatgaagatcccatctaggactttcatagctagagagaagaagtaaaggacaagcaaactcttttgtctgggactaatgcaactgatgactttaagttgaagccaatgcttattcaccattgcaaacatcttagggcccttaagaattgtgctgaatctactctgcgtgtgctctacaaaaggaacaacaaagcctggatgacagtacatctgtttacaacatgatttattcaatattttaagcccactattgagaactgctgctcagaaaactatattcccttcaaatcttactgttcattgacaatgtacctggacatccaaaagttttaatggaggtatataaggagattagtgttgttttcacacctgctaatataatttccatttttcagcccgtgaatccagaagaaatattgactttcaagtcttactatcaaagaaatacattttgtaaggctacagcttctaaagattgtgattcctctgatggatcaggacaaaatgagtcaaaaacctgctgaaaaggattcaccattctagatgcccactaagaacatttgtgattcatggggggtggttaaaatgtcaaaaataacaggagtttagaagatgttgatttcaatcctcatggatgattttgagaggttcaagacttcagtggaggaaggaagtgcagaagtggtcgaaatagcaagagaactagaattagaagcagagcttgaatatgtgtgtgaattgctgcaagctcatgataaaaatgtgaatggatgaggagctgcttcttatggatgagctaagaaagtggtttcttgagatggaatctaatcctggtgaagatgctgtaaacattgttgaaaagacaataaaggatttagaatcgtacctaaacttagttgataaagcagcagcagggtttgagaggactgctttctattttgaaaaaaaagttctcctgtgggttagatgctaccaaatagcatcacatgctatagagaaatcattcgtgaaaggaagagtcgatagattggcaaacctcgttgttttcttattttaagaaattgccacagcctccccaaccttcacaaccgccaccctcatcactcagcagccaccaaaatggaggcaagaccctcaccagcaaaaagacaaccacttgttgaaggctcagagatcattagcattttttagtaaaaacgtatttttaaattaaggtatgtacattgtttttagaaataatgctattgcatacttaataggctacattatagtataaacataacttttatatgcactgggaagccaaaaagttcatgtgactcactttattgtaatatttgttttattgctatggtctggaaccgaacctgcagtatctccgagggatgcctgtacatgcagcttccctgtttacagtttgaggagaatatgttgggtagcatcttttagaaataaagtctaggatgttggttcaaattttgtgtgaaagcaacaatagggccaggtacggtggctcatgcctgtaatcctagccctttgggaggctgaggcgggcgaatcgcaaggtcaggagttcgagaccagcctggccaacatggtgaaaccccgtcactactaaaaatacaaaaaattagctgggcatagtggcggatgcctgtaatcccagctactcgggagactgagtctggagaattgcttgaaccctggaggcggagggtgcagtgagccaagattgcacctctgcactccagcctgggtgacagagtgagatttcgtctcaaaaaaaaaataaaaagaaaaagaaaaagaaaaaagaaagcaacaatgggaccgacgaaactaaaagcagtctccccttttacctccccaagaactgtaaaaccatttgtaagtgtctgtgaccttaatgaccagaaacgtgtcaggttttctgtgttcctggggctgtaaaacaccaggaacattttaaggaggtcagactcagcaggggcgtggacatgagtacatgcacatgtgtgtacgtgtgtgtgtgtgtgtgtgtgtgtgcatgcacatgtcctggaatgctccattcctccatgctttccctgtaggcagtatgcctttgtaaacccttccaggactctgggtttgtgctccctgggaggataaagaattaatcaaaatacactgctgcgatatttttacatcctgcaagtcagaggcagtatcctttcttcctcacaaatctaagaccctccaaattgatctcaatacactgactttaacaagagtaaaccagagatgttttatggcagggataaagtaactatcaaccaacactaatgacaagaaagcaaaaagagttggagagaggaaagcataaaggatcccagagacactggggtgttggtttggaaaataccttcttggagctggtttaagaggggatggaacctgagagtgttctcaacctcgtgagattaattatttgtggcaggaagtttctctctttatttgtggctgctttggagacagttgtgtcatgtttttcttcagtcctgatatttttcactggcctctgggatatatctgtgatgtcagtggtatcaaagacttttctgcccttgttccatggatgtttagtgtacaatcagctgctgcaacaaacaacaccaaatctcagtgactttgcacagcgttccgtggatgtgtcttgtggggcggttctcccgagtaactgtcttctgtgcaatgactgattctgggctctttctattggatgactctgccaccttgggagtccttccttcctatttccatggataggagaagagaagatatcatgcaggacattcaggggccatgtctagaagacgtgagaatccttccacccttattctgttggccagtgcttagtcacatgtctaaaattgtaatggagcagcagcaccatgtcctattgtgagaagtagccagagactaatctcaatgacagttcttatagcttgaaaaggtatttgcaaaatctaaagcaaaagttgccaactcgaatgcctagatgtccaagcaagtgtttaactgaattgagtgagcagaaacaagaaccagggagtggtgctgagaaggaaagcttggagaggggcactctacataacatgacaatttaacttgatgacagacttctctggctaaactaaccacatctgctggccacatccatcccttatgctgccagttggcaacctacagtatgggagagaaaaagaaaaaatcctttctctggaagcaaactccaaagttgggtatattcttgaatcagtacctgtcaggataaaaaaaaaccctttctttttaagaaagaacgaaagttctgtactacagcaaataaatggaagctaaaaagaaaacctggtataaagagtgtgatttaagaatttgctttctgtgcatacatttagggtagtggctcttgcatggaagagagatctctgagctgctactttaaaggatgcttggtgtcctacagaggtaacacaactcaatcatatcaggcactgatgttctgatggtgcagctgatcctgagatgcaaacaccccatgatcttctgctgtctgattccctgctatgtccctgtatgtagtctaaacagtctattcactgaacagttttttagtaacaacaaaagtaataatatgttggtaatagtttgtcaatgtctaccctggagaatatcagtgaatcatgaatatggatttaaatataatacatagaaataataatagcaagcatttattgagcaagtactatgtaccaggaactacttaaggctctttacaataattaactcacttaatcctcataacgggtgagataccattactcctgcttttcagcttagaaaactgagacacagaaggttacttgcccaaggatagcccgctggtaaacgagattcacactgaaccaacgtggcttaaacctgtgcttatagtccgtctgaaacgtgaatctttgtagcaggctgatggtaatttttagataatagaaatcttttgttaatcatagaatttgattattgctgtgctttcaaaggtgtcttggttacctctcatttcttaggtactcactgatgcataaatggacaaacatgtcatagagtaagactatgattgccgtggcattaaagataaatttggaatgatgctcagagcatatattctagaaaatttacagaggatttggggaaaactatgtccaggtagtatttttatgcatgtgacatctcataatattggagaaagggcttgcctggttttggagtaatgtccaagttctaattcttacagcaatgaggggtgctgctttactgctttccatccccttaccaaagttactgtgaatgaaattgaagagcggatatcggtggcaagttcaagcatagatactgttttgaattctcttaagaaattaaagggcaaggctgggcttggtggcttatgcctgtaatcctagaactttgggaggccgaggcaggcggatcacgaggtcaggatatcgagaccaccctggccaacatgttgaaactctgtatctactaaaaaaatacagaaaattagctaggcgtggtggctggcacctgcagtcacagctacttgggaggctgaggcaggagaatggcatgaaaccaggaggcggggcttgcagtgagccaagatcgtgccactgcactccaacctgggtgacagagcaaggctctgtctcaaaaaaaaaaaaaaaaacagtaaaaagaaatcagaagacaatagcagtaactagaacattctactattattgactagtaagatatttagcttttggggaagtcctaaattagcctggaatcatttttaaatgcagttttgtaatttcagtgatgtgttacatgaaactcaaagagccacaaaataattcacgtgtaagcgaagagtgtgctggtttaaaagatgagtctgcattcttctccctttatgcagataattcgtaatcatctttgagatcccagcagaaatgtctcttttgtggttttgctttccttgatgctctagatgaagttagacttccctataccccaacttttacatgctcccagagagatctatattttcctttccagttaaattttaatcttggtgaatcacttaaattatgatttgttaatgcctcttttctttttgagaccataattatatttaacaattattgactccttatcctgtgtggcacctttctcattgctttggacaatgtgtagcaaagtcctcactgaatcccaggagtctaataggtatttgtgaatgaggagtgagtgaatgaatgaatgatttgactaattcttacctcactaagtcacccatggcccaggagggtactgtgtacctttatgttacaaatcatttaactttaattttgactggtaggtgaagtgtcccaagaatttgtaaagataaaactgtgcctttggggcttctcctactgctcccctcttccctaagagtcagcagctggaaaaggtttatttattttttttattttgtaactgtagaggaatcctgaatgggccctgcaaagtaatctcagagattgagccacacatagacaaagatggagaacacagctcacctgcagagtgctgtttctcatcactaactgtggtttctctcagtcctgactttttatgctgaggattctgggagaaatttcaccttctttacttcctacaggatatccagtttcctggtctgggagctgagagcagaattagccaattggaaggttaacgcataattgtaggcactgggtgtatggaggagacccttgaccatttgctatttaactgaattaatgttggccagttatagattttctgtttgcaaaattgccagcagatttttctgactcctggatctgcatcctgtgtatgtgccacttgggatgccagcattttgattgcttccagagcgatctaaccagagcctgctctcaagacaagggaatccatgattcacaagcggaaccgtacagatgccagaccacagcgttcttttcactttgatttgagggagatgatgttggtcagggtgatgactcccccatttcaatttctctgatgttgttcaggccagccacacggtgaacctcctgagattgattcttgctcccttctttggggttcagtgcatttcagagggctggtatttagagagaagccctggttccacagcttccaaccttttgacactgctttgagttctctggtggggatgataatgaattttcttcaactgtctgtgtgcagtggttaggattttgaggtctgatattgaagttttgttttctaagaaacacacagagtcgaggatttgagtgcaagtaatttgagtgatggcagaaattggtttaagaaaaatactagctggggccgggcacggtggctcacacctgtaatcccagcactttgggaggccgaggtgggtggatcacgaggtcagcagatcgagaccatcctggcgaacactgtgaaaccccgtctctactaaaaatagaaaaaattagccgggtatggtggcgggcgcctgtagtcccacttactcgggaggctgaggcgggagaatggcgtcaagctgggggcggagcttgcagtgagcagagatcatgccactgcactccagcctgggcaacagagagagactccatctcaaaaaaaaaaaaaaagaaaagaaaagaaaagaaaagaaaaatactagctgggtgcagtggctcacgcctgtagtcttggcactttgggaagtcgaggtgggtggatcacttaagctcaggagtttgagagcagcctgtgcaacatagtgaaacctcctcagtacaaaaaatagaaaaattagctgggcttggtgacgagtgcctgtagtctcagctacttgggaggctgaggtgggaggatcgcttgagcccaggaggttgggtctgcagtgagccacagttgcactccagcctgggcaacatggcaagactcggtctcaaaaaaaaaaaaaaaaaaaaaaaaaaaaggaaactttaaaagtcaaaaaaaatagaaaaaataccaatagggaatgaggaaataagtcagggaagagaaggcaggtaatgaatgtgagttatcaagctagattctctggtggactttggcactcaatcccaggtggaaactgggagacaaaatgcgtatctccaagtgatctcaccagaggggtgagggaattgggatatttacataccattccccatcagttattggttaaggaccactcccaggatgttaatttccaaacactctcttctggcactatgctcagataaaatacccttccacaagttttagagacatatctcgtacaaagaagaaaaaatgcaaagtcctgcacgttgacacagaaggtctgaggggaatgggtaggactctgacagagttcctttgaggacacttgaacctagattcagatgctggcttcacccattccaactgtatgatcttgggcaagcttgttaacctttctagaatttcgagttcgtcttctataaaatataccttataacattacacatttcataggcctgctgtggagatgatgcatatggtgagtttagcacattaatggccaaatactaagggctcaaaaatggtagctttcatttgttaagtgttacggagcctcttctctgtcccagtatgtgtggtaggtgctcagtagaaccagtggttggttgttggggggaggtaatacctgtttttatggccttatagcctttgcgtactaaaccttaagaccatttcttatttcactaagtcacaccttgcccaggagagaatcgtatacatctcatacattatgttccaaatcacgtaacctaaatttttgaccgctggatgaagtgtcttaagcatctgcaaagacagaactgtgcctttgaaagcaattgtaaattttaagttttatagtagccaagtttgcaaaaggaataagaaactggtgaaattaattttaataacatatatttaatttcatatgtaaaatattgtcatttcaacatgtaattaatatgaaattattgactattttacattcttttccttatttagacattgaaatccagtgtgtattttatacttacaacatgtcagtttcagacctatgactgttaaagtactcagtagccaccggtggttcatggtcaccatattgggccacagtgaaggcttaacaggtcctggattccttttagaagtaaattccaacagaatagttccattttctctttcctcctcttcatagatgacaatgcttctttgcttgtataaaaatgaagttggttttagcttaggcatcatggaaaattgacagtttctgtaataaaatttcacacatggaaaccatggtgagaatcttagcaggtgtaaaaatctgacgaagttatttctttaactgcaatttaatggaaactgcagcagctgttccatttgcgtattctccaaatctcagtgccaaaaagaattgttggcagccactggagaagtttcaacttacctcttcatttgggaaatgaaatcaaaacctcagcttgtttctaaaagttgcggatttggcgaaagttagcagggcaaacacataagccgctattaaaatattgatggctttggttttctcaggtgctgctgctaacatctgcagaagatttggactgcactcctggatttcagcagaaagtgttccatatcaatcagccagctgaattcattgaggaccagtcaattctaaactgtaagcaatgtcactcaaagatgcttttagactcttctcatatttgaatttactaatgtttatgactgtgtctcaggatgtggtatttcctaaactaagtgttttctgattatttttcttatgtcactgcttgacccaaagtggaaattcttgaatgagggcctggccaacttagaggttaatagagtgatatgcatctctttttagtattttatcatcagtgggtatctccatactgctgtcagaaaagggggctgtcagcctccaatgagagttgtacactgtgcaaaggaaatgaaattcatttcccctgggcagatccccaaaatcaaaatcattgccttctcgcagattgctgttctacctgtagtttctcatacatagcattagatcaaaataatggtgagagtatgacattggcttctgggaatttttagacacagacatcaaaaactcttattcttaaggctaataagatgggttttagaaagattcaaaacctctactgattattctatggattaagctcaactcatcctgaattccaattgatttatttaaaatatgcatctttcatatctgtggtgatgatctctttttgtttttaatgtcaatattatattgctttatctttaagaagtgttagggtacattgctaaatgcataacaagtacagttttagtgcaatagaatttaaaattggtggtagacaaatagctatttcattgtaggctcttgagtaccttgcttaacaactggaaatgaagaatatggaaacaactgatctaaactgatcagatgcagtcgggtgtgatggctcatgcctgtaatctcaccactttgggaggccgaggaggatggatggcttgaggccagaagttcaagaccagtctgggcaacctggtgaaaccccatctctactaaagttacaaaacttagctgggcatggtggcatatgcctatagtcccagctacgcgggaggctgcggcagaagaatcgctttaacccaggaggtggaggctgcagtgagccgagatcataccattgcactccaacctgggtgacagagcgagactgtgtctcaaaaaagaaaaaaaaaaaagaagaagaagaaaattaaaataagctgatcatacgctccaaggtcttttcaaggaaggtgattccacattggctcttatggtctcaggtttacgttccacgctagctaagttcctttagtcctatgctatgtggctgacaagtttaaaggaaagacaagaaaaaaaaaaaaaagcacacttgactggattattctgtgaggctgggacacactctaagagtcgaaaggaacacaataatgaagatgcactgttgagcatcaagggagctgtccaaggtgaagcccgtgcacctcccgatgaaatgacgccaatgaaatcatttcaataattagtctgtaatgacaaggtgcagggctggcacaataagtgaattccaatatgtgatttcctgctcatttgatctctgagtgtgactcctgggtcaggccattaggaaccctcctttgtcttttcatttttgtatttatcagaatcaatatatttcaaacagaacttgatttgtgagaaccatttttctggctctcctctcctctcttcctctgtcttccttttattttttttccaagtgattatcccaaatggcatctatgttaacatgcttggaaatgcgaagcgaccctgagtatggaaattaatagagttggtatgcaaagtagacctataaatgtgattgcttctgtaatcttcacgatagcaaacagtttttaattcgctgctgagaagctggaaacaatcatactttggggggatctttttaatttaaagtaagccatactgtacattgcagtatcacagttgtgtgtgtgtgtgtgggggggggggcggcggtgtgcgtgtgtgctttaatcccctaagtaattaagtgggttatggttgttgcttctgggtaagctagtaaatgctaaatgggactaggttcattatcaatgataacacattcagaaaaagtcagtgatatgagaattgaggacacttaaatttttatgcttgtatatgagttgttgggtcagcaaaatttgattagcccctcttggtgaaaccgtatgtccatgtatattactaaggtaaaaaaaaaaaatccaaagcagatctggttaggtactttcaagttcatctcaaagcaatgaacatattatgagtatagagcctgcagataaggttaatggtgcctaaatgaggaagaaaattgtcatagacttgagaatgcctattgaaaatagtttaggaaactctggatttctagaagtagtagcagtgctttgctttattccacttgcaagtagcggttcaattgaataaacttttatacctaaccaaccaatattttaagccagtctcactctcccctctctctcattctcagtttattttgcgtatttcttataatgcaaaacaaaaaccttctgtctctgaaaaacgtgattaatcaagaaaccaatgagtgaagtgtgctatcaaattgaagactctactggcacaaggctaaatctgaatgaaaaacgaaaagaaccaaacagaaccagaaaatgttaaatgcatagattccatttcctgaatcattgtataccaaagatccaggaaatggttagggatgttttagtctcatataaatataggtcagtgttgtacacagtgagaaaactagattagtagcatcatcttgtgccctactcatgacatttgcacttcatatttttcctttatctttgcaatatttaagagctttggttaccaatcattgtgaacttttgtgttgcagggggtgtaaacacagcataatcaatcaattgatgtctacactcttcacttttctttaaagttgtctgaaagtgctgtctctttgcctgacagacatagtatatctacccctaccctagacttgtgttcatccaattgtgtgttcagcttttagcaggttatggggaatgtttattctgtggatggcttcctgctatctttgttcagacagtaatatttccttttatcctttttcatcttcctcctcaattttcaatgacttatctttttctactttaactgttactaatggtcacctccactccttttatttccctaatattttattcactgttatctctgatacatctttctctcagttgttctgaagccttttatttgcttcacatctgaatcactctttattctactctcctttccactaactggacttgcttttgtcttaaaaacgccatttttcaacaatatgctgggaccaaaacatagcattcagctatttcttctaacgtaaccagtgggctcttcactgcatctttcagagagtgatgcaaagctcccaactcagggaaacttgggtaaaacttccttggcttcatctcagtcttgaaagtttatctgggaaaatgtgattcttcccatttgtcaatgaaaaatacaagaagaaaggagaagtcagcttagaaggcaaccactcagaaaggaggcatccatttaaggtctttgaattctgaaaggaatctgtgaaaagtttgtgggaggtgttttctggaggcctggcacccatatctccctcaaattgcccagcatggtagatcttgcttttccccaaacacgacaattgtgtgatctgggagctgacatcttagtaccaccagaattggacagcaaccctggttacatcatgacacccagaacagaagatccccagtcttagaagaatagctgtcttgggcaactgaccagccacccagctgggatgggaagatcccaagtgataaaatctgactatcctatgttctgcaaaattataaaacaggatagtctgctttgataccatcagctcagacagattttttccagcaaatggaaaaatgtgtggtcattgagctcattaggagaaaccatacccttgacctccagcctctattagcaggggatgagtgcagtctttggtgtccagaaagaagatcctcattggccacatagccaccattagaactgtacttttttttcttacccttgttcattctttatgggtcattcctcttaggccacccacatgcaaacatagacacataggtagagacagaaatcacagcatctgaatttacctacaatacaacttgcatcacatgtttaggaaagaacctgcattaacaagagcaggctaggctaggccatggtgtcaaacaactctagtgacttaacacagtgaaagtttatttctcactcagatcatgcagatgcagtcgggctgctctcctgggtaactctcctcccagtggttgccctccatgcaagaacctgatggccgaggctacttccaacttggtcctaccatcttgtagcttccagcttttatcactgagctggcagacaggggaataagaaagactatgaggaggtcactgcaggtgcttaaatacctcagccccaaagtggcatgtatcatttctgctcatattctaagatctaatcatgtcgccaacctaactgcaaaggagtctggcaaacgtagaagaacacatgggtatcgatgcaggatcacagtctctacaaagatcctaacaaaatgatgtcgcctatatcagaaagagacataaatagagacagaaatggaccacaaaggagccagctgtcttggagtaaccaaggcctacataggatgaagttagtcagtttaagcaggagagcaaggtcgtgcacctgcgactatgtcctgctttccttagtagagaaatattcccactgaacagaattagcttcttagaaacactataagctcctctccctgtgccatcttagaaacactaggggagggacagcacctactcatggactccagttgcttcctccaattggttacaatactgtggttaagatcacacagttttaaactcatatcgactagaattcaaatgtgcacacagtcatctattagctctgtggccatgagtgagttattcacatcctccaagtttgaattatctcatctccaaaagaagattaatggtagtccctgcttctagagctaatgcctcaactgatgggaaacatgcttagaacatagtcacaaataaatggaagctgctattattattattattgtccttataatttctgctgttactattattatcattactttcattcatagacctcagctagatccacttttcttataatggccatctgaaattggctttaagaagaaaaatcatgttggccattaaaaatacaaacaggtgaagaagcgactaaagcagtgattgtagggcatttgaacttcatggaccagtaatttttttaaatcctagattgatgagagtgtattttaaaaaattggtaagacttggtatgaattttttaaaagtaagtaaatgaagggaggggaaaacactaccgccatttacttttgccaggctttccttttaaaaggtcacttggcatcaaaaataaacataaaagaagtaaagactagttacagaagaaaagtcagttctttgagtaaattttgctttgtgaaaaatgcaccaaatattcttatttacttcgcttttgtggaaaccattgatctaagggattaggttgatgtcaccctttttgctcttcacttttctgatacttttctgaagttttaatatgtcgttgtttctgaagaggcaggggtatttcttaggagacattttcatgaagggactcctgtccatgttgacaaaagagagtgagtgtttctagataatgtgacaatcatatgcatgttaggaggtgtattagcctattttcatacttctataaagaactacctgagatggggtaatttatacagaaaagaggtttaattgactcacaattcagcatggctgaggggtggcctcgggaagcttacaatcatggcagaaggtgaagaggaagcaaggcaccttcttcagaaggtggcaggaaggagaagtgctgagataaggggaggagccccttataaaaccatcatttctcacgagaactcactcactataatgagaacagcatagagaaaactgcccccgtaattcagttacctccagctggtcacccccttgaaacgtgaggattatgggaatcatggggattacaattcaagatgagatctgagttgtgacacagagccagaccatgttattccgcccctggttcctcccaaatctcatgtccctttcacatttgaaaactaatcacacattctcaacagttcccgaaagtcttaattcattctggcattaacccaaaggtccaagtccaaagtctcaactgagacaaggcaagtcccttccacctagaggcctgtaaaatcaagttagctgcttcctggatacaatggaggtacgggcattgggtaaatacactcactccaaatgggaaaaattggccaaaacgaagggtctacaggccccacgcaagtccaaaatccagcagggcagataaatcttaaagctctgaaatgatcttctttgactctgtgtctcacatacaggtcaccctgatgcaagaggtgggttctcacagtcttgggcagttccacccccatggctttgtggggtacagccccactcccagctgctttcacaggctggcgttgagtgtctgtagcttttccgggaggacagtgcaagctgtcaatggatctaccattctggggtctggagggtggtggctgtctctcacagcttcactaggctgtgccccagtggggactctgtgtggggatttcaaccccacatttcccttctgcactgccttagcagaaattctccatgagggctctgcctctgcaacaaacttttgcgtggacatccaggtgtttccattaagcctctgaaatctaggcagaagttcccacacctcaattcttgacttccgtgcacctgcaggcccaacaccacgtgtaatatgcctaggcttggggcttgcaccctctgaaacaatagcctgaactgtattttggccccttttagccatggccaaaatgcagggctccaagtcctgagacggcacaaagcagcaaggccctgggtctggcccatgagaccattttttcctcctaggcctcagggcctgtgatgggaagggctgccttgaagacctctgagatgccctggagacatctccctcttacccaccagccctgttacaccattgacttggcgattaacatttggctcctttttatttctgcaaatttctgtagctggcttgaatttctccccagaaaatgtttttttcttttctatttcatcttcaggctgcaaattttccaaacttttatgctgtgcttcccttttaaataaaaattccagtttcaaatcttctctttgtgaatacgtaaagctgaatgcttttaagagcacccatgtcatgcttgaacactttgctgcttagaaatttcttctgccagataccctaaatcacctctctcaagttcaaaattctgcagatcactagggcaggggcaaaatgccgccagtctctttgctaaagtacagcaggaattacctttattccagttcccagcaagttcctcatcaccctctgagaccacatcagcctggacttcatcgtacatattactatcagcattttggtcaaagccattttacaagtctctgggaagttccaaactttcccacatcttcctgtcttcctctgagccctctaaactgttccagcccctgcctgttacacatttccaaatttgcttcctcatttttgggtatccttatagcagcaccccactctactggtaccaatttactgtattagtctgttttcttttctttttcttcttctttttttttttttttttttttttttttttgagatggagtctcactttgtcgcccaggctggagtgcagtggcacgatctcagctcactgcaacctctgcctcccgggttcaagcgattctcctgcctcagcttcctgagtagctgggactacaggcatgagccaccatgcctggctaattttttgtagttttagtacaaagagggtttaaccatgctggccagactggtctcgtattagtctgttttcatactgctgtaaagaactgcctgagactgggtagtttataaagataagaggttcaattgactcacagttcagcatgcctggggaggccttagaaaacttacaatcatggtggaaggcagagagaaagcaaggcaccttcttcacaaggaggcaggaaggagaagtgccgagataagggggaagagccctttataaaaccatcagttctcgtgagaactcactatcacgagagcagcatagaggaaaccacctccatgattcaatgacctcccccgatctctcccttgacatgtggggattatgggtatgacagttcaagatgagatttgggtggggccacaaagcctaaccatattaggaacatatgttggcatgcaagcttctgtgagtgtggacaagtatggcctccctggccttgataactgacagttactgtgtgctccctagtgtgttgagggccacctcgaacctcacaacagctcttaggggaaaggtactctcatctgcccattttacaggtgaggacatttaaggctgagctaggtgaaacaatgaacctgagatcatactgcttataattggtggtgtcaaaatttgaacccaggattttagggccctggttttcatccatagttctgtggcctagtgtctcttagtttttttgatgttggtggtgatacatcaaggaaatttgccggtgtgttttcccatcacttttatcaaccagggtgagatagagagaactgctgctgctgcgtatttgttgcttttcatagccaagctcatcctgtctctgtattatagaagaattagctttttctattctggatggacccagggccagattgtccatgacccttaactctcagctttccaccctctctgttagtttctttcaccaagacgttacttggtcatgccaccatgacactgaccttggttagcagccaggtcctccatggagtgtgtggaatcacattaatcatatttgtacttaacatacatgagtcatggcttttgagggtgcttttaattgactataaatcaagcaaggaacttgaaaaatgaaggcaattaatgaaaaagcatgtgagaggtgttttgcatcctaagggaggaaatacactgtcagtgaatttaatgtcacaacaaaggctcttttgaccctgctgaaaagatttcatgtggatagtaataaatggatgaactttgcagcctcacaggtggagaattgcctgtttcctgagttcaagctgacttaggcttttatctgtctacattctctatcttgagaacttcctagattcttttacttttgctttcatttcttgtgatttttaaaaataacaatgataattcttttcccattttctggtcattcttcacacatcctttacatattttatacaagcttgtatttactttcaggttgggagactgattaattgattagtgaggttatgtaacgtcccctgaactgcagtctggacagagctggacaaggttggggtttcaagtagtatatttgttttaatctgttgcgatgtgccaaggaaaattattctggtattgcctaattcactctatcattatgaagttgacgatacatcgggtcagaatgtggactcctatttacattaataagagtttttcctatatttaaacagagctcagtagaaatgttatgctttcacaggttttcccttccctcctaccaatccatttgtaacaatctagtagtaagtcaattaataatgattagaaacctcataaatgcattatcctacctaacaaatgtgaaatactataataaaatgacgtaagataagaaatgaacatatgtacacatcaaagacagatgtaacaaaatgtttagagatccttccattggacttgggtcctaacttgttctttaaagaatgggaaacacaagaagtaacagagtgagaaggacttctcagacgaggaacatgaacacaggtggagttcccttggcctaagttttcttatcagtagaatggaagagataaatagaccagaggtatcacactgtcagcctttgggctaaatttgcctcacagatacgtcctgtttggctgcttagtgtgagaatttgaggtgtttgataaaaggaatttgtcattaacatttagaatttcacctttagaaattcccaatttctgggtagtgttgcgtcttcagagcagacagagatgccacagttcagctgcctgggttcaaatctaaggccgatcctttaccaactaagtaactttggcaagttgggaaaaacaaaacaaaaaaactcactgtggttttattttctcatctggaaaattaatattataatggcagcaatctcaacagtctgttttgagggctaaatattaatctatgtgtgataactgctacattgtgtaattattatcattattatttgagatggagtctctccctgttacccaggctggagtgcagtggcgcaatctcaactcactgcaacctctgcctcctgggttcaagctattctcatgcctcagccttccgagtagctgggactacagaagtgcaccaccacgcctggctaatttttgtaattttaatagagcaaagttttgccatgttggccaggctggtcttgaactcctggcctcaaacgatcgtcctgattcgacctcccaaaggactgggttaggtgtgaaccactgcgctcagcgggaattttttttttttttctttttaaacacaagtcaagtgtagtagtgagaagtgcggaaggggtagaacaaggagtttgatatgtaactttatccttattaaaataccaatgaaattatttacagaaaaagaaaaaaaattctaaaatttatacagaaccccaaaagacccagaacagcagaagccatcttgagcaaaaagaacaaaattagagttatcacgttatctgacttacagttgtactacaaagctatagtaactaaaacagtgtgatactggcataaaaacagatgcatagaccaatgggacagaatagctaacccagaaatctatgcatttacagtgaactcatttttgacaaaggtgccaagaacataccttggggaaaggacagtcttttcaataaatgctgctgggaaaactggatatccatatgcagaagaatgataatagagccctatctcttgccatatacaaaaagcaaatcaaaatgaattaaagacttaaatctaagaactgaaactctgaaacgactacatgaaaacattgggggaaatactccaggacattggtcttggcaaagatttcttaagacctgagaagcatgggaaactgaaacaaaaatggacaaatgggatcgtaccaagttaaaaacttcctgcatagcaaaggaaacaatcaaaatcaagagacaacccacagaatgggagaaaatatttgagaaccacccgtttaatgagggattaatagccagaatatataaggaagtcaaacaactcaatagaaaaaaaaatctcattaaaaatgggcgaaagatatgaattgacgtttctcaaaggaagacaaatgggtaacaggtatatgaaaaaatgtccaacctcactaatcatcagagaaatgcaaaaaaatgtatatataaacatattctctccctgcagttaaaatggcttttatccaaaagacgggcaatcatgagtgctggtgagggggtggagaaaaggaaaccctcatacactgttggtgggaatgtaaattattacagccactatgcagaacactatggatggtccccaaaaaactaaaaatagaactactatatggcccaacagtcccactgctggatatatatctaaaagaaagggctggaagggtcctggggagggagaataaagtggggttggttaatgggtacacaaatacagctagaatgaataaaatctagtattttgtagcgtaatagggtaacaaaaattaataatttattatatattttacatacccaataagatgaaattggaatgtccctaacacaaagaaatgataaaggtctgaagtgatgaatactcaattactctgatttgattattacacatagtatatctgtatcaaaacatcataggtcccctctaaaaatatacaactattatgtacccataaaaatttaaattactttttaaaatattaatctatgtaaagggttttgaatagtagctgacctataatggtccctgaaatattagctgtcagaaacagcatagggatgattgtagctgaaagcttgctatggccctccaatatttatctttctgatatccagtaggcttcctagttaactctgcctgtcccacatgggcatctaaattcaccttcaggaagtcactattactcctaagactgttcatggagtcaaatgatgttccatagaagacaaaaccatcttgaagtttttgatgctgtcttgtttctgtcatatcagtaacactattgacaatacctgctattcactatcaaggaagcagaatacagtgctaaggggtgagaggacatgggctggctggtgttgatcaaagactttgaaatctgttttcagtgttttgaattgttgatacaggtaatgtatgaaaagggaaccatgtggtcagacagggtggctggctttctggaagttcagaataggaggaaggtgaaaaggatgagtgggcatggctcaggctgccatggagccatttcagaagtcctgagatggggacagtttgtatgtatatcagaggagagatcaacaagggagataggagtgttattggggagcacttgaacatgaaataagtgaaaggagagccccagggagatccaagggttgacactaacaggcatctaaaagaggttttccgaaagagaagcagaatcactggagtctaatcccagctctaactttgacttgcatgacagttttcctccctggacctttgtttttctcatttgtataatgagagcttgtgagttgggctgttttgactgtaatcaacagtaacacaactccaactagcctcagcaaaaacatataaaattatcagctcacatgattgaaaatttcacagtgtgagttggctttggaaacacttggatctagatgcattaatgatatcctcaatatcacccttcatcccccagctttgctttctataatattgatctcaatcttcactctcagagggtttccctccaagatggccaccagcaattccagtcttttattcttctagctaaaagagccagagcatctgttttcccagtgttccagcaaatatctcaaggctgaccgtccttggaccaacttggtttacgtgcttatccctaagccagttattatatccaagaaaattctgtacttctcttagccaggcctggggaaatggagatgaaattccctcaaggaaggaaatgatgctgggctggcaaaagtcagacagtccgttctaagggtattgtgctctgttgctaaggtcccattaagtactaacgtcttatgaccgcagactgtgccccaagcctgagaatttttagaacccagcatacacacaaatggaaatgttttttaggtggcaggggataaggacagccatcacaccaggtttcttgctggtgatgctggtgagcagattgcttaattaagactatcaaattctaagtgctgccatatggcctcactcttcaacctgttgagtgtcttcactcacttggttctggagctggtataaatctgtttcatttctgtttttctttaaggaattaagaatacaggaacatacggatgttacaggagcatctcctaatttaaggtattagaactacataaactgggctgctttaataagtaaggcatcaaaatataaattgggaaagattaagcatagctttaaataggctgagaaagcagaagttcttattattctgttacagatcaaatctacacacattctagtaatagaggtgccctctatttgttcttttcaccttaatgttgatggaaatttttttggcttgagagcaaaagggcaagaggtacaaatgcttgccagtcaaaatatccccaaggacttctgcatttgacaaaattcattctccttctggagatagaaatagggaatggaaaaggaaaagatgtatattgagtccctaccactcatttagccaactatagaagaaacactgaatgatcacctagtttttgccagaccctgtgctaagtataagggataaagctttgaatcagataaaaaatgtgcctcctgctgtggagctttgatgatatcagagagagaaaaaggcaaacatgatataataaacccttgagaacacaggaaaacggcacatgacaagacgatggttaagtatcatgaaggaaataaggcaaggtcatatgatagagatttctgcatggctgctgaagaatgggtggtcaaagaagatttttctaagaagccaagtcctaaactatgagaagaatccagtgaggtaaaaatcaatggtataaacacttaggctgagggagtaactcatgtcaaagccctaaaatgagagtgggttcttcagtttgagatactgtgatccaggaggagggctgtcatttgatacatttaatcatctcaaatgtcttgcaaataggattataaactctatgttatagataggggtataaagattgactaaagagcccaagatctcactaaaaagtgtcagtggtgttacaatcctctgactccaaaccccattatctttccatatggaatgctgtagctggtgttggagtcttctttcacagtaaagtgctcctgtcattgcctctgagaacagactggggtgtccttgatagtttcacaggacagtggtgtgggctcctaggttatattgcctgtctctgtcactcacaatgggtggtgtttttaagctacccaaacttccagctcctaatttttctcatctgtgaaatggagatagtatttcaaggattaaacaagatagcacatacaaaggagtgacagcagtgcctgctacatgcaatatttttattttaaaaagttggttggttttatcctttaaaagaataaggctggggtgggaaatctctgtgggatgatgctgtttgaatgggtagtgctggatgcccaccaaagatgacccacgaaattttcaatatagcttggctcctctgaaagagagcatattttcttcctacttcttctgagactctcttttaagtattttcatgttctagggatacttgttctcccccacccctgaccacttctcactcatgcttggtctctttgagctaaatgttaaaaacatactctatgaaaaatatttgagaaattagtactcccaattttaggtccagatgtgttctggaatttagaaagataataagatgcacacattgtattacacgattctacgagcggggtctcgggcagctccctgtattaaaacaggttggcatttcaatagtaaaacatatgaatgtttaccctcagtaggataaataaggaccacaaataacatcatgtcagttcaggttgggttttgctgccaaatgagttataaaaacatgtttggtatgctgagtctcttggatttcagaattgcagattgcagtccttagaacattcccgtgaaaagttgcaaaccttagtcgtgctaagatgttgagttggcgtcttcacatcccggccacttctgggagcagcagagtgtggtggctcagcccacccctcaacccctctactacttgtgaacaccttggtaaatgatgtcttggcaggccacccccgagaagtggccaagtgctgcaccagcttttttcttttccatttgaagccaaaacgattgtcagcgatccaggcttctcttaactgtgcctgtcagctgattctgaagacctcccagaggatctatttttagctaaaactggttttaaattttcatatgtatacattaaattccatagaggaaggggggattccaaatgaggaaacattgattctgaataacataaaagaaataagcagtgcttgaaaaacagttcaaaatatgagtcaaaacctcccaggaatatggttagcactgcatttttccatggaaggaagtctgttgaattgaaaacagaatgagagtaagtggggataaattatactaagaaagagactcagcatgaaattctaggtactgaagaggggaaggagaataagaatagggaggactgaacttagagggcagttgggattgccagatggatactcatggggatgtgtggccaggtaatcaaatcgcattgtccaaaagggacatggaggccatgggctaggaccaggcttttggccatactcaagagggagagagaagatacacctcccaaataaaggcctggagtctgcacatgacagctttgattatgcttccaaggttttgttcatttttggggcatgaccaaggtagttctagaatgagtgaggccaaagctgaaagtgtcacaaagtttttgcgtatgacaaaagttgcctgctttgcttttggatgctcaactcagacttcttgttttcatgatgtgcagttttgatcaggacattttagtgataggtatagcctacttctgtaccaaaggagaggttggattatctgttgaaaagcgttttgttggctataattacaatatgatgacttagttaggattctgataaatcctgactaactcaagactttaaagaaagatacttaattaaaatagaaggaagttgcatagtcacaggttcatccaaagacctgaatgacaaggtctcagaaaggacagaaactagagaagttccatgggcttaagcaatgggaactcatagaattaggacagtgcttttcaaacttttacagtgaatgacgatatttgtttcattttgttttgttttaatgtgtcacagtaacatacttttgttaaagaaaaatgtcaaatatagttttcaaaaagtttaaaacatgactcacattcatatctaaagtgaacacatcaaagattttatctatctcaacaatgcaaaaggggaccaataaaatgataagtatgattcaaagagcattcgagaaactagctatttgcatgcaatttaatagtaaaggagtgttagaataagtttgctaggttacatacgaagctggttaatgtcctgtattagtctgttttcacactgctgatacagacatacccgagactgggcaatttacaaaagaaaggtttattggacttacagttccacatgagtggggaggcctcacaatcatggtggaaggtaaaaagcatggaggagcaagttacgtcttacatggatggtggcaaaaagagaatttgtgcaggggaactcctctttttaaaatcatcagctctcatgagactcattcactatcacgagaacagtacaggaaagacccatctccataattcagtcacttcctaccggtccctcccatgacatgtaaatagtgggagttacaattcaagatgagatttgggtggggagacagctaaaccatatcatgtcctacaggacaaaaaactgtaacctctgtggttatcttttctacccatcattacttgtatctctgccagacagaaatctgtgaattaacatgtaatgttgttaagcctgaaaccatcattgagtagtgaatagtacattttcctagataattaaataatctttgaattgacaagttaatgcctgtatacgacattgaaagaacatgcaacccacatttttgtcttattttcaagttttgaaccttttttcttagtaatataatgaaaatcaagttttgtaaaattaaataaatccaaagacataaaaggtaagcttttaaaaaaatagatggaacaggtataacattactatgtcacattgctttcaacttctgtactcgtcatgggcccctaacaagaggttgggcattggtctgtggaccacacatttagtgttaagataggaataacttaactccaaataccttccagtttgggatgtctttattcaaattcctggtagagaagctgattggcctggcattgggtcaagagcccactttgtggtctagcagacaggtatcatgtttggaagcccattccctaaactagggactgtaaacaaacaaaaatcagaagcatccatacagttactgagtttggagaggtagcccaaacaaggggaggacttgggcagtgctgagctctgaccatagaaaaaaagtatctgggaactatctcaagcgtcatttaggctcccccatttcaagcatgcacccaaacagctcatatactatacagtaaatacaacttctcaaagtagaagataactggtgttaaaacaagactacatttatgagaactcacttccataagggcaaatactaccttaacagaatctcagcaacattccagaagatggaagtcagaatagatatttatagggcttgtagggagggtatagcctcaagcaatttaagataggaagatgattggtattgggtaaattcatgacatcttgatttaagattgttagacatagcaagatgagtttactgaaataagtctgacaagtaggttattgtttgatagatgagctatttatctagctaaggagactgttgtcccagataaattgatatgcatggattgtccaaatgaagcagtgaaattgttcctggtttagagccttatgtttcgtggacaaaggtttctgtgaacaattaagtcaggttgacgaaggtgatctcagttgttggtcttaagcactacgccatgttgatttaggtggtctgaattctcaggacatggtagttcacatttgttccatgttagcatttcccaaacttctgtctgtggaacactattctgcagagtggtaacagcaatgcaatggggggaaacatattttgaagttaagtaagtttgggaaattctgttttgttttttaatttaaactgtaggccctctcaagtctttatgatgtgaaaatgcacagtaaatattccagaaagcatgcaaaaataccccagaatctaactcctttccagtctgaagagctcctcaaatctctcctaaagttacttgctttacacacagccacctctattcatttttttttttttaaatttccagtagccagtgtaacctgggggccagggaagacctgaacctctaggactcaaaccctgtcatgattcttgaggagagaggaaggtggaaatacatacatacacatagacacacacacacacacacacacacacacacacacacatatacacacacacacactctatatatgtatatatattctcattctgctaaactaatcgaaagtaagatatagtaaaatgtttgaaaatacatatgtgcagctttgaaatgtcttcccatatcataatggctgtggaatcagcctcagaagccagattgtctgagccccaaggaaacgtcaaacccctctccctctccagtagcattccccagtctgtgtcacttagacgaaaaggatctcagggtgggtggcaatgctccttcactgaaatctgcagttatctctacccaaggcttacagtaaattttttgcaaattagaaagccctttgctctctcagtaaaccctggctttcaagatttttgttttagtaaagtctttagactaaatgttgaatctttcactctctttgctcctaatcatctctaagacagcaaatgcctctagcaaaaaagaggagacgtcaactgggaaaatttgaagagaaagtcacacagatacatttcagtaaggttgtctctgttacttgaggcttacaagaaggaaagaattccctctctaaacacactctaaacacacaggagttgagaacggggagatttattccagaaccccttctgtgcgttggggcttctggtagcttgcctttcttggtaacgattttctcagagactgggtagattcgagtggagcctggggcatggttgttggtccaatggcgggggttggggagacacaagcagttggcagggaacttacaaatctccaggaggttattgagaataaaaattcagatattgccatcttttccatttcaaagcaccaagagtctgtcatcagcaattgtgcctttctaggtgtcacctgaatatctaacattgaggcattgaaagatagatcaggactgattttactgagcattttcaaaggcagcaggcaggcttttcaatgctgcatgagatcctcaccttctctgaggtgacaggggcttctgttttcttgagtttccctgtttgctgatgtcatcccctcctaccccatgaccatgacaccaactacatccatgatgtatatttccaatgtgtttcaacttatggtcagctcccaccagctccatattctggtgggataagcaagccttgccttgagctttgcaggctgggcccatggttgtggacatcacagctctggtcctcatagtattggtggcaggcagatgcccagctctggcacctgaatgcttggatttggatgccagctctaatacttactagctctgtaacctagaaaaagctccttagcttctctgcactttaggtttcttttttaaggaacactgaaggaaaatctgaggctggtacagtctctgcttggcaaatggtggttatttctatccattaatgtcatctgatcatggcccctcaaacctcactttgagccttgtgagcaaatgatacatactgtttatatatatattttcctatatatgtagaaaaatatatattaaataaatataaaatatataatttaattaaatatatttaatatatatttatagtatattaatatttaatatatactatataatatatacatatattgtatattttatatacaatattatatattatatttatatgtaattgtatatttatacataatataaaatatctattatatgttacatatatttagatataatatattttacataaattataatatataataatataaccagtatgtttcattatatataatatatagatacatactgattatatatgagtatataacatatttacatgatatataatatataagtatataaaatatgaatatatattatataatttataaatatatataaattatgcaaattatatttgtgaatatataatagatttatctaaatatatgttatatttagctatagaaatatatattatatatttagatattatagaaatatataatatatattataacatcagtatgtatcattatatatagatccatacagattatatattaatatataatagattatattaatagatcatatataatcatataatggattaatagattatatatactatttatgtaatcagtatgtatatatattatttcaaacctcactttgagccatgtgagcaaatgatacatactgatcatacctactgatcagtgtatatttcagtctctttgtatcgccctatatattttccactttgcaatgagaggcctttgcttctcaagtgcagcgtcctcatgcttctcccacctgaacaaattattaaccctgtaaaccggctttcagcaagctacgtggatgaggggtctgaaggtttttagtttcttattagactgtctctcgtttcacttacatggtacccgctgggttgattgcttcatatatcggtggtactaatgtggatattgaatgtttcacctgccgagggccttcatctaattcatactgagcacatagaaaggtgatttgaatgggggcatttgctctgttattttggtgatggatttagggaaatggaaagtagcaaattgctttgtttttggacctttgccaggtccatcctggttatggataatacttgcttggttgattgaagaaggccagctgctactctaatagcccaagtcaatggccaacggtgcctgattagcaagcctgctatgcttactgtagtgaaaaacatcttataattataaattaataccctttctattatacatcaatatgctggtatatttcataagttggccagcccttcatgactaatattgatattaaggtcaactctagttttatgataccaaggcaaagaacatctttaagaaaatttagatacaactcctgactttgaatgagggaattcatactgagaacctcagtgttaccatttgtaaatcagattaaataatgcccaacatctggggctttgaaaaccaatgggataaactttgtgagaacaatttttaaagcctttagacattaccccgtggtgtctagtgtctcttcatattttcctctgggtttatcttgaccctttcaaatggaatgcgtggatgccattagtatttataacattcattttcagtgctttagtattgtttttttctttattgttgtgtaatatgtatggaaaaggcatatagcaaagggtgatcaatggctgggcttatcctaatctttgtgcatgtgcttgggtgtgtagaggcttccgttcgtgtctctgggccatcttgcataggggttcaagctcccatttggatgccatgggttgaagtctccggaaagctgacctcagatgaggattggtgtgtaggaagtttattagggagtattctgggggtcatctgctgtgggagggaggggaagaaagctggagtctgacagtcttatcaaaggctcagtcaatatcacagggactctgaagccaggatggctgttcacaatggtcctgagttggggcaagggagccaagcctgtataactccattacaatctgtttttggatgtgggctgtgggaaggagccatgaccttagaggaaaagactgtctttagccaaggtaacccatagaggactgacaggtgaaggctgtctgcagaacctgggaaacatagtccttccgtcctgaaaaggaatacaacaggcacattacagaattcactacagtcatctagaaaacaaagccatctggtatccatggagacagcttccatagtcactattgcccttggagacagacacccacattcctagtgtggttgcctgacagtggtgaggaggagggggctgactatctgagtgtccccctgcgatacgatagcatgtcacctggttcatgacccccacacccaggtctctttccagagctcacccctttttgaggctggcaccaccctggacccaccaccagcttctgtggcagtgcttactctgctgtttaacctgcagtactaattcctgtctttcaagaactctgtctttcaagttccccattattaactttaatgtatgattatttatgtgtatctattcatgcatctatgtttttattaatttaggtatgagtgagtcctcagctcagtctgattcacatcagagcttttttaaaaaaataaatatcaggaatttttagagcatgtaaattatgattcaattcacacttgtctttttatgagttactgccatggtgtgaataaagcacacaagtgtcacaaagatattaacataataataagcattaatctccactagtagagtgttactaggcagggttccttccagctgccatatcaggaatccttccagcctgggtactaatgtcatcttcctttggagaccaggcatgaagagtcactcacttcctgaagtcactgggactgaaatccaggcagtctggctctagtctccaactccgctgccaatgaccaccagcattgcaaacccgtacacatgcgtatcaggcagacctggccgctggcaggcaagctaaccagctgtgaaccatggtcaccgctgcagggtagggctcgatgatcagaatgtgttccttcatttcttaaccatgctggaaaaagtatgtagagggactaagggtgtttttattttctttggcttttttccttccttccctcccttcctatcacccttccttctttccgttctccctttttccctctctctctccctttcttccttccttttagaaaaaacaaacctaacagtatgtatgtctaatacatacaaaatctggtatttaattttaaaaatttattcatacgcttggtaagatttttaccaagccatttggttttttattcactctctctgatgtggatcatgcctattctccttcttgggatattaggagaaaaaaaggatactatgattttcttaaaatggagctgtttaaatgaaggaagcatgtataagcctacccctttaatgggagggttcaataaatcctagaatttgcctgtaatgtgtagaggtctaaagagatttgtcctatgagaaagttcactaatttcaattatctgggttttattatcaccttctaagggttagagagacaggattttatagaatgccatcacctgaggctgtgacaatggggtttcacaccattaaattcagaaagcataagagaagagataagaaatgagagggcttgaagtgcatgccagttccgttgtggaaaatatgacctactaagcagctatgagaaatgaaagcaggcagtgtcatctcatgatctattgctattgtatgtgaaatgctttctatattagctgttgttaattaccatcatccccaccatcacatcattgtatttaatagcaggagaaaggaagcagctgttgtaggcaaagctctcacacttgagtgtctatcagagtcacctgggggaacgtgtgcaaatgcagattgccaggccctttgcctagtggttcacaatgagtatgatcaggctggaacacaggaatctgcatgttttccatcgactatctcagctgattctgattcaggtggtatgaggattacactgaaatagcaaacccatgctttgtctcctgttagtctagacagtaggcatctttctgttacctcttgggtgtaatgtttagtttaaatttcagttcctcatctctacgagggagtcataaatttgcatcttgctcacagagctgctgtgaggattagctgagctcgtgcccagaatggagcagcctctaatatttgctgtgctgtctctagagagcaacagggaggcatttcatggtcttccccatcttggtcctcactgtatctttctgtccttactctgtgcctgggacagctttagggcttaatgaacataacagaatgctgaagagctcagccactggagcccagctgcttggatgcaaatcttggctctccaacttaatgcctgttcatgagcaagttatttaacctcctagtacctcagtttcctcctctgtaaaatgggcttgattatcatacccccatcataggtgtttttttttgggtgtatgagatgaattattatgactacaacacttaaaaccaataatgaagtgccatgtagatgttcattaggtgaataaatacaaatattgttgattgaatgcatgtctgcatgcacgctgtttctttccttatgctgtttctttccaacataatacagatgtattctactagctgacagacttttaaagtagaggccacttttaaaagcctgggctcccatgagaaggaaatctgcaggtataagatgggtttgtcagtcagcagaggcatgctattgagaaaaggaggcaacctggggagggggtgttagaagagagcttgggattcagttcttctaaccaggagagctgacaagtaacaaaatgagactccttctgttgtctgttgcagtagacaaagcaagatgcttagttaacagcagcaacccagtgcctgtaattttcaagtccttggaggcacaccatgtcacccaaggtaagccaggggacacaggagggaagcaagagaagccagggagaatctatttcctgtgtcccctgtaggtgtttgactcacctaaagttaacactaatagaacatttgctcagaaatgtcatcgctgaaataaacgtgttaaatttaaacttgactgccccaattcatctgttatgcaattgaactggaaacagctcagacttaaaaggcatctccaagtttttctcagccaacaagacttaggccactttgttttctcagatttttcagccttgtccaatttttggataaaaatcctttttgaaaacttcagcagccatattattttcttctccagtcatcaacttataacgtaaagacaaagctgtggggaaaatctaaagttgcgtcaaatttttattttctagccagctacagctctagtctaaagctctttcttttggggagaaaatcccatttgcacatttcctcttagttgggtggacttacccatatatacttgggtgacattcaggaggctactttgtgttttggctgtgtattctaatttttcttccggtactatatacagcaagagaaggggatgttgttcagctcttgttctacctagaacccaactgcacttttgcaagagatggatacaaagatggatgcataatgcatgatagtatattatgagcactactcttatggctttgcattgtaagtaattttaatgtaaaacatatttctatagtctggttacaaaaacaaaacattttagaaaatttggtcattctcctgaaaacagcaaaaagaagaaaaaaaatcataaaagatctgctgaaaaataatcagttttatgttttttctttcatgacagcttcatccatctatccacctatccattcttgtagctctccatccacccacccatctatatacacctcccacccccccacccactcattcattcatccacctacccatccatccatccacccatccatccatccatccacccatccatctatccattcatccatccatccatccatccatccagccatccatccattcacttatcctgccttgcatcctaccttctatccatctgtccttctaccttttcttctatctatctgtatattctttaatctatccatccattcatcctgggaagaaataatagtatctttaaaatgtagtgcattggttacaagcacaagatcttcagtgaatcattttgtgcattcaaattctgtctgtatgtatcatgcactttctatgtaaccttgggcacgtttttatgcttctatggccttttcagtctttaaaaaatggggttaataatagtgcctacctcatagggttatgtcaggatttaatgatataatccatataagatacttgacaaagtgcctggcatagaggaagttctcagtaaatattagctgtctttatcattattatcctcttgctaacttaacagagttttcaagatctggtgagaaaacatgtaaaagatacataatataatgtctattaaaattataattataaatgcagtcataaatatacacatgtatatttcatttatgttactgatatccatctgtttcatcagctcattttaaaggtttctttaatagctgaaaaatattctgtagtacaaatatttataatcaaactgttatagctattcatttagactatatcaaatttctgttgttattaataatgctgcagtgaacatccttattcagttatttccttagattaagttttcagaagtgaaattggtggttacagagtgtacacattgcaaagctgaatcatattgccacagtgcctggtgtttgcatttccatatggttttgatggccaggttttctgcactattgccagtgtatgtgttatcactgcaaacgtttgccatttcggtagacaaacatgggatgttattgctattttattaacttgtttttatttgatcaccagcaaagttaaactttgccatgtgttttttgaccatattcatttctgtttcttaaaattatcaacttagaatatttgtgcaattttttttttttacatgtggagcttgttcttaatgattctgccagggcttaaaatttttactttctaatgagaaagttttggaatttactcttttccaatttatgaaaattggacaccggctccatgcactgttctaagcctttttctgtgttctctgtgattccttagagcttactaactgtgaccctccagtcaaaaccatgtttaaccaagtgctgatgggcttgagtccattcccaagtgactcggaagttgcttacttccctacctttgagtgggtctcattttatctccgtgatgttttccttgtccttctaagtcatattcactctgctcattgaagaaaaatggttggtaattgtagtggataactactccattctgtatgccttctatgtcttttcttgatgtgtgcacctctttctttatccttatttttaaacttgtgcttattagataggtttctgtacaaccatatctgtgtaggtttctcaccctagaagcctccttttaaatagggcaaagaagctacctaaagatttctctttaatatagggaggaaaccactttcgaacttgtgcccaaagatttatcttcaccaatggtctaggacagaggtcggaaaacttttactgtaaagggccaaataatacatactttcagctttgcaggccagctggcctgtgttgtgactactacacaaaagtagtaagagtctaatttggcccaggagtttgctgattcctggtctaaatgagagtaaagaatgggaaagggaatggtgtgggaggaataggcattttcattcattgttgttaatgagaaagagtcttcaaacaccagcatgcccctgtgggttggattaggttagaaaatccttggaggactgccttttccaccccagagtcctggagagaagaatgcagcctgacaggaaggatctgggtaggtgacatgtggggagaggattaaaagaaaggagggccagtggctcacgcctgtaatcccagcgctttgggaggccaaggtgggcagatcacgtgaggtcaggagttcgagacgagtctggccaacgtggtgaaacctcatctctattaaaaatacaaaaattagctgggcgtggtggtgcacacctgtagtcccagctactctggagtctgaggcaggagaattgcttgaaccctgcggatgagaggttgcagtgatctgagctcgcaccactgcactctagcctgggtaacagagtgagactccgtctcagaaaaaaaaagaaaggagaagagtgtctcaagggtttttttttccagcaggtgaacccagcctccctagcaacccaaggttaagaacgtgttgaaaacagcatggaagcccattctggaaagcagtggtgattgtgattctgaacttaaacagcttcccttaaacacactgttacttcagaaaagtacggttttggccaaagggctgtatgtcaggtatttacttgctcatcttggtgggttttgtttgtttttgtctttttggttagccatctaagacattatttttctgagatccaagttccaaaaagcaccgaacaaccttttgggaagaaaacatacatagtgtgtaggtgctaccgatttgtatcctctatgaccttgccatagaaaggcaaatcagacgggcgctcccattgcctcattgcaggctgccattttcatataagcttcatgaaatctgggagaataaaggcaaaaggtttgatctggctgtgacagggaatattgtgaagctgctggactgggcctgtgggttgcctgtgactgtcatcaagttcttcttctctggaggcttcaaattcctcctctgtcaaatgaagggactggactagaaacagaatggcaagtacagggcaaatgccccagtgctctctgtccctgctgcctctggcagccacttctgctcccccacagcatctcctggtcgcctggacagaaagcctcctccatgcagcactgctccaggaactgttctcagccattaaagcagggttcagaaaagcttggaggaagatggccttgtagacctcccctagcactgaagttctgtgatgcttagcatatgtgaaactcaagtttcttctgttcctgaatggggattatttattgccttggacagcagccctgaaacttgatccatttagctgcccctaagtgtagttaagccccgtgaaatgtaaacttcgcaagtaaatggaccattgccatttgcctctgtcttctagatgcaattgttttctatagtctgtcttgtggccggttataaaatgtctgtcttgagcaagctggggaggagggtggatagctttcgatttgcccaagtttgttaatgtttcattgcttggggtgttttaagatcctgtgcctttaatagatttcctgaactaacagtttgccttatttacttccctgggctataatcattattgtggctgaccatgttgataagctactctgtgaagccttctctaatgaatgagagtcactcttcaagtggttattccccttaaccttattttcaatcacagaaaatcattctcacagaaagtattctttccttttgttcaaaaaatacccccttgaatgttttaaatgtcactgttttttcagttctaaataatttttaattggtttttacatgaagttaactgtagcactcttgattcaggaaaattgtgcttgtctgtctctctattatctctctctctctctctctctctacctacctacctatctaccaaccaaccaacctatctaaaatctatctataatctattagtttttcttgcttcacaaatgacttaaggcaactcgctttcgggttgatggaagaaaaaatacaagtagcaaacttggatgaagttggaagaaacttggcacccactgtgtctggcatgtgcagatatgagtgatggtctataaatttaggatcttattaacagccaaagcaaagagtacaatttttccatgtatctggtttatagtatccacaggatacaagcatgctggttgatcaaatgttgcatctatatctttgtgattaacacctgacagatatttctatgatgcgttctgacagggttacacatgacagagttggctctgtctatgttgtacttaatattattgtagaaagaaaaattgagtatatcttgtgaaaaatagttccatttgaaagtccatttctttcaaattcaaagaaagaaaacaactaaaatacgtaagtctaaagggcatggttgatttaggattttcgagtgggaagactattaaaagagatgcttgctcaagagagtatagactcttctttggaaattggcatgggccacagacctccataggtaatacatttaaaacacaaatgctttttggggtactgtctcccagtactttgtttttgaagatttgtgactacatggtttcagtgctatatctaataaaactggcttcaaaacgcagagcactagcattttcatatgtttcagtaagtctcccagccttcgtgattctagagacaccaatcagttgatgctagctgcagttgctagagattccttcctggaattttgatgtaggcttgtaaggagggaccatacttaacatggaaaattaatgacctgagagcctgtcccaaaagaaatgctccaggcaggagatcttcaacaatagccatctagagtttcagttatctaggatagaacagtgtataggctggaaagacccagccctttcagtaaggcatgtgagtttgatcactcaccaccatctccagcctcagccttcttggaaggccccagacttaatggtcatttccaaccctctttaaaaacgattcctttgctagagtcggaataaataattgaggcaggcttctccagaatctcattggtgtcagctatggagtcatcaacagatgaaattattccatcaggatagtaaattaaatggcagtcttagagtggagttttcaaggtcttcttacatttgtaacatttgttgtcctacatagtcttcatacaaactataaattgagcatgagagacattctttttttttttttttttccaagactaacttttgctctgtagcccaggctagagtgcaatggcatgatcttggctcactgcaacctccgcctcccaggttcaagcaattatcctgcctcagcctcccgaatagctgagattatatgcatgcaccaccacgcccagctaatttttgtatctttagtggagacagcattttaccgtgttggccaggctggtcttgaactcctgacctccagtgatctgcccaccgcagcctcccaaagtgctgggattacaggcgtgagccactgtgcctggccggcagcaattcttttatatacttggagggtaggcacttgaagcccagaaaggctaaaagactaggacattaagtcatagaggagggtttttttttttttttttaagttttgttgttggtcgtgatggtgttattcaattcttttattatctcagaactcatgtcatactgccccagcctctgtatcagcattatgtagcaatgatgttactgagcctgatctctgtaagaggctctgaataaaatgagttccatgctggaacttatgtggagaatctatgttctgtatctctcccttggggactcttaatttcctgggtagtgaagaggtcctctaagaaagaagcagatttcgtggaacccaggatttcccatcctctttttatctgcactgcattttaggagcttttaaatttctgttctggagttgggcatctcttcaaggttaagactcaagggctgtttgtattcctcttggatttgcctacatttagcaaagcagaaactcaacacattgttgaaaatactgaatttcactgggcatatattttgggttgtctggaagatcccacctattgagtacactgcaccatcacccctccaactgctcatgcacttatcggacatatgttgttatttttggatcagaaaataccatcccagtagaagtaggagtgatcagtgtgacagagagctgtctgtattgcggctgtaaatgccagtgaccatggcattgagcagaccataggttatacttactgtcgtggttctcacctaaagtacacatcacactttgggtttccataggaccaggcaacataatgacccacctgaagatgaaatgattttgaaataccaggcccttatcatgggctagggacagtgtggacattcatatatgtgaatgctccttaaagcttccctataaccttggatactgctggtcacgtgtcccttaaatatagatgaggaaattacagctctgagacaattgttgttggtcagtatccttttgatcctttgtttgtaaatcttgcccagttggggctgcatgaggttgaaagctcagactgcttcacttccaacctcagctcgtccctttatgaagggaggcagctcaactgcctcccttccaacctcagctcatccctttatgagctcatagccttgggcaaattacttaacctgttggtgttcagtttcctcatatgtgaaatgaaaatgatggtatcatttcctcctaatgctgacttgaggattaaatgagttaacacacataacgcttaggatggtggtggacgtacaaaacactcaataagaatttgcttttgttattattacttgttcacatctatgcagcatttgtgcctgcatgctcacacactctagtcttacgcagcttattcaccaacattggttcgggatgacatttgactgttttcaaaagtcaaatccacttttcatggacaaagattttccttcataagtgttattcaaaagattgtgctgtctgccctgaaaacagttcttatggaggagaccaaaagtatttttggtaaatgacagtctgtgtagagtgagtcatgtcactagatgtgtacttggaagggcaaaacagttatttcaatgtacaaattattgcctcattactttatcacataccagaagagagtttgggatggatctaagaagtataacaaaaccactgcaagttgttctgtcatttagcatttaattaaaaataactagagaaacaactatttgaaatgctcagtgtttttcttctttttttttcatgtaacaatatgtttagtgaatttttcaaattactaaaagcattcaggcagttctagaaatttgcatcttgtaaccctttagttgtttttatttagaatgttggcattttacagtagtgtcaagtatggtaattatttttcatagatattgaatttaaaagagtaatccctaaacacattttgacatttggctctccaagacaaagtttgtaaaaaaattgtgacctgtgaacggtaactttactatatacttgtttgaccattatctaagaaatatgcctttaatgaataagagggaaaaagatgaggtcagacatcaaagtccctgtaattctaatgtgaacaaccatgattcctgaattccatgtaaattagcactacagaatgaaagcaaacaaacaagcaaacctcaaacagagaaacctcaaaattactagagccaattagatattcaaaggaaaagtctcagtttttaataccttataaaatcacacaaatacatacacatatgtgttggcatcagcagttttgatagacatggcttaaaataggagaaatccaaaaatagataaaggcacttttaatatggcctaagccatagcaggaagtattaataacatgccgattttttactccaaaaagaactgagtgtgcaaagcaaaccaagaaagaaatgtggactgggccaactaatgggtttctaatcattgttaatctacaagtgtgatcagtttattataaagtgttaatttttcctgtgggtaatacttggagaaatacagtataccactcatttccaaagtgatgaaatggctttctgtttggcatgcaggaaagtgaacctctttagtttagaatatgggttggatatgcttgccaggtctgggctattccctgctgcctctgagcgaaagctcaggaagccagaacctgaatctcttcgaggaagttctacagctgacttttaatcattgggccatagcacaacacctattagctcgcttacgtctaggtcagtagaacctcctctggacctcagctactcttcccactctgcatctcgagacacttgccttctttccatgtgacttatcgctaagctcctgactgcatgaacctccttccttccactggtccaagtgacatcattcccccgtcctcactcccaataccaccacttcagtaacctcccacatgttttcctgctctactttaatccagtctacacagagagagcagccagccactatcctgttttatttatttatttttttacttccttaacagacgtttactggatatgtcctgaatcccagtcactgtgttaggaagtagctcaatccgttgtctgtacacctccatgcatccgttccttcattcaatgatgagtacataggacaggccagttttgttctccaggctggtctcgaactcctgggctcaagcaatccacctgtcttggccttccaaagagatgagattacaggtgtgagccactctgcccagctccagggcaggattaaaggattgttctcccatgttggaagaaaacagagttcaggccccaaggcaactgacattttactgggccagacagtgccttaacaataatagggcaggcgtggtggctcaagcctgtaatcccagcactttgagaggctgaggcgagtggatcacctgaagtcaagagttcgagaccagcctggccaaaatggtgaaacgtcatctctactaataatacaaaaattagccaggcatggtggcgtgcacctgtaaccccagctacttgggaggctgaggcaagagaatcgcttgaacccaggagacagaggttgcagtgagccaagattgtgccactgcactccagcctgggcaacacagcaaaacctccatctcaaaaaaagagaaaaagaaaacaataatataattcaggtagtgaaaacatcccagaaaaaaataaaataaaatagagacgatgggaagtaatgggaaggctgtagctagcatggccacggcaggccttcccagcagggcatttgagggagacagaaataaaatgagaggcaagtgacgtgaatatgtgtgagtgtgctctaaccagagaggaagactatggcgaaggccttggtgagtctgagaaatgccaagaaggaaggccaggctagggagtcgtgagcaaggtggcggatgggaaaggtggggacacagaggtagggaagggggatgatcttgtggggccttttatgccacggtaaggaggttggattgtatcagccatgatgttttccttcttcctgtcaaggtgaaatttatatgacgtagaatcactcattttaaggtgaacaattcagtggcatttagcgtatttgcagtgctttgcaatcaccacctctacctagttcaaaacattttcatcaccccaaaaggagagctcatactcattaagcagccgttctgcattcctctacctccagcccttgacatccaccaatactactttctgtctctaaaaatttaccttttttgatattaagaagaaaagacacccacacatatactcaattgtgtccttccctggcttgttaccctccctccttcatcacacttaggctcaaacacaaatttgccaccatcccctcatcatctggtccttttccatttctttagtctaacttcctgctagtcttttcttcactctttaagagtaaaggcccagactcactggttctcctcaagtggtgtgtttgttacaattgatgaacccacattgacacacaattaccaaccaaagatgccatgctttatatcagggttcactcttaatattatgcgctgtatgggttgggataaatgacatgcattcaccatcatagaaactttgaattatgtgaggtagtagatgatgaaacaaacattacatactaggaaagggacgcctctccctttttttttttttaaagaggggtgttttctgcttggttttgtccattataaactgttagattaaccatttgtacagccaatgaaatagctttaagggaggcactcaggagcttgaacacgtccacagaaattccaaggtctctccagtatcaacttgcagtacgtcaagccagtacacatgggagagccttgaaggggtacaagatcagcctcccctctgctctttgaacacactgagcttgtggctgcctcaaagccttcgcaggcattatccctcttgcaaattttttcatgggtagtgcttcctgtcattcagttctcagatcaaacactacctctttaagagctcttcactgcctactttaaggcatcaccctgttttatgttgtttatataatatttcacaacctgacattctctcattcattcattcgtatcttacctgtttccctgtagaagtataggcttcatggtgagcaatagccttattttccttgttaacgggtgtatttccagcacttcttacaacactgccaggcatattgcagattgagatagtctgagtcttctgagaactaggattaggatttttttttttttttttttttttttttttttttgaaacaaggtcttcctctgtctcccaggctggagtgcagtggcgctatcacagcttattgcagtcttggcctcctggactcaagtaatcctcccacctctcatcctcctgagaagctgggactacaggggttccccactatgcctgggtaatttttgtattttttttttagagattgggttttgccatgttgttcaggctggtctcaaactcctgggctcaagcaatccgcctgccttggccttccaaagagatgggattacaggtgtgagccaaggtgcccagctccaggacaggattaaagtgtgaaaaaattattaggggatatacctgggagatcaaatgaggtgggagttgggagactggaagagctgtcagaccagatgcaggtctgactctcagtgaataagagacgaaagaaagaaagattgagtggaattattttagactgctgtgcaattcttttttttttttttttttttttttttttgagacggagtctcactttgtcacccaggctggagtgtagtggtgcagtctcggctcactgcaagctccgcctcccaggttcacagcattctcctgcctcagcctccccagtcgctgggactacaggtgcccgccatcacgcccagctaatttttttgtatttttagtagagatggggtttcatcatgttagccaggatggtctcagtatcctgacctcgtgatttcctgcctcggcctcccaaagtgctgggattacaggcatgagccaccgtgccctgccacactgctgtgcaattctaaagaattctgggagtgctgtcagagagtacttgagccaaagttgcccatcaaaaaagttttaaattcacaggagtgggtttgccttagcatagcttttgaactaagtaactggccagcagcagcatgtggaagcatgaccttggcaagaaatgtggccacagatatcagcacacagcagctggggtagctgatcaatgtacttccttcaatgagagatctgtgaggtgcatttccatggccaccacagagatgtataagaaatattagttcaatgaatgaataatgaataaatgaatgaatgaaagaattactccttcatgttatgtttataactggctcttcctccaggttttctgcctcacttttggctctctcagctactttattactgagaatttatctgtactgtctagttttacagcaacgctgggagctgctattatccatccccattttatagatgaggaaaataagcctccagataggttatgcaacttactcaaccaagctcaacaactaataaatgactcagctctgtcttctgaagttgacacttaaagcccatacccttagctattaatgctgtacattgccaatgcaaggtggataaagacgtggagaaatactctgccctgctgagtagagtcctgaaactgcaaggggtggggaaatagcaatgaatcctaggcttaggccaggtaactaagatgtgcctttatgagtttatcttgatcatttctttattcattcatttatcattggccatttattcattgttcactagtcggcaaacatttatcaaactcctttgcatgccagtccatggactaagtgttaatctttatgcctctgatgcttatcatctgcaccgtccaatacagtaagccacgtggagctattgagcacttgaaatacagttggcctcaattgagatgtgttgtgaatataaaacatatacagttctcaaagagtgaataaagaaaaaattatttttaaaatctcatgaatagtttttatactgattacatattaaaatgatagtttttggtcatataatgttaaacgaaacatattgttaaaattaattccacccatttctttttataattattaaggtgacattagacaattaaaaatgaacatggccgggcgtggtggctcattccagtaatctcagcattttgggaggccaaggtgggtggatcacccgagatcaggagtctgagaccagcctggccaacatcgtgaaaccccgtctctactaaaaatacaaaagttagccgggcatgctggcatgtgcctgtaattccggctactcaggaggtggagacaggagaattacttgaacctgggaggcagaggttgcagtgagccaagatctcgccactgccctacagcttgggagacagattgagactccatctcaaaaaaatgaacatatggttcctattataattctcttgaattatagcactggtctcatggatgatatagatagtggtctaaaagtccagaggtttctgaggtcacagagcccggagcaaatgtctgtggggaatgtttacagaggtgggagatttcacctgggccttgatgagagcactagattttacctgatggatgaagcagggaatggtcttcccagtgaatgatggaagggtggagtagtggagagaaaagcttcatccagttatttggggctggaattctaagtgaagttgtctcaagttgggttttctaggaaacagagtctgagctgcagtttagcatttttatttattaaagtgcttgtttattaaagagtatgcttaacttcactcagtatgtagatatgggcttccctggaaggggcaaaaccttggatgaggcagctctctgcagctgaggtaattcccaagaggaccagcattcagactgtcccccaagatcacactcatcaactaggatgacaagtcctttttgaaggaccatctgaagggtccatcacagtgtccacttcagttgtctagagaaatagagggcacagtgtgccttcctttactgcaagctcagtccacagggtctcacattagctgagtgtgtgggaggaagaccaagtgtctgtgatgtcaggtgggtatttcggagtgtatataaattacagtaagggcagtgtcaaatgagtatgtgtaatgcatctacccatggtccctagagtccactagaagacaatttcttggtgtttaagagattattcttttaataattcattgatcttaacaatacaatacatcaatggtttacgcaaaagccatgttttatctgcaatgcacttctaaattgaaaggtatcataaaatggcacttaactttcagaatccttatgttatctaaagctcagtttcagatttgtttgatgataacgaatatcctgtctattttattatctagtacaagccctagtttcggaactcagaaataaatgaggcaatgcctgcaggtgggtggcacgtgtaggtgcctgtgtgtgtgtgtgtgtttgcgtgttttggagtatgcatggatttggccttatagtttattgagagcatttttgcactggtttatagtcatgcagtgaagcacctctgcatttctcacctggcccatttagtgtggacacattcctttgtcaacaaggacataaagccacaatctcctcctccaaacaaaacaaagtgaatcgctatgtgttcggtataatgggattgagaagtagagttctctttgctgttatttctccataataggcccatgatttcctggcccctggcattcaggatagtgagcatgtgcaagtgattacgagggcagagcagttgccagttttccctgtagctttcagaatgtcatcagaaatctacacgtatgggcagtgaggtctggctctcccatgtctcccctgccccatcttgattgctctctctctctcttgctttctatttcccagaaacatgaacttactttgacttttccaaatataccatgttccttaccacccagtgtccttgcagctgccattccctctgccaagagtgattcttgctgggccccttttagatcacatctttattcctggtggacagaaagaaccaggacaacaagcccatgcctgtcccaagtatagctgagtgcttgacacttagagaatgtgaataagtgaatgagcacagcataaatgaaataccacaaacaggccaagccaaataaactctgaagttgagttttacttggttattaatgatctttggcacaagagtttcagtgacttgataaggccacaagccaagtgtggcctggttcaagaagtacagggatgatacagacaagacagaaaggaaataaattctatcaaaaagctcagctgtcttgaaaaagcaagagataagaaataacttcagaggtgggtagaattgagaaaaggatttctattttgttattttccccgaataaataagccttaaacatgtttgtaagctgctgtgaagtaaccagcagagaggaagtgattgaagatgagagagagaaacagagtaattgatgaaccaacgtccccgaggagacgggagggatgaaatcaagagtataggtcaagaggcgagcctgggagaggccagtgctaaggcaggtgatatttctgcccggccgttagcttttgtgcagaatagtgaaggaagaatcaatcacttcctttctggctgggtaaatgccaagaaattctatggcagaaacttccccaggcaggagactcagaattaattgttaggattaagcataaaccaaaacgagcagggaaatcccaagcactaaatcccaggaatggggccttcatggataaaggaacttcatctgtgaatgatccaggagcccagaatgccaagggaagtttctaggttcttggagatcaagttaatgcccctcataaggttgtttcacatgagccaaaatgtatattgattttttttttttttttgcctttattacacttccagaaagagagcatgatctcctggaatctgtttagggaataaaaatgtccgtacagaagaaaaaggttgttttttgaccttctgctgacactgtcttcttgctctcatcacagcttattttctagcaatatgaggcccacaaattaggaatctccttgcaggccttcaaatatgatttacctgattaataaaatcttagtggaatagatagtattctcctgtgtgtgtgtgtgtgtgtgtgtgtgtgtgtgtgtgtgtgtgtctgatgattggggttcttggatacttagggtgcagggatgagggcaagctgaccttgtttttcatctaggagacctgacaaagatggtgggctgagatagccgtgtaaagctaaaacagaaatacttagtgaacaagcaagtgtgtgagtgaatagatcaaagaatgaatgaaactaccctctgcactctaggttctagaaggcaccctgaaaaaggcatgttgcttggggtataataattgctcaatatatttttcagtaaggaataaaagaaccaacaaatattgattggattaaatggattaataactgataaacacttacagggctgcggcatgtgctaggtataatgtattacatagataaaatggatacgaaccatataccaggccctgtgccaattgcctgcatgtaactcaaaacaaaagacaaaggtcttgccctcatggagcctgaagtccagtgagggtttcgttaaacttgtaggacaccatttccatgccttccatcagtagagcagattctctgtgcagatacttttcacacaaacaatgcctaaccatcccagaaaatctgagcggtgttagcaacctcactttctctgagataaagctgagatttcttttagtgacttgtccaaggtcacatagctattacgtggcagagtcaagactcaaacacaagtctgtctcatttcaaaacttgggctgtttgcctatatcaaactgcctttaatttgcccattttaaagcaggaaagaactaaaaggcttgctttgatggatgtgaggtgatttgttaaaagcttaagagactgccatttttcatgatatgcgtaaatgtgccctaacctcctgaagcaatataaagtggttctttatgttcttagggtattccccatctaaggtaaaaattatcaaaactactggggagaaagcttctctggagatttgccttataaaataaacagaaatcaattttgacttgttttctaatcatgataaatgaagccaggttaggagaaaaaaaaaaaaaagtcccagcattagttgaggatcattttgccaggatacattggtctttgacaagcaattaagaagtcctgtgattgtgcctggcagtgccacagctcagcacactcctgattaattctcattttctttctttcctcgggatttatttactcgtttcacttggaatgtgtttagcttcttaacctcccccacccctcttttctcacgtgcttctttgcttggccccctacaactctacctatacattaatcagtgtcatattcattactgctggtgaaatgccatacaacattggcattcattcatttttgtctcttctgttgagccattcatggtagatttccccaacgaaacctaccatgtttgttttctgtatttcccaccagatgttcttttaaaagccagaagatgtctgccttggtctggttggtataaagagggttcatccaatataaactgccaacagtaggttggaaatactcatcagtatggaaagggcgaagtctgggcaaattggatgggtcttggagaagctctaagagttggaatctacatcatcatctttgtcttcatggctagcaactgttgactcctttctctagttcaggcattctgtctgactcttacattatttctttgaatccttacaacaactctataaagatggtaatggaaaaagacaagatgaccaagattcagagactttaaagcacatgagcagtaagtggtgaaaccacctcaggcctctgcctgttgacttattcataggataacccacagaaacactaattcaaacatggtgtcagaaacagcagcagtaatgaatgcctcaatgaaaaacatttggcccagcaccttggttaggttgagtttgcatggcaaccctattgaatcatgggtttctcagagctgggagctgcaccatgccatctacctgcacctgtcctctttggaggctgggttggtgtttgaccctgtgaagagctttggattgctttgcctacccgcagtggacttgctcacacataagtgggagccctagctcatggtctccaaatttttatcctcatcgtttcttcccacctagttttttcctaattctggcccttcctggccacccaccctgccattatctttctctgacgcttaggacttgaacccttttttcatcctttttgttttattctggtgttttagtcgtgagctaactggaaaatgcttctcacagtttaattgccgtggaaactttctacttggaatcagaccctaacgggttttttccctttccttagggggctgtgcatataggaaaagggaacatatatgttatccctcatgtgttaggggctgtatagtaacaagcctggaataacccttagagcaccttcatagggaaggtagggtttattatccatgtttcgtaaataagagcactgaggttgagagaggtgatgcagattgctgaagtgcctatagctaggaagtggcaagtcacaatggggccccagttctgtctgctctaaagcccagtctgtctgtctgcttctctgtatgtctctctttttctctctccctattcttctggaagtcatagaatcctgtgattctcttccaaactgcttttttttctattaaaattataacccgttattaaaatatttaagcacacaaattaactggtgctaattatgatattttgaatggtaataagcaattagagtgagatttaaagaagaaaaaaacacctgtatataacttggcatcttttgtaataaatacaaacacctaaatataacttggcatcttttgtaataaatacaaacttttgtcaatcatgacttgatctaaccgatatgcctcaggtctgcacagaacggaaatgttttttggaaatcctagtacttcagaaggctttggcatccaaatccattgcaagtagctttctatttagtctctcattttctctctaaagagagattgatatgatgatttttagcttaatttgagagatgttgagttttctccaagacaccctcgttggttcaccttgctctgaatcctttgtcttctcaccctttgtggcaaattgagacgggggaaaactattaggttggggcgaaagtaatttctgtttctgccattacttttgccccaacctaatacctcccagcaaaatgcaggggttgcggagagaaagggagtgatgtatggagagtcagtcatagtacatgtgcaattcaagatacctgggtgggcatagtagtctttcccctggagttctatgtcattgcagcctcctctcccatcacagcataatttaagtgaagcaggtttaacgggtggtcagtatttaccagagccagccttctgcttctggccagctgggtgacttgactagcagaccattactccatgtgggccaccgtttcccatgaatagagtgcgacatttgaactaaatgaacctaggtttgtcccatggagtgcagtttctccctaaatgaacctaggtttctcccatggagtgcagtttctccctaaatgaacccaggtttctcccatggagtgcagtttctccctaaatgaacccaggtttcttcaaaattctagaggctctgactctagcagctgcaattggactcttccctagaagcatctcgctgagtctgagaaaggcacgtcaatgattcttcaagggaagtagggggaagcagaggcagtgccattcacaatgagccacggctgctgacagcagttctgtaaccatccggtgtgtttagacgggagaaagagcttgagaatcgcgattatatggatcatctctctctagatggacttcttttatgggagataatactgaggttaagaggttaagcaacttgctcaggtcacgcagcaatttataatataacaagatatttatgagtaaaacatatatgaactaattatatatctgatagtcgtttttaaggaggaagaagttaccataagaaaaagaaaaacaggacttgggtgttataccatgaatcacacgtgtgtgtgtgtgtgtgtgtgtgtgtgtgtgtgtgtaagataattttttcagcaaattaaaaacaaagcctaagaaaaatgagaacttcctgaacaaaaatattcaaaatgatgactaactagaaagtatcagaaaccacattttccttaaccagtactgtctcatacaaatataacataagtcacacaagtaagtttaaattttctagtaggtgcatcaaaaaagcaaaaagaaccaggtaaaattaattttaataatgtactttaacccatatctaaaatgtgacttcattgtgtaatcaatatgataaattattcacatatttgacctttttgtactaagttgttagaatccagtgtgtatttattttgcacttgtggcatgtctcgattaggacgagccacatttcaaatgcttagtaaccacacatggctactggctacagcattgtacagtgtggcaaaagtttctctcctttttctcttttcccaggctctgttgaaatttttctttcagaaaaatatttaaataggatatactctgactttgaaaaaatacacatatgtgtatgtttatataagtatatgaatatatacatgcatatttctatctatctacctgtctaatatctgtcatcgatctatctacctacctacctacctgtacatctatctctctagagatcttctccacaaaagcaaggaaagagaatctctgacactatattttcttaatgaagatggagaagtttttgcagttctcattatttcatttcaggctttcagatgttcaggagccctttactagaaggttgatagattaataatctccccactaagcttatagcttagcagacctccatggtggccatgatgaggattcctttaacacatgattggcccttagtccccatttctctggtgtgagttttcagcttttgttaccacatcaaagctccggcaatttgtgcaggaaaccccttgaagcaatcatgaacccacttgtactgtaagagttcttacttccatgtcctaaaagaataataaccacaaaaggatatttccttgctaatggactggggagaatggactgtgacaaaggctggtttctcattgccaggattttaatgaggggactcacctgaaaatgtctagtgcacattaggctcttctaatagtttccgagagctggagtaacagattaccactaactcaaatggcttaaaacaacagaaatgtgttttctcacagttctagtggttagaattccatattcatggtttcggcagggctgtactccctccgaaggctccaggggaggatccttccccaccccttcctagatgctggtggctcctggcagtccttggcattccctgcaggtgcatcttgccaacctctgcttccattgtctcatgacctcctcttctgcctctctgtctgtgtgtcctcatgtgtttttgtaaggacaccagtctttgagtttagagcctaccctaatctaaaatgaccgtaactttgtcacatctgcaaaggccttatttccaaataaggttgcattctgaggttctggatgaacatggattttggggaggcatcatttaacccagagcaactgtcactaaaattttcctaccaagatcccttactctagtttaattggcctcttattcaaggcctactccataagttattttggaatatagaatttcagaacagaaatgggatctgatgattgcctagttcagtggaaccctttctttaaatggaaatttagtcacagtaaaggacagaaaagaacgcgaaccaaagcttaggtgatatgtttgcaggaggaaggggtggcccacagtgacccccgctgccccctcctctttacccctcactaggctcccggaagacttccagagcatcccaagggctccacaaacccctgtttaatcataatccctttactgtagggattaaaaactactgtttagggagatatagtgaattttcccaagtcacactgcaacttgaatctgaggcttgacccatctatgaaatatccaaactgtcggtccattcatttctgcattaccaacaatggtcagttatatatttttctttgagaagagaaaagcaaaacagtccatgcttgcaattcttttcttcctttttgtaaactatgacagaaaattcatggtgaggccaaagccatgacaacacctgtgttgcctcacattgattttctgtttccaactggaggaagaggttcccggaacagccacttttgagtcaagtgtgtgaggaaggagtctctcttgccaaggactgctgtagatgattcctgcatagccagcgctgtgcagggcctccacttgagtgagcactctgttcccattctatttctcactagtattttgagtatgttccccccaaagtagagatagtatgtctttgaatgcaaaccatgggctgagccctccaaattacttttaaaaaattagcttcttcaaaaaatttttttccacttccctactgtcttaaatatactggtgcttctgccctaagacctttcaggaaaggtacatgttctacctgatttacaacaataggttattctgggtaaataatatatctgttggatttattgtgcttattattttattggaccacactatccttaacctagagaagaagcttgaggaaaggagctagggtcaggcagaagacaggtatgttttgaaataagaaaggaaaaggaaaacgtctggaaccttgacattccacaggatattgtcccatgaatacaaaaggtgatgggtagctagaacctgagggaggaggtgccttcttttggaattaaaattccagaatgttctggaaagtgccagatgcaagaccaagtaggaccagctagtaatggaaattcctcccatattgacaaggttgatgaacacatggtgggtgcagctcatggaacactgggaggtcaaaagcggtctcagttacctttgtacaatggacatggcaccccaggttaacacaggggccacctgcccagcaggcatgggcatcagatgaaggcattttttaaacaccttatttaacaattcagagtctagatacgagtacattctcattttaaatagttcagaaaaacagatattcccttttcctccttccaaacatattcttcccttagaggcaaccaacattattagtttaatgaatcactttccagacctttctctcacatttaggtacatacaatcacccctcggtatctgtgggggccaaaatccagaaacctctgtgaataccaaaatctgcagatactcaagtctcttttataatatagtgtaatgtttgcgtaaaacctaggcacattctccctatacggttgacccttgaactacatgggtttgaactgaatggctccacttatccacatgtttttaccaaatggcaaattgaaaatacagtattcataagatataaaacctgcatataaggagggtcactttttcatacacaagggttccacggggctgactgtggggcttgagtatgcatgggtcagggtatatatgtgggggtcctgaaaccaatcttctccatatacagagggacaactatactttaaatcatctctagattacttatgatatgtaatacaatgtaaatactttgtaaatagttgtactgtattttaaaatttgtattatgttttatagttgcattgttatttttattgttttaaacaatattttcaatccatgattggtcaaattcacagatgtggaacccacagaaactgaggactgactgtatatgtgtgtgtgtgtgtgtgtgtgtgtgtgtgtgtgtgtgtgtagacacgtagaattttgtgatctagaagtgttaaatataagaggtaattatgtgaggtaaataaaatgtgtgcgttaaatataacaggaatactactatatgaatttttctgaaatttgtgttttaacattttaagttgtttttaactattctttggtacggacattgtattagtctgttctcatgctgctgataaagccatacccgagactgggtaatttataaagaaaatagttttaactgactaacagttccacatggctggggagacctcacagtcatggcggaaggcaaatgaggagcaacgtcacatcttttgtggtggcaggcaagagagctcatgcatgggaactcccatttgtaaaaccaccggatctcatgagatgaggggaacagcatgagaaagacccaaccccatgattcaattacctcccaccgggttcctcccacaacacatgagaattatgggagatctcatcttattcaagatgagatctgggtggggacacagccaaacgatatcagatgtacttcgcatatcatgtatagatgagaaaacaggcatttcttcccaatttttgcccatacacatgtggtggacatttttcatgtgcaccaatatctggtccttttctgcttcctggttacaagaggttttattaataccttccctccctgccttcttggagttagctgtggccatgccactggatctgaccactgaaatgtacttggaagtagtggcatgcgacccttctcagccaaagtatacaattgccggtgttcaattctccacccctctttacgcatcccatcaaatgccgatgtctgagtcatctgtgtccctgggtgtctatgctcatcagaatcctgctgctgacctgcatgcagcatgtggcacaggcaagaattaaacccttgttgtttgacatcatgcagactttggaactacttgtcatcactacataatccagcctattctggccgatactcatagctatgagcagccttgtacatgcttctctctgcacctgtgatgacatttctccagtaatgaatgtctattgaaaagttaaaacattaaattgcttttaaagtaccttcttatccctccagcccctaccttttgtccctaggctcctctgcatctgttgactttagattttttttgtattatttattcatgttttattagataaatatcttccccagacaaaccttgaactccctggagtcaaccgattcccttgcccaagcctctggtgttagtgattgtttcattaaactctagtctcaaggctaatccttgttggaaaattcgttctgtcctataagaaggctcccaggctcctagtctcaaaccactaaacaggccgcacaggtgtttagtggtacttattggtggccatgtgacattgttatttctctttgcatatttctcatatgattcacagtgtttaaaaggattacctttttggttttggaggtgcagatttagagaatgggatttccaaagccatattgtccctttcagagcacagtgagggtgttctttcttacccagagggtcaacagtgccacaggcttgccagtggatgagtttaatcaactctgactgtgtggccagtgagcaaagaacatgacaggggtttctttgaggtgagcaatgccctccgccagaacctagaagtagggtaatgatgctgaggttggtgtacactcagaactcagtactgccgcagagtaaggcagacccatcccacctgggctgtagctcccacgatggtgagtccctagatcgtaagttgatgggaagcataagaaggtcagaaccaaaccagagctttgagcgttctctcactgcattccatagtttccccgagcgctgaaattctttgcaacttccattcatttgcacatctcatctggctgtaaggcataatgtggtctgtgtgaaaaagaaacttctgcaaaagagtcagattcagagtttatggcaacatcaaggaatagtttatcagttcagctgagtataaccacttgatttagcacttccttttcatcatgcctctcccctcatcacaaaactgcaaaggctccctgtgacatccaaagcctctttgtctttccctgtttaggaaaaagtgacctagagggaactctgcaggggctacatacggaatcttgatgttgcctcctgcctgctgtactgtcctggttaaatccttcctcttctctaactctgtgtctccatctgtaaaatggggatggtaatagagcctatcctgcaggataattgtcaggattaaaagagttaacccaaaacagataataaggggttctgaagatccaccaggagcctcactcagacaccttgatgcagacagcacctggtaaacatgggtgttcagaagtatggtccttcccttacggccccttactcaatggccatccattgtctgctgagcctaggtccctcacacctatgccccaggctcctgtcctggaatcctggcttttaccaccaaattccccaaaagccccgtgagtggctgttttgagctgagggcacctgctcctactggcttcctggagccttagacgcacccagtgctctggacctcccacaccttgttgaaccacccggcacttgctgactcctctcctgaacctcatgtgcttgtgacccacgattcagccactgtctaaccagctcttccgtgtgcagccctcagagccccagctcccacggctctaattccacggccgcccctgccgtctcttcagccatcccatcccgccatcaccatggaaacctgtgggaacagcagcttttcctcatcctcttctccccttaatctccagcccactcctcctccctcttcttgtctgtgtccttcccctgagacatgttcaaatgttgtttctgcatgttaatattttcttaactatttagtgaattcatcatggcggagggagtgagcacgaatggactctgtcatacttcacagaaattaaacctgagccagctaaatatcctttcctgctccattctaaacctttatgggtctccacaataaccagtaactccatggttgtagagttcagataatcatgacataaatgtaggaatgaaggcaaacaggccggcccttcccccagatgactggggtcttcccagctggtgtaaaaccctcttctaggtcaaaacatttcttaaagtaaatgagtgatgactatgacaggtgggaaagtacataaaataatgtgattgaaatactcttagttggttctgctccattgaccctagggaggaagaaacaactaatttgtgctttctgttattgcattgaaagagagtggtgactcgccgggcgcggtggctcacgcctgtaatcccagcactttgggaggccgaggtgggcggatcacgaggtcaggagatcgaaaccatcctggctaatacggtgaaaccccgtctctactaaaaatacaaaatattagctgggcgtggtggcgggcacctgtagtcccagctacttgggaggctgaggcaggagaatggcgtgaacccgggaggcggagcttgcagtgagccgagatcacgccactgcactccagcctgggtgacagagcgagactgtgactaaaaaaaaaaaaaaaagagtggtgcttcaaaattgtgtctttttcaacgtttgttgtctctacatggtaaaatctgaatttaggcctaattcaaaatccatgagattgggaatgggattgggaatctcattatttgcattaatgtatgagactctctgagtaagtgttggtttaagtaaatttttttcttaaaaaactcagtagaaatggaactcagattttaaaatggactttaaaatggtctaaaaagtgtttctaggtacaaaatgaattggagtttacctattttttccaaagggcaggtagcaggtctgaagtgagagagggaaacgttcgatgctgcgttgttctgggagatgtgagccgccggctcattcagaatgtgcagggatgtccattcccacaggagcatgtgtcgttcagccaggtgcatgttttaccttgatctactgtgcttggagccttttctttcccagatctaggtctgatacctgcccctcctccttaccctggactgtaattaaagggaatatgtggaaatccaggccacaactattttactttctgtgaataaggccatcaagttgatggcttgttactgtgggtcgatgggtcaaacatgaggcaatttggggaaacagcctaaggtggctataccacagaggccagcagagcaggtaaccaggcacaagatgcgatcgctgacgagagagctgctgtgacagagtaaggagtgcatggggaggagggaccactgaggtttgtctgcgtgtgggtaccccatgcgcagatcctcaacagccgttccaaggaagtagtcatttgggagatgaagggggtgcaggtagaggagtgggggattgagacagggaggggaagccacctagctagtgaggtttgtgtagcaagaaggtaaccactcggagcacctggagtttaatccttaaggagactgctgagaaacagagtggtgcacacttagggttattttactgagaggcaggagatgtagacagcgctgggggatgtagacaccacttgttaaaatctggcagaagagaatttagagaagaaaggtattgctgtgtggtaagagcaatgacttggtcaggatgagggtgggcatggagctctgaggaagggacgtacagaaaccaggacagaactctagccattatctcctttcttctagcgatctgacaaggtcctgctagatccttcactagactctagggcaggcttctacttagtacaactgataccaccgccatgcagccatcatggcccctcccagggcccatttgttagtaataataataataatgcttaagaagcattgagtcctaactgtgtgtcctataaactatcataacccgtatagtcttcataaagatgccttcaaggagacactcttattatccccattttacagggagaaaaaaatgagcctacgttcagcaattttaagcaaattttctattgtctcatgactagtaaatagtggaataggccagttttgttttttcaccttgactgactgcaaatgtctcagtcatgattcctgaccatcttctaaccctctaaggacccagacactcctaagtagttaaagagtctgacgttatcaatcaatggaaatattttcaaaaggtaaagagaaaagaaattaaagttatgatgatcttttaaggcaaatcctgctttcttgaagcttggtcagccctggcacaggcaaaagtgcatgtcatttcaaggcatggggcaggtgaaatggaacacggctgtcctggcgtccacaactcacaggagagtggagaatgtggaagttacatgctccatttagacatcagtgttctctactacaaaatcgtttctgcagttcattaatcagactctccaaatttgtttaactcattatttataacagcattaaatccagtgacaccaaacggtgtcaccatgagtatcaggaagtctgattttaatcctcagaaaatgtgttcaatgtctttccctccctcctccacacttaacagggacagtgaatggaagccagtgttaaatttgcacgatgtgcagtggtctaaactttcactgaatcctaatcaacttaatatcctgttgcctttttgaaatccagtgatgaaatgtaaccctgagacagcttaaacagaactcaagcctggatgctctctgcaaaatggtctaatttggtggttatagcgctagtattgtatgtacaatgatcaaatcctgtgttttcaattgtcctttttatggtcaatcaaggcggtcttaggatatagatttaatatcgcaagagtctaatgtaacaggctaatgcatgccctccagttacagggagaatgtctttttgtgacagtggttctctgggtacgtcttacaggcttctatttttgaacttgactccaagggccaaagcagcacattttggaaatggttttgtaaactgtaacgaaggtatctttcttcagcagcttcctgcccaaagacgccagagtgctttacaaacttatcaaagtgatatacagggatcgttttagcctctgctgaaatacaggggcccaggggggaaattacagtcattgttgaaaaatcttagattgtcaggtcgacaggaggagggagagtgtacagcacctaaaatatcctcccaaactggatggcatgtcccaagggctgtggtcttatctactgcctgctgcaggtgacgtttgtgaaaggggtcctgtgagttttgatgattgtctctcttagacatgctggtaatacagctccttgtaaagctgattcttcccttggatttgctcatctcatatcagagactttaaggtaccctctgacatacaccctctacaaaataggcatgttgcattttttggcatactagaccatcagaaggggaactgctatatcacagcctctggaatcctggctaactacagggaagagatgtctgaattatagcagaacatgaaagaaggcagcttgtgctttaaaggaggtgttcaaagcatgtctgagcagagacttttgggctctgttttaattaatactttaaaataattcatatttaaaatatcagatgtttccataaagaggaggatgtttaaatgcctccagactacattcctttttattcttgattttacctgggagtccaaagttcaattccataaagcaagcgtttatttgtcactttcaatatacatcgattgccatgcttaagatgcaatatgggctgcggaaataggttaacccacaggctcccagggcccagtgtagaaggtgagagattcgtgtaaaatgattcaaataaaaggaagaccctggccgggtgccgtagctcacgcctgtaatcccagcactttgggaggccgaagcgagtggatgacgaggttaggagttggagaccagcctggccaacatcgtgaaaccccgtctctactaaaaatacaaaaattagccgggcatggtggcaggcacctgtaatcctagctagttgggaggctgaggcaggagaatcgtttgaatctgggagttggaggttgcagtgagctgagatcgcgccacagcactccagcctgggtgacagggtgagactctgtctcaaaaaaaaaataaataaataaagtaaaaataaaaaggaagaccttgataaatgccatgatagatacattctcataaagcccagtagcatattcgggaggtttatgagaacatatcaataatttttatgtttgttaaaatattttaaacaatatttttatgtttgttaaaatatttagttgtagtttatcttaattttaattttgaagtaacagagcaggagacctaaaaaatattccctactaggagatagttgtggaatatatagcatttgtatttctacatttttatgtgacacatttaggtgttccttaaataaaatgaaattgaccaaagttctggttagtatgtagcaaactaaaattatgtgaaaatatccaaagccttaacagagctaggatattcccgcatccacactcacacagctactcactgtaaaagtgatcgttgacaaacataaggaggcaaataaaagggcatagcctttgtcttttaaaccactgtgacaggaaaagttatggggagtgggtcagtgaggaaggaagtctgaacattgctgcattcaacagagaaagtaaatgaaaggaagacgcttacaaataagagagaagaaaggaccgcattaactctaaagaaggggctagcaggtcctgtggagccgatggggcagtgcaaaagcctgaccatgctgatctccattgggtgggtccaatggaagaacgctcagggttacgtcaggaaggtgccctagttttggggaaagaacatttcaactcaggttcagaggaaaatttagatatgttaaaactttagataagttaatagacagggcagaaatgaaagaaagaaagattcttcacagggaagtcctggctatctaactgtgaaaacctgaaagatagttgagaaaggcaagagaggcaagaaggagtggaaatgagggggattcagtgagacatacgcaaagaaagggagagaataaaatgatacattcaaagaagcgtattgtgacaaaatgtgaacttctctaataaactcagtttaaaagagaacatataggccaggtaccatggctcacgcctgtaatcccagcactttgggaggctgaggcaggcggatcatttgaggtcaggagtttaagaccagcctgaccaacatggtgaaacctcggctctactaaaaacacccaaaaaattagccaggcttggtggctggcgcctgttatctcagatacttgggaggctgaggcgggagaattgcttgaacccaggacgcagaggttgcagtgagccgagatctcactactgcactccagcctgggcaacagagagagactccatgtcaaaaaaaaaaaaaaaaaaggcatgtaaagtaaatggatgcacatgtgaggagcagcatccatgacccatcacaagtgtatgggatcctaaagcttcctgacaattgcaaatgttaaataagccaaagatcacaaaaagaggtttgttttggcagttgtgcacaaacctgctgcgaggcagctggtgccctggtaaaaggtggcagagcaaatgcagaaccacacaggtgccgggtacctcctttctgtggtcaaagaaaataatcatcaccctgcaaaagggttggacaaatataaataggagaaaattgaaatccaagatagttgagaagattataagtgtatcctactgatttaaacgagttcacacctatgaaactagatgaattatttctcacagaagacccggagaaaatggtgattagaatctctgcaccagtttctgtgatttttttgagacatcctgaagatgagaggtgagtagacagcagatgggcagggccagcatggtttttgtctggttatttatttctgtggaataagttcctagaaataggatgtctctctgggtcaaaaggtatgtacactttcacttttttttttttttttttttgagacatagtgtcactctgtcacccaggctggagtgcaatggcactatctccgatccctggaacttctgcctcccaggttcaagcgctcctcctgcctcagcttccccagtagctgggattacaggtacccactgccacgcctggctaatttttgtatttttagtagagacagggtttcaacgtgttggccaggctggtcttgaattcctgacctcaggtgatctgcctacctcaaccccccgacaaaatgctgctattatgggtgtgagcccctacgcctggcccacactgtaacttttgatacatattgactaattgctcctctccagagtttgtacccaaattataaagccacccagagtatattagaggaccatttattatacctgtttgataaaactatgcatttttatcaaccaaatttttaaaaattaatgtggctttattgctcataaggtttaacttttttcatgtatttattggccatttacatttctttagtaaaatacaagtaatgttccttagtacatttttctgtttggctttttgttttatagtactcatagtaattgatatgacaagaatatcaattttttgttggcctatatattccaaatgtgttttttaaatgttatatttcaatcttactttttacatctttgtcatatggcatctttactttttaaactgttattttagattcaggagaatatatgcaggttagttatataggtaaactcatgtcatagagatttgttgtacagattatgtgatcagcctcgtactaagcctagtatccaatagttatttttttctgatcctctttctcctcccaccctccaccctcaaataggtcccagtgtctgttgtttcccctttgtgtccatgtattctcatcatttagctccaacttataagtgagaacttgtggtatttggttttctgttcttgtgttagcttgctaaggatgatggcctccagctccatctgtgttcctgaaaaggtcatgatcttgttcttttctatggctgcataatactccacagtgtacttgtaccacattttctttatccagctcaccattgatgggcatttagtttgattccatgtttattgtgaatagtgctatagtgaacatatgtgtgcatgtggccaacattttaaaagaaatggagaaggtaagttctggaaactggtagcagaacttaagccgcggtataattctgaacaggtccatctgttcgtcatcattcatctactctaaatccatgcatctctgttcattcagcaaatattgattatgtgcagtgtgctaggcattaggaaatatgctagaaaacaaacagaaataatagtccttgccttattgaaacttagagtcaaatgaggggaattattaaacacgttttgtgaattttaagagggcaatagtgagatttgtttgatagaaagagtaatatcgagatcaaaatgtgtgtgggtggggtcacgatctttgtgttagtcagggcctttgctactgcaagtgccagaaacttaaatcaaagtggctgaagcaaaagaacactgcatgcctcatgtatgcgagaagtccatgaatagggctggcttcaggcctggctgggtgtataaattcagatggcaccctccaccaggacttcgtcttcatctctttgcttggcttttgtctgtgttggctccattccccatgcgtcaccccttcccaaacctcttacatgtttttattttcccataagttctcccctcataatgcaaaggtagttgccagcagctccaggctcacatccatccttcagagaaactccaatggaaagagtctaacacagttcaaaccaaagcacaggatgaagttcacttaaatgaatatgggtcctgtgctcgtccatgaatcagtgatgtggccaacaaagacaacatacactggtgatcatgacctgggtcaaagtcaaatgcccctcctacaactaggaatggagtcaccccatctgtaaacagactgagagtctgtgggaacaaggcagtttcctatggaaaagaaaagaatgctgtctggtgaggctgtctccactgcaggccccactgtggatggtgctggtcagagactatcaggggtattaggatccattttttaatcttatattctctctcacacactctcttttttccccctctcttggcttgatttcactagttagagccttctttacaaaatcagacagaagggttaagaatggacatcattgccttgtttctgatgttaagtggaaagtatttcatctattaaacatttataccactaagtatgatgctccctgaaggcttttcagatgtgctctttatcatattgagtgagccccattcaatttcaaatttgttaaaaatcttttatcatgaataagtgttagattttatcaaattttttttctgcatcttttgagatgattgttgtttttgtcctctagtctattaattaagcttattgtattaattgattcttgaatattaaaccaaccttgcatacctttaataaagcctagttggttattttccttgaggtgtacaatccttttgataagttgtattagttttctgtggctgctgtaacagattaccataaatttggtggcttaaaacaagaaatttattttcttacagttctggagcccagaagtccaaaatcggcatcagtgggtggaattaagtgctggcagagctacactctctccagaagctctcggggagcttcatttcttgcttcttccagcttctggtggcagctggcattcctttgcttgtagtcacatcactttgatcctcaaggccactatcttcaagtatcccttttctctggtgtcacattgccttctctatctctcatagaatctccttctcaattccatttataagaaaacagtgctggcatttagggaccacctgaataacctaggatcatctccccatcctaaaatatttaattcaatcacatatgcacagacatttttttccaattcaggtagtatttacaggttgcagggctcaggatctgacatctttgggacccattatcagtctactaactatgttattaaatatagcttgcaaatatgttgtcgaggattttgtttttatattcctgagagatattggtctttttttctttagatatctttaaatggctttggtagtaatgtaataatgtaatagtggcctcatagaatgagttgggaagtgttctctcctcctatattttttgggagagtttgtaaaatactggtattatttcctctttaaatgcttgataaaacttacctgtaaatctatctgggtctgagcttttctttgcagaaatattctaaattactgattcaatttattattattattatttgtttttaactgttttctgctattaagatttttaatttcttcttgaaccagtttggtaatttgtgtcattctagaaatgttttctatttcatctaaatagtctaactgttggcataaaattattcatagcatttccttataatcatttaaatttctgtaagatcagtggtggtatgccctttgttatttattaatttggtgatctgtgtcttctctcttttatcttggttagtttaggtaagatttgtcaattttgttgacattttcaaagagcaaatttttggtcttattgattttctctgatgcatttgtaccttttttgtgtacttcaaagaagccattggcaaattaaatatgactggacaacttttcacataagtaactaggaaaggtaaggaaagacacagaatataattcaagtccctgaaggcctgtattacagaagaagacataggcagattctttcacatgccagggagtagaactcagattagtgtatagaagtttcgaagaagcaaacatgagtgttgttgcccccatcctagaacacagactctagaatcaatcagatttagaccctaattctggccttgcccctcttcttgttgtatgtattaattaaggtaatgtatgctgctataacaggtatgccttcaaaactcaggatcttaacaagttggtacttatttcctgctctggagagaaaagctcacagagaagaattttatgacccatgcctgaaagtgagaattctacttatgtgcacattctgttgactagacctaagggaggctagaaaattagtcaaatcatgtgcccgagaggaaaataaaatctctttggtgagccactagctagtctgtgccacactgtataacctggggtttaactactttttgagcttctgattccttaaatgtgagaagggtatacaggcctaccttgttgatattgaggatttgattccagacaacggcaatcaaggaaatattgcaataaagcaagtcacacatattttttgtatcccagtgaatatgagtcatatttatactgtagtctcttaagtgtgcaatagcatcatgtattttagaaagtatataccttaaagaacattttattgcaaaaaaaatgttgacatagagactcaaagaacacatgttttaggaaaaatggcgccaatagacttgctcaatgcagggttgccacgaagctgcaatttgtaaaaactgcaatatctgtgaaatgcaataaagggaagcataataaaaggaagtatgcctgtaataatttctgtcacatgggtgtgtccatactgctcagtatctggcacaaggtgggaatttgatgaacatttgttccatgagtgaagtgagtttaaggactggtgtgcatggtatgctcagaactacatttggtttatagtaagggttcagtacataagcatatttactgctgttattgttcttaagactttagagaggaataaagccagacaagaacattttaagctgaagtttgaagagtgaagtttccatctctaaaagttttcaggcaaaggccaactcttagggaggtcacagagtcctacttttgtactctgaggctatggaatctagtggggcatcagacaaaccatagtttcatttactatcttgtaacttcaaggaagccactttactttcctgagtctgtttccttggatccaaaaacctacttagtaggatagccatgaaaattcagtgagataaatcatatgaaaccagaacacagctgatacatgcagtgaagcggctcttaaatatgtgcttctttcctcttacttcgcttcctctttattttttcctggtctatgatacagaaaatcgtctgaattaattgcatttgaaacgaacattggttgtaatttaagataaagagaaaattcctaggttgggaattgggatcctggttctgcattttcccagcccttcctctctgcaaatgatcacagaattacatagtctggaccccaaaagcaatatcttctgttacttaggattcaaggcacacatgtttgtaacaattggcttctcaaaacttgtaagaactactgatgggtaaacaagtcatgaatcagttttttatattcaatcaaagttgatggagattacccaattaaataactggtatataactagtttccctatttccttttccctgtttcatagaaaaactagttatacattgcttttctgtaagaaggtggtaaatgtaaattgagaagctcgaggttagcaaaacagaagataatgatcaaaggactccatgtctatgtggttgctttatgataatgctgaatagcagccttgttcatgcagagacaatataaaagcctttccccaacttctccccctcctccaattcgtaaaagtcaacataatgttaaaacaaaacaagaagtttagaattaggatgaaacccatctagtaatacagtaatgtcaggaggacaatatcaaaacaaatatttatttactcaggtggtggttgcggttttcgggctttttctcagctgcggtgcatttgtggcttttatttctgcactgccgcttgttacttggagccattacttcctatctgtgttgtcaatcgtgtcttgaggttattctagcaccttacgaaaagccaccatccacctaattttagagcttttaagataaagcccgggagcactaggaaggtgagtgagttaccgttatcaatctggaatgtgaggtttccagtgcagtagcaccacctcttctaggtcaccatggccagcccttctcagaatacagaatgatgtaataaataatgcctgtgtgaagtgaaagctttgagcaatggaaccagctaacatctagaattttattaggcacaaactttctcagatgttctcagtgctattattaccccctcgttaaagctggtaattcttgtttttaaagcactttggagacactcattgatacatgcctgaaaaaaaaatagatgtttattttttccttaaaaacttcgcatgagactttagaaccgtatacgaataatactctgattactgaagtgggtggattttccagtctttatttttcttccattaatcatcttaagagatccaaactttccctgccatgaaatgccagacttcatgctgcaagattcccctagttgaggggaagggcagagccaaccagagcccctggccctctgtcaggggctgcctcctttagctctcagtaataccatcagctcctggcctccttatcaaagagggaggaggtgacataaaattagagaaatggcccagagaggtggcccctcagagcacccctagctggtgtttaaaggggagcagttatgacgttgttactgcagataattgccagttgagtgtggaggccctgtgttgccagtcccacccactgatcaggaaaagctggtaatcagccatggcatttgtatgctgggaaggaagaacaatgggctacaccagctttatgtcaatcagcattgccctgacatcccctatcagacttctgcttaaatctttttggctagaacaggtcatgcactagctgcagaggaggttgacaaagtgagtattcgtgtccccagccattgtggcagatgaagatcaggggaaggtttttaggaatgggtatggcatggccaacctgaacactgcctaccaacatgtagacatgatattggctgggtattaaaggaaacaaacatgtcagacagccagaaatggcccacagcccatgaatttaaaacctctacctaagagcagcccattgctagctctcgcaccctctctgcccttgacctcaataatataccatatcttgattcactggctccaggtctcctaccaccgaggacttgccttactttttttttgttgttttctccatggagtccatctgttggaacattctgtctacaaactccttttgttaggtaataatgagttttcccattttaaaaaattcagcaaagactagcagagctgccaaccagagcctctgatcaacacaggataaccagcaggagagttggtggaattccagacagtggtaagaaaaaaaataaaaataaaaaagacattttaattagtctgtgcagctttatcttgcataaatggatacattccactaggccagggattcctaactttttctataaaggtccaggtagtaaacattttagactttacaggccacagggtctttgttgcaactattacttcttgccattagtgtgcaaaagcaccctagacaatatttaaaatgaatggacatgacagtgttccagtaaaacgttatttccaaaaaaaaaaaagaaaaaaaaaggccagaagaccattgttttgcagatctcttgcatgaggcttttaaaggtattaaaacattttcgcacccctgtgcctgttttcctgaaagtttagagatcctgagttggaacactgatttgcattataaaccttgccctgaacaattctcagcctgtccagattgctaagttctgcatgacattcttagtaatgatgtccccactttcttccctctgctctgaagctcattcttgttgagcttgatggcattttaggcttgactttctctagaagtcttcactagattcctagaagagggaggcacagaagctcacaagctctaggtacaaaagccttgaagctttcgagaagacagataagccaggaagtgattctagctctgctgtatatctgtgtaaccatagttattcacccaacctctgagcagtgtgaggcatggacaggaggacttcaaccaaactggggttttcatctcagccatgttcatccaggggtatcattggtccattagtgatgaagatgttgtattaatactttactatgtgttttattccagtgtccggttataattgtataagaaaccatcataaacttaccatcttaaagcaataacaatcatttgttttactcacaaatgtgtcatttgtgagggctcaatggggactattcatctctgtttttcacggtgtcagttagggtagcttgaaggctggggtaactcaatagctggaggttgggctcctttattcattccttaatgtgcttggtggttgattctggctgttggccacagtatccacacatggcctctccacgtggctgcttgggcttcctcacaggatggtaggtggtgccaagagtgagcatcccaagggaacaaggtagaaatgagtgatattttatgactgaggcttgactttaccatattttatagcagttggggcagtcatagattcccctgaggtcaaggagacagaaaataaactcctactcacggagagtcatgtcaccattaccttgcatcgtgagcatgagagatgtaatatgatggctattttgggaaaattcagtctcccatacagaatataacttgagctattttcagcccatgttttaccatcttcataatgccttatagttgaagtaatataaggatacctcacgtgagtagaggctgcgggtatttagaagacccaaaacagatgttaaatgttcatatgtgccattttctcttcctataactatttttcttcttctttctctgggaaactccagcttacattttacttttcggcctagaaactgttcctcaagaactcttccctagtaagtgatcccatagaacgccatgtttccccatcatattcctcatcacactgtattgtcattgccagcttatgactttggtcgtgagtgataacaggtaaggaaccatgcctgtgttactcaccgctcagtcctcagcccaggcaccctgcctaacacacagccgatcatcaacaatgtacttattgagtgaatgagtgaccagtgctaatgagttactgaatattgagagaattggttggtacttcataaacaattcttgaacccttcttaaatagcagtcattgtattagatattggggctataagacatggtctagttggggagatatatggttctaataataatttacatttagtagctatgtttttgctgtgtatctctcatgcttttcatgcattgtgatggggatggtgacatgcctctcagcgagagtagcagattgttttatttcagaactatgatcataccatttgtactatttggtcatttttctccattcaataatataaagtaggcagtcgtgtatgtgtgtgtgtgtgtgtgtgtgtgtatgcgtgtgtaatccacataaggctttttgatgactgcatattatttctcatcattgctgtcttctaattcatttgaccagtcctgtaattgatgggcatccaggttgcctctaggttttcacttcttataagcattgcataaatgatatttcttcatgtggacccattgcatgtggcattgaattatagaaatgatactgttgaattgaagataggcccaattaaaattttgacacagaccattaactgtcacacagatttatattgccaccaggagcatttgaaagtgttctattcaattccacacaccagggatactatcatccttactcaatatctgccaatcctttgggcaacatagaatattctactgttgttttcatttgcatttctcttaagaccttatctggagaattatgttttttcaacataaataaataagaattgtccaaggtaagagttgtgtaggctctgtaaaaactccccaagtttcagtaatttacagatttgaatggataaacatccttattgttcttaaatactaaagtaagagcagatgtaagaagagcttacactttttattatatctgacattcaatgggaaaccactggaaaggttggagattggggtgaccagtgtttctgagatgaactgaaaacacttagcctcttttcttcttatgtccattcttctgtgtattgataaagcctccatttttctgacattggaatgggaagagatgtttcagtctcagtctaggttcaatattaccaaagtgcataacattatattcaatttttgcctggcactttctaagagatctctgatttgtagttgtagtgatgactttcataatctatttttggaaccattgtttgtattttttaaatgattagatcacctttaaaaaatatgctatcattccaatcaggttgataccatttgtttttaattgttcactaaagtatagcatatatcatagaaggaatgtttgtgctccccagaattcatattttgaaacctagcttccaatgtgatggtgtctggaggtagggctttcatgaggtggtaaaatcattaggactttactctcaggatattatgagattagtgtctttataaaagagaccccagtgaactcgctcgtccttttctactacatgaggacacaatgaaaagacagccattgcctgtaatcccagcactttgggaggctgaggcggggtggatcacaaggtcaggagatcgagaccatcctggctagatggtctagccaggtgaaaccccgtctctactaaaaatacaaaaaaattagctgggcatggtagtgggcgcctgtagtcccagcgactcgggaggctgaagcaggagaatggcatgaactcgggaggcggagcttgcagtgagcaaacgtcacgccactgcactccagcttgggggacagagtgagactccatctcaaaaaaaaaaaaaaaaaaaaaaaaaaaaaaaagaagacagccgttgatgaacctgaaaagaagccctcacagacaccaaacttgctggtgccttgatcttgtacttccacctccagagctataagaaataaatttctgctgttaaaaagccacccagtcaatcatatcctgttacagcatcccgaagagaccaagaaacatacctgtagaaaggagtagtcataacaaatctatagattgattagttttcacaaaccaaacacatacacataacaacactcagagaaacagagttatgactggccaccggaagccccatgccctctcagtcatattccacaagggaaatcactatcatgacttctaataaaatgcattagtttgtctctttttttttttttttttttttttgagatagagtcttactctgttgcccaggctggagtgtattggtgcaatctcagctcactacaacctctgcctcccaatataacctttgtatttttaagagagatggcattttgccagttggctaggctggtctcgaactcctggccttaagagattcacctgcctctgcctcccaaactgctgggattacaagcatgagccgctacgtccggcctgttctttatgtaaatggaatcatagagagtgtactcttgtgtgtctgtatgggactctctctttttgaatactgtaatagatcaacagctaacatttaacagagatgcaccaggtacttttctaagcactttatatatgttatattaaacataggtgtcttaactatggattatatgggaatgttttaactttttcttgaagtaactttatggtttgtatacggatgccaaatatagatacatatctaatttatctattttatttttttagaaataatttcttagaattaggaacctcttcagagccataattgcaaaaagagctccccgtcagctctctttgcagtcgaggtttgtaattattcttaaaaagaaaacatattaagatgttcttaggactctgagtagttatgccctcagataaatgatattaaactaagcacttaaaattaaagctataaagcattggtgatgcccagatatatcagtactccagttcaccctaggtgagaagggcagtggggattaatagccccctctgtccatttcctttttaggaaatgatgacctatcagagaggacataaatcactcctcttcccaaattagattaaaatcctgagctttaaaacttgcttttacctgcagactctaatgttcgacttgtggctttgtcatttccccacaggggcagcttccgctggttttacaggacagaaaagttctgtttctattactgaagaggttgaaccctctgctgaagctaattccaaacaaagtaggcaccatatcttctttcaaaagatcccttagggaataattgcaaagagatgctgtgattaggtaattacatgtgtgactctgcccaagaaacctgctttctacctaatttatactttgatttccctctctcgtgtcaaaaagcatatctagccttatttatctgactaccctgcacagaattttctcatcatgtaattgaaggtcactagaaaataatacttttttgaaagcgtgtctgataacaaacaaacaaaaaatggttagaatcactgctaaatatgaataattctattttccaatgctaaaaatgcacatctgttccagaaagacttggactcacatcctacttttcaaaatgcttcagccattcaacccttgatgctatgggcataaatgaagtttagaagttctataagcagtggggaagctagaattggaccttgaggtcccccccttttttttttttttgatgtttgttaggaattaagatggccttaggtattagtctgttttcatgctgctgataaagacatacctgagactgggtaatttataaagaaaaagaagtttaatggactcacagttccatgtggctggggaggcctcacaatcatggcagaaggcaaaggcatgacttacatggcagcagacaagagagaaaatgagagccaaatgaaaggaggaaccccttatagaaacatcagatctcatgagacttatttactaccaagagaacagtatggaggaaaccatccccatgattcattatttcccacatggtcccacctacaacatgtgggaattatgggagctacaattcaagatgagatttgggtgaggacacagccaaaccatatcaccttacaagttccatgtctagtacagagcttgaccctaagtggatgttcagaaagcatcttcagaatgaaaaggggggcacagttaagacctctggtaaattgtacgatagcttgtggggggaaaatcactgtagttagtgggaagaatgtggcttctttgcttaggacagttgtggatttactggctgaaggaatcactcacagaagtcattctacattagtggtcaaaagcatatgcttttgagtcatatagatgtaggcaaatcattttaaagattgttgctatatttttagtataagtgtgtcctgcccaacattgacacacacttattctaaaaaattgtttatctgagattcaaatgtagctgggcaccttattattgtatttgtttgtttgctttgaaatcctaactcagtcccactagtcccatttttgtaatgtttagctttcaggcaacaaccgctgaagaggtaaagagattatttttgaagagtcatgtgattttggctgctcctagctgacctactagagaaaaatcttaacattttccacaaacttttccattaaaatagaggataggtcattgctaaagaactggcagagcttcccaagacaaaacttgtggatagagtggaaactatgatctagcccgtccagtgaggtagactcaagatcaggtacataaactttactgaaaaaatgtgttttttctcatgggacgtatttacttgaggaagtatttaatcccttagcatagacctttaggttttcaatgaaaatatgatgagttgaaacatttgatatgctgatggcattctgactgatacttttcataacaaattcagaagtgaaaaataatttggtatgctgaaatggtggcctaaagtgtgaacgattaacttaataggaacaaatgtaagattccgtacttgattctaaacaatgaactttactagtagagaagttgactagtagagaatgaagtttactagtagagaaattgggaagccatgatttagtagaggcataaatgaaagcaagggttagcattttaatttaattttaatatcagtatattgacttaccaatttcatatttttttatatttttatgacatatctttgagaaaggggtttgcatgaatctttaggaaggctgaatcaaatgattcagggttgggggagtgatattggcagttacatgttgtattagtccattctcatgcagccatgaagacatacttcagactgggtcatttataaagaaaagaggttttaattgattcatggttttgcatggctggtgaggcctcaggaaagttacagtatggccgaaggggaagcaaatatgtccttcacatggcagcaggagagagaagtgcagagcaaaggggagaaaagccccctataaaactatcagattttgggagaactcattcactatcatgagaacagcatggggagactgccctcatgatccaatcaccactcatgaggtccctcccccaacacgtggggattacaattcagattaccattcaagatgagatttgggtggggacacagaaccagaccatagcattctgccacttgcccctctcaaatctcatgtttctcacatttcaaaacaaaattatgccttcccaacagtttcccaaagtcgtaactcattttggcattaacccaaaagtccaagtccatagtctgatttgagacaaggcaagtcccttccacctatgagcctgtaaaatcaaaagcaagttaggtacttcctagatacaatggagatacaggcattgggtaaatatgctcattccaaatgggaaaaactggccaaaacataggggctacaggatccgggcaagtctgaaatccaacaaggcagtaattaactcttaaagctccaaaataatctcctttgactctgtgtctcacatccaggtcacattgatgcaggaagtgtgttcccatggccttgggcagctttgtccctgtggctttgcagggtacagccctcctcctggctgctttcatgggctggcagcgtctatgacttttccaggtgctctgtgcaagctgtccatggatctaccatcctggggtctggaggacagtggcccttttctcacagctcaactaggcagtgccccagtggggactatgtgtggtggctctgatcccacattccccttctgcacttccctagcagaggttctgcatgagggctctgcccctgcagcagacttctgcctggacatccaggcatttccatacatcttctgaagtctaggcagatgttcccaaactccaattcttgatttctgtgcatctgcaggctcaacaccacatggaagctgccaaggctcgaggcttgcaccctctgaagccacagtctgagctgtaccttggccccttttatccatggctggagaagctgggacacagagcactaagtccttaggctgcacacagctggggggccctggctccagcccacaaaaccattttttccatctaggcctcagggcctgtgatggcaggggctaccatgaagatctgtgacatgccctgcaatttccccattgtcttggtgattaacatttagctccttgttacttatgcaaatttctgcagcaggcttgaatttctccccagaacatgggtttttcttttctattgcattgtcaggttgcaaattttccaaacttatatgctctgcttcctcttgcaagctttgctgcttagaaatttcttccaccagataccctacatcatctctctcaggtttaagttccacagatctctagggcaagggcaagggcaaaatgccatcagtctctttgctaaagcatagcaagagtgacctttgcttcagttctcaacaagttcctcatctctgtctgagatcacctcagcctggacttcattgtccatatcaccatcagcattttggtcaaagccattcaacaagtatctagtaagttccaaactttaccacattttcctgtgttcttctgagtcctccaaactgttccaacctctgcctgttacacagttccaaagtcacttccacatttttgggtatccttacggcagcaccccgctccctcggtaccaatttgctttattagtctattctcacactgctacaaagacatacctgagactgggtgatttataaagtaaagtggtttaattgactcacagttttgcagggttggggaggcctcatgaacttacaatgatggtggatggggaagcaaatacgttcatcttcacatggcagcaagatggagaagtgcagagtgaagggagagacagctccttataaagccattagatcccatgagaactcactcactatcatgagaacagcatgaggggaaggctcccatgacctaatcacctcccatgaggtccctcccccaacacgtggggattatgatttggattacaattcaagatgagatttgggtggggacataaagccagaccgtatgacatggtgaaatagttacaactgttttcatgaagcttttttggtctcaagatctgtgtgctatttgaataaatgagatgcagctggtttccaacgtgttttcctagcattggggtttaaagaaaaaagtaaaaaggacctaccttggaaatcatttcagaaaactgattcttaagcagtgattctcgaacttgagtgtatatcagaatcacgtatagcaggggtccccaacctctgggctatggaccacagcaggagagtcagcaataaccccctgagctccacctcctgtcagattggtagtgtcattagagtctcatagaaagtggctatgttgcctggggtatataccctggggtttcttgttgtgtaccaggaaaatttaggtcatggacacacacgaggagtttaggagtggaggtttaacacgtagaagagaagagaaagagaaacagcttcctctatagaggaagtggtcttggagcagaaaaagaccagcgggtggcagctgtgctgaattttatagtcaggtttaaagaggcagtgtctgatttgcatagtgctcacccattggttctgtcaggtatgatgtttacacagggcatgggcaaggctggtcaccccaccctaatcttatgcaaatgggctttccagttgattggcaccatcttgtctgcttcttactgtacatgtggctggcagagaaaggaagacggagctgccatcttgaacatgtctagtccttagttcctgccagcattcacctgtgcaagtctccagcttgcttgtctatgtctgcagctcaactttacattttctttgttagaaaattatttggggttgctttttattaaaaagaaaagccttaccaaggattcccatgcccttaccatctgcctgtgtaatttcttcttaactcctgtatcatcaggaacgtgaaccctattgtgaattgtacatgccagggatctagattgtgtgctccttatgagaatgtaatgcctgatgatctgaggtagaacagtttcaacccgaatccaccccacccaccaactttccccatcccatgaaaaaattagcttccacaaaactggtccttggtgctgaaaaggttggaagactgctgatctatagggtttattaaaacagtaggccccccaccttcagcatttttaactcagaagttcagggatgaggactgagaatttgcatttctaactagtcccccgagtggtgatgctactttagatcgtaacgttcatattgaaacatttgtcctacctacggatgccaatgaccaaggcatatgttggacgagcactgtgagaataggtagaatcaactctacttgagtgcattgcccacacaactgcttagtcttgtgtgcgtttagggaaagaacaggtggggagtgggggaggtacacttcgcccaaccatttgcttgtagatcttcatggactcctcccagagttcacctttgaagactaaggtatggtagtgccaagagtggagatactcctttatcagggcctctggggtcatggtcctgggctgtgacctcagcacgacatcagcacaaccaaaacaaaccacaggctggtgtttaggttcttgtcaagacctcatgcatcattaaacagagggcaactgcagagctctccattctgttttaagaaaatagaaatagtaactagcattaaactaaacccacaaacgcctgttccctcttgatagggtggtcacgctactgctgcattgttttgctttttcttttttttctgatgcagctatagtacaagccgtgactcatgctaggtgctagcctcacagatatacataaacattcacaatcaggtttccaaagctgtttccttacttccctttgttgctattttacttttcattggaggttgggcgaggcaatctttaaatgaagctattttttctttgtctctctgtccctctgtgtctctctctgtgtctcacacacatacacatgcacacacacacacacacagacacacacacacacacacacacagtctagctgaatcacgaattccgtgagaacagagtcagcatttgtatattttctcagagatctattcctaaccttaatgccatacctagcacatagcagacacacaaaatttgtgactgactgaatgaataaacatgtatattattgcaagccagttgcaaacagatatattgttgcaaacagaaggttacctgttgatccttcctatgttatctctgaactgcaggaacttcattttttctatgaaccaaatgtaggtcatcatgaatcaagcgtccataatatctgtttgtccacatataacctattttatagcagagcttatattctgatgatttgtagatttaatgttgtttattcatcatatctatcacatttgttttttaaatatttctaaacagctgattaaagtacaattggatggaggtaaaaatatttttaaagacgtataatataaaaggacagtaattggatatagttattcaaatgtaacacttaatttactttgagtttttacttaaccctgtaacaatggaattgtgttagcttacataattttcattgtttaattgaaagaagaagaaaaagaaaaagcagctgcaacagcggtagcaacaacacgccaaaaaacggaaagataatactttttccacttggcatttatttctgggaagaatgtatcttaagagcctttactgaaaagggcattgagttacacaggcaatagctttttcaacagctatttttccagaggtgtaaaaacagcctttgcctggttacattgtatatcttacctcagtaaagtcatgaaaaggaatcgtgataaggtgaatgcactcctacagagcgctaagcttcctggcgatttgacttgattcgggaatagaactcagtaaactgagcagattaaatgatcaatgtttcttttagattagccctctcaaatatcaatggtctctgccagccttagatgagataatgaggtaatttcaatactgagcttttgacagagtgtctgaagtgtaaagagtctgtggtattagaaacatgtctcagcatggcactgcccagcatcagcaggggccttctgagaggccaccgttgtccagagtctaagacactggtccagtggggacacatgagatgacatgggtttgtgtgtgtcttaattgcagtcctcgagaagagacaaggatgtgagtgtgtatagtttatttaaaaggtgcaggaagcatcagtactgcacacaagacaaggaaaaagaaaggagagtcaacgtagggtgcagtattaagctatggtaggcaactaaagtttaatcctgtaagaaaactctggaagtaatgtagaagacacacttcagagttatccatcctgaggagggagggagttcccttcagctggaggtacttatttcagtgctcttggttgaggactactcccagaaaaagggtgttgatttgggaacacttccaaccagaggggcatcacacctgccacatacacaggaagattcatcttctgtggttctgggaaaagccttcaggcacagaactgcacatcctgcaatgggaggttgtctggagcacagtgaagtggggtgcagtctgaggaatttggcaagacactgacagcatctcctctggtgtggaaaatggcattagaaagcagtggtcacaaggctgggtgcagtggctcacgcctgcaatcccagacatttcagaggctgaggcagatggatcacctgagctcaggggtttgagatcagcctgggcaacatggtgaaaccctgttctactagaaatacaaaaattagccaggtgtgctggtgtgcacctgtagttccagctactcaataggctgagacagaaggaatgcttgagccagggagacggaggttgcagtgagctgagatggcaccattgcactccagcctgggtgacagagtaagaccttagctcaaaaaaaattaaataaaagggagcaagggagagggagggagagggagagagggagggagggagggagggaaggagggaggcctgttgacagaacaatgaataattacgcacatacctaaagcgaatactcaggtgagatccccaagtacactctttcaagtatgggttagatattctaactgaagcaaatgtaaaaattgaatgttaacagtgggtctcttctattagtgtggttgtttgctgtcttctccagaatggatgtttttaagaagtcctttctcctcaccggttcccactagctgcaaaggttacccttacatccttgaatctctggattttttaaacccatttctctaatgctgcttataatattgttgataatatttgtcaccccttggcttgttcaaatatatttcattccactataggtatattcgcacgttttcacgctgctgataaagacatgccctcgactgggtaataaggaaaaagaggtttgatggactcacagccctcacaatcatggtggaaggtgaagaggagcaaaatcgtgtctcatgtggcagcagacaggagagaatgagaaccaaatgaaaggggtttccccttataaaaccatcagatttcatgagacttattcactaccatgagaacagtatgggggaaagtgcccccatgattcaattatttcccaccaggtccctcccacaacgtgtgggaattattaattcaagatgagatttgggttggggacgcagccaaaccatatcagtaggtcaaatgcaaagcctgaaatatggagaggaagacatcagtataaatcctggttccgtcacttgaatacgttgccttgagcaaattattcccttgcagaatctcagtttttccacctgtaaaatggagacggcaaaaattaacagtcacctcggggagtaattatgacaccagaatgagctaataaacatcactgttttgctcggtggtgaggttgagtccaaaccttagcagttatgattgtggttgttgctgttgtccttactaattactccatagattgatttgagttttgcaatcagtttgatgccttgttccatagtttcttttttacttccagatttggttcaggtaaagttggcaaagcaaggagagctggattcttcttacctgcttcaccttagctggttcctgcttcatacatctttcaagatgtttgtagaaaactaatcagcgtctacgtttgttttctaattttcttttgctcacacatactgtggccacttgattaccaatcagtgctgtgttggcaggcacatacaggccctattcctactaatcagagatgtgggaagcaaatgctggtgtttaaagggaacccttatttgagctcttgtcccatgactcctaattgttgtatttctcaaactcaacccagctgcaagctttattagggaaacatttattcagataaaagcctcagttatgaaagaggggtaattattttgcaaatgtgtttgaatcactgtatgctgtagtgcaactcatccccaaatggagaaggtgcacatttgggctgaaatgttgctttgtagatggacaatacaacaagcatatgacggggaacttctggcaaacgataggaaaatggtcaaatgaaaagacaccagtaaaatgagagattggatgaaaagtgatcaggaagctctgaaagctgaccagagtgaacaaaatgcctaaattccgttcatccacattcatttatttattcattcattaaccattgaatattttggggctcctatacatagtttgctctcaaagaattttaggttttagttgggagagagcaatgaaaatatgttaactgcatgccaactgggatctcccattcagtgaaatctagatagcgttggaccaaaaccctgttctgtgccttgagaatgctcagtgatatccatgacatttctggaatttcacgggggtgggtgctcacctaccaaaggtcccctcctagctctaagatcagcttctgcttatttcgttgttttgcttcatcatctttacattgcacaatccacgtgtagaaaatagcccttccctttcctttgtgcgccaaaatttacataaagcattgtgtggatagcacactttattgaaattctagaaagttgtatttggagattgtatcaactcccagtggaatattaaacacggctattcttaaatgtcctccaggcaccaggcacattttcttttgttgcttgtaccgagctctctatctctaaccacctccgagttttctttttccatccctgttcccatctctccttctcttaatgttctgcccagtatatgggggctatcacatggcatgattattctatattcttgctccctcattgagttccagtctcaagcacttatattcatacccaggaagttgttctccagaatataacagttctcttccatttaaaagaaacttccctcagtggtaattcaaggagttcttcatatatcctgaatataagtctgtcagatgcatgaattacaagtctcttccctttgtgtcttgtctttcactttcttaatggtgtcgtttgataaacagatgttctgtattttaatgaaggctaattatttatttttcctatcaggcttattgcttcttgtgtcctgtttaagaaatatttgcataccccaaggtcacagacattctccactaggttttctaaaagcttgcttttcgtaggtttcatgattaattttcatcttaagttaattttgtgtatggtgtgaggtagaggtcaagatgtatgatttttccagttgctgccgcaaaatgtattgagaagatcaccctttccgtcactgaattgcagccataaatcaaataaccaatatgtgtgatctatttccgcactgtctttccctggtctttatatttaaccttgtgccaatatgagggtggtaaattttaatcatcttcctttttatgtaggcatttaaaactatcctgttataagtgctctggtaatagaaatacagactataacacacgccagaggatttgacctaagggaagagggtcagagttggctttctgagcggatgtgccatttaggtggagaagtactttgtgcgtctgcattctagggcatgccctgcttggcagttttctcattttatgatgggtcctgtgatgtggccaatgtgaaccatgctgtatgtgcactggcctggaatagataacaacaataaaagaaggaagatgcccaagaagaagtcaaataacctcattgtaaagatgtgaaattgaggtttaaagagaacatgtgatatgcccaaggtcacagagttgatgagttacaatgctgggattggaactcaggtttcccaatagatccaccctcttcccatgaccctgcattgcctgtaggtacaaatgctcaaagttgctgagctataatgtggtgatgcttggactcgtactcagttctgtttaacttcagagtctgtgctctaccccgtatccttgattacctccttggaaaagctgaatttatttgtatgcctaactaagaatgagctaattgattcccattttaatatgacagctctgccttagcactatcaatatgtgtccaaaaaatcttatggtgcatgactaattgcactttggaatcgtatacatttaattatatatttgatttgagagtttagcatttacaattattgtcatctcccacttactgagcttccattcttccattctgattgtctctgttacagactttttttctcatgcatagagaagaaataaaggcacaatttcctttttccatatttatgtgttatatattcctttagcatcatgagccacatatgatagtattgctagatcagttctcataatgtaccctttgcaggatagactgtgaaaatctaattttggcaaaatgactgaaatcccagtgaatgattttttcttttcttatataaacctaagcatccaatagtgaaagtttatatgactcaaatggaagaagaattcatgacaaaaggtgtgattattcgcataagaccctgaaattcctttctgggtgaaataggccctttcttccttccataagaggctctgactgatgagttggcttttattaggcaatgtatgtctgatgcaatatctgtggataaaaccaccagcccctatcaagtcaatcaaatatttactgagcacttattatgtccaagacactttggagaacaaagaaatataacctggccttgcccttcaggctgtatcaattgagatagaatttggactgctgcaatcaattacacagatgtctctcaaggtagtgtcttgatgcttgagggaaacaagacaaaatgctattaataatgacttagttttctttgtcaagcaatcggcttgccacatcattgaggtaacttcacattttcttgcatcttttacaattagcagcttcagctgactctgcaacctgttgagaaagagggcccaggcaatgttgtccttggcatcttattcaggtctggcttccactgcagtgaatgcactcagatagccctttatcagctgagtccccttgagattaagtatttaatgtctcttgatctccagccttaggaaataacccaattcattactcagccattatgtaattcattactgtcattagagatcaggagaatcgtcttaggagaactgagaatacaaggcaaaccacacctttctttgtccagcatgattaacggactgtggaagggccctaatttggagttccattcatgggatttggttttatgacatcctccagtcccaggcttctggtatgacttgcagaggcattggttaacctggtggaaaatggattactactcaacgtgtttaccgatactgtgtgtctgtagtgggctttggtggactcctttatgggattgttgatctctcaacagaacagagaagttggtcaggaaggttattaagggagaatgcataagggagctgctttttctagactggagtgagggtcatggattgcttcccagggaacatttggcaatgtctggagataattttttgttgtgacagtgtggaccaggagtgggaggagaacatgactagcatctagtgggtgaaggccaggggtggtgttaacatcctacaatatacaggactgcctatcatagcagaattatctggcccaaaatttcagcagtaccactgttgagaaaccctgggtacctgcccattactgctcccttctaaaacaacacatatttcttcataggcccttgtgaatttatttgttttatttgatgagagagagaaagagagagagagagacagacagagactgatacatttgtacctatctatctatttacaacttctccattccctacttcatttcacaaggtattaggtaaagcaggtatataaataacactcaataaagtagttaagagaaattttaaaaaaatacacagggggaaatacaaattaaagtaggcagtagcaactgtagaaaatatattatactggtaatctgacagtctgacttataattgctgtcattttctttgagcttcctgagagccaaaacaaaaatagaaacagtcattatactttttgttatccatgaggagaaaacagtgtagagaaagcttttaataacacaaagacatttctcaagtagaacttaatgtaaataagtgttggcaaaggacaagatagtaaatattttcaactttgtgggccatgaagtttctgtggcagtcactcaactgtgcccgtgtagtccccaaagtgtccacagacaatatggaaacaaatgggtgtgactgtgttctaataaaacttaatacaaaaaaacaaagggtcagatttggctcttggaccatagttggtcaagcctcagtgtaggtcttcagaaacactcctggatcaagtacgaaatggatattaagatgatgtttcctaggccactgactgaaaccgagagctttcccttacagggtgctaaacgactttctgcaccatcggtagtttctacgaggatggaagaacaataacaataataacaaaatatcttcttagggcatttactgtggtgcatatcaaggattttgtgttttttttcttcgcggttgtttagttttgctttgggtgacaccccttctcatttgctgtgaagataccgcaggatgataaactccctcttctatactaagtcccatctgcaaggaaaggaaacttcactctgctccttccatcttgctgaatatttaaagggtattgacacaaggcgttttgataggccaaaagtattattatcctaaaaaatatttcctgtgatttaggcacatggagaggcaccgtgttagagagtcaagataaaatacctacctaaagactcttcctctgagtcatttcctagggacactctcagttcctttggtggccacagtttggctgtcatttcctctgtgaattcttctacgactctttggaggaaggatgtggtcttcacctttgtccttccgtatgttttgtaattctgaattttatagcacttctcctggcgtcttataactttatatttctctttcccctgatcaactgagcttcttgaggggacagtataagtctttctgatcttttgccctcccctgtgtcttttgcaacatgtagaacatactagatttccataactatttgttgattaaattaatgactagatggatggatggatggatggatacatggatgaatggagggagggagggaggaagagagggatggataaatggatgtgggagggaagggtggaaggatggaataatggaaagaagaacatcagcagcttctcaaaaatgtaagttctaacataagtagtaatattacttatgaaatattttattgatagtcaagcaccctgattaaacttgtcctatttcatcatataaaattaagcttaatcttcatttaggccaggtgtggtggctgatgcctgtaatcccagcactttgtgaggccaaggcaggcagatcacttgaggccagggagttcaagaccagcctggccaagatggcaaaacctcatctctactaaaagtacaaaaattagcctggcgtggtggcctgtgcctgtaatcccagctgcttaggaggctgaggcgtgaaaattgcttgaaaccaggaggtggaggttgcagtgagccaagatcacaccactgcactccagcgtgggtgacagaatgaaactctgtctcaaaaaaaagaaagaaaaaacatactcattcagtaacaaaacaaaatctcaaggcaacatatctgatttatggttcactaacataaatacatatgcctagaaattcactgaacgtcaaaatgatttatacatacaatcactagagtgaagttgaaagtgttttaagcagaatctgcatttaaaatgcatatatatttattagaaaggatgccataacagattggatacatacaatcaaattgttgctaataacactaggccaaagtctttataagtgcgcacgcctgtgtgtgtgtgtgtgtgtgtgtgtgtgtgtgtgtgtgtgtgtgatgttgtaagaaagtttaaggctatctcccttccttattcctctctctgattactgtcaatgctagctagttgatgtcagtaatgacaagtttgtattttaatttttaagcttgagtgatccatcacacctcaaccagagtaggtggttattcctactacctgcttggatgtcaaatgcatcagttggcaatttgtatttcttcagctttctctccctcctattttctgtgtttattctgtctatctacttatttcttacacaagagtgaccaagagtgtgtacccaggaggtgacggtcaagagtataacgtttcagaattaaaaaatattatagttgcaaactggatattttggataatactggaaaaacggaaatattagatcatgaaatcagatattatccatacttctgtgttaactacgataattatcttaatttgatgtttcggtttttccatttgcttattgtatgtaattttgacacatctgccttaattaataagaatggtacaaaattaagtaaattttacaaaaagacattttaaaagaactctttattcaaggaggaaacttaacaaatttaattttctttgatataaaatatcaaaagccataactagatattttattcaaatattaagcttgcaagtttgggagtaggggtgggaatcccactacagtcaaattattttgatgttactttccaggcttagagtttatcttccatatttccaatgagaatcagttcctcaagtggaattttatgataaactgctgaaagtagtatttaaaatggaaaccctgacaagaatgagtgtcacagggagtaatgaattcatgatggaactagttgggagtgtgtgacattttaagtgcctcatcactctgaattcactgggcatttattgtaatagaaaggaccatattgaattcatttggcattcatgtggacttcacatgtatttatggagatgtaacatggtaatttaatatttattctactaagcattctttaatggacattgaaagatattgtcatacaatgcttagtaaagccggtaactctaacgttattcttctatcaaaacaaagaaatgaaacaccattttgattcccaaagcacccgagtaagttatttggataagccaacattatgtatttactcccccaaatctgctttctaaatttttaagccacaaggttgactctaggaccaagacaataaagcagaagttcagtttaggattctttatattctaaaattgtctgcaaatacattaatctcagtctaaaaatattaggggaagattttcttggaacatcagcagtaaatttaacacatggcatgccttcaatagatttctcttcttccccctttagagttcagtttgctgtcttcatcacagtcccaaaaaatacatttgtgtttcttccttgaagaagaattatttttagaacaaacacatcattatttgggaacaatcaaaagatcaaaggcataagaatctttgctggaaagtgaaggaagagttcttcaaccaaccaaaatgacaatcttttatttttattctaagaacagagttgttccaggacacagcctaatgcaaactctgctactagtcactttcaaaatgttgtctagaatgccttgtttttaaattttctctcagttgccttctttacaccactcaaaagcagaacctttattacaaacacaccaaaaggtaccatataactaatcttcctggtttgaatgtaaccaatgttcaaatatgattgtagagtattaattattttgacatcaatttactgaacacattttaatgaggaccagaaggaaagacaaagtttacttactttcgtgatatatatctggtccagaccttgtaagtaatagcactttcaaacttactatagaaaattcagtgactgtaaacatctttcaactctacattgtgagagagttttcaaatctttggcaaattaccctgtgtaaacctccttatgacccaaagagatattttgaatgaggggatgtattagtttcttagggctgacatgaaaaagtactgggtgacttaaaacagaaactacttgtctcatagctctggaagctagaagtctgaaatcaaagtgctgtcaagggccacactactttcagagtgtctaggggaggattcggcctcaccttttttaggttctggcagccccaggtgttccttggcttgtagctgaatcactgcaatctctgctttgttcctcacacagtgttctccctgcgtctctgtcttcacatggcattttcttatatggaccccacgcatactggaataggtccactctaacggcttcctcttaactcgatgacatgtgcacagattctattcccaaataaggtcacttttgcagattccaggggttaggagttggacgtttcttttagggggacacaattcaacccctaaatggggatctcctgacagttcttaatagggtcaatatttcaatgcgtgcatttgttttttataatgatcttttctatgatactgggtgagataaaaaccaacttatttgcctttaagagcttctttgttttctgccatttgtgctagcaacagtcagagaaaactttttttttatagcaaattgtttttctcaacacattctgtctggaaaagaatgttctctagttaccacctctttggtctaagggcatctccttggtttctgtgttacagcctctttgtgttaattataagttgctttgctttacagactcaaaatgaatgttacagtgactgataaaagccaggatcctgagttcaagatcctgaccaattgggtgcttcatttgaaatcagaatctgtgttcactgtggtttacttggggtatgtgttagatttctcttggttgcaagcaaaaggaattcacaatggttagtatcaagcaggtaagaaaagggaagaaagaagattgttgaggtgtgtcttagttcactagggctcctataacaaagtgccacaaactgggtggcttaaacaaaataaatttcctgtcaatctcttctagaggctggaagtctaaggtcaaggtgtaggtagggctggtttcttctgagggctgtgaggggaatctgttcatgcctctctcagcttctggaggtttgctagaaacctttggcattccttagcttatagccgcatcatcccaatctcaaccttccctttgcatgccagtctccctgtgtctatgtctgcctctgagtccaaatctcccattttttttggtaaggacgtggtatggtttggctgtgtccccacccaaatctcatcttgaattgtagctcccataattcccacgtgttatgggagggactgggtgggagataattgaatcatgggggtggtttctaccatactgttcttgtggtagtgagtaagtctcaggagatctgatggttttagaagtggtctccctattcgcttggttctcattctctttttcacttgctgctgatgtaagatgtgcctttcgcctttcaccatgattgtgaggcctctccagccacgtgtaactgtgagtccattaaacatctttttctttataaacatgtctttatcagcattgtgaaaatggactaatacaggataccagtgatactggattaaggtctacccatgactttattttaacttgattacctctgtaaagaccctatctccaaataaagtcactgagagttagaactcccacatcttttttttttttttttttggtggtggttggcgaggacagtgaaacccacagcagtgagagagttgtatgcacatggacacaaaagagcatctgatcataaagagaaggaaaccaaacctgtctgggcactgcaatgtgtgaatctagaactctccaactgctatgcttcagcttagatgttgcgcatcaccatatttctgtgtcctgaatttcacatcttcgagaagaattttattggtccagttgagcccagataccttcccttggctcaatcttcaatggccagggagtgagggcacaggtcacaatggccatgttttgagggatgtgcaagtttgtgtgtgtgcttgtgtacatgtgtgaggattttgtcctctacaaaagtcagtggaatcattgtgagactgtgagctggcaagaggatatctccttcccccacatccctcaccccatcccaatctctggagaggaaagactgcctgtgctctcaaagaagaagtggcttttcattgattcagaaagaaatgtcagttgatatctgcttcctataaggtgttctgtcctgagctggaggtatagatacaagaaatgggtcctgatattcagctattggcatgggtaagactgaagtaggaaaggacttttcatctcctcccaagccgaggacacagctcaccatgaggtcgttgggtacgctggcttcatctaaaagaaccacatttaggttcttatgcgagaccacggcatgagctcagtccatggcaatgagtcctattttgttgagatgcccaagcaggagtttccttactgccagcatctacagggctgccatgtgctccccacaactctcccaggcttggctcaagtgcagggaggcccaggtaactccaaagagagggtccattcatcatggacccaggctttctctgatgtccataactgtctccccctggggattttgatgaatattcaaggacataaattcacacacgggctcagctgttgtacacccatgggaatcaggaggctcagtatatcttcctaagtgttccatttctttcccaggagccacagaagtgcaacaaagagatgagccccataaaccactgcatgtgtgtgtttgtcatttttctttagtgcaaggtttacaagactccctcccaacagggtcgtcatctcaacacatgtcacttggctatacgcttcactggaacattgtgttgtgctggggctgaattaaatgtgcaattactgcacattttctcgaaaggagttttgacaatgataaatgcatagacatttttccacactcagacaacgtgactccttgctcatcaagtggctcaggattcactttgaagaactggtctcttgttaacaggagaacgtgggtgctgcccgagaagcgcatgggcctgagttcaagtgccacttctacctgtcatgtaccatctgagcgtgggcagctttcttactcctgctagcccgagttttcaatgagcaatcattgcacctctgataaacctcattggctatggtatttctatatgcaaagctgagacaacacttggaaagtaattaccatagtccctggttaatagtaagctttcaatgagtgttggctagcattcatgcccgtaagttatcctcttgcctagagcagtgatggctctaatgtgagttcagatccctacaataggagaaacagtgcttgttgcttttcaaaaagcagagaataaccataacttttctacagatccttgaatataataacagtagctaatatctgtttacttattacctgctaggcaatgtgatcaattttctgtggatcagatgattcaattctcatacaaaccctgtgaactttttggtatttattttacatattaggaatcctggtgggccaactgcagcccactggcccctccaggtccactgtccaccattctctactctctggtgccacaagatgcttatctgtatgaagccttaggaaggaaaccagaagaactgacaccctgtcttgttctccctccacctctgattcctcactagtgcttctaatttactgaagccagctggaaaccagaagacaaggctgccaggtgctctgacaaaggacggagcagggtatagaagggagagtaaattcagaggactaagcaaatgtactcagcacatctgcttgtgaacatactgccagcaagtgccatttgttttaagcgatagagaattagatatcctctttgctgtactgttccaaactgcttatttctttctccttctttttcctcatagactatgatcttttgatattatagcaggaaacttggcgtgggctagcatcttggtgtaatccaacctctcttagatttgtggatatttcattgtgaaaaggtcaagataaaaaatacattactaaatatccatttatcctttattttctcatcatatacagaaaggttattgccaaatatggccataaaggttttattgctccaatttttatagcaaaaacagatacacttcttaatgaattttggtttattagatcaccagtgaccaacatggggtttctagctcttaggagaccctgatggtggcaatgaaggtctgcaagctattttaaatatttcagaaaatctaatataatcttacttttacaaatgataaagcttcacaaacaaaaacatcaagatgttttgcttttgactgaaatgatattagctctgcatggtgaacttagtaatttaattctgatcagcagctctggttggcagttatatgtgcctttgattaataaaacatgggtgagaaaataaattattacttaatctgtgcagtttgctagataaagtctttgaaaacctggagtcaattggatggaaaataatgaactgggtgctcagtggtgaaataataagcacaataccagcttggcatgtctcacatatgtaggaaagccaagacaggcttccagatgggccgagatctgataaacaattccagtcaattatttgtttttagtaataacaacgacaataataatgatgatagtaggtaacaattattaagtggccagacatagtgctgaaatgctctgcatgtaatattttatttcttccttccaatagacctaggaggaatgcactctgattatcccttatttcaggttggtctccttcagaagcagactcagacatttatgggctcagatagtttatttgggaggtaatgccaagaagcactgtagggaatgaagaaagtcagctggggaaggcaaggaaggcaacaccaggatgcactgaatggtagattgtctctgtgggcacctgggatgccaccccccttggcacgtctggggacagtgtagaacacacctttgagttgtaccacacaatcagtgaggaagctgggtattgctcttccgactcctgtttgtaattagttcagagctgctttcagggaagtcgacttcccggaacttccagttcaccctgtggaagggaaggggctgagcatgttctggtggctagagaaagccctcaggtacagagatacaggggtttccagaaagcctctggtgacgcacaaggatgtgagcacacaagaacagtacctgctgcacttccgtcctacaagagaggaagtcaagaattcatgagttgaaataacttatccagagtcacaaagcgcttgtgatggtgtgctcttccaaagaatttttttgctccctgtgtctgaaggctaccaatgtccaataatgtaccaaatgagcccttgttcttagagtttttttaaacaacagctttattgagatataattcacataccatactattcactcttttaaagtgtagcactccatggttttcagtctattcacagaattgtgcaaccgtcgccacaatgaactttagaatattttttaaatctcctggaaaaaaaaaaaaacactatcctgagtcatacctcattttccaccattatatcctcagctcctggcagccacaaaatctcattctgtctctgtttcattcccttttatggacattttatagaaactgaatataatatctgatcttttgtgcctgccttctttcacttaggatagtgttttaaatgttcatccctgttgtagcgtgtatcaatacttcagtctttgcattgccaaataatattccattgcctggatatatcacatttgtttatccacttattgctcaatgaacattttagttgtttccactttggggcgattttgaataacgttgctgtgaaaatatgcctataatctttggtgtggatatgcacctacctaggattagaattgctaggttatcggcaactctatttttaaccttttgaggaactgccagattctttttccaagcagtcttagagtttattgatgattttaatttgctgtttaattaagcaagatgcctgccttacactgtttggcaaaggagaaaaatcagcatcaggcacttgcagacatagatttccagaattcctaaaacattcaagaaggatgttatcggtacatgatcagagttgagtaggttctggattttaatgcctgtacttgctttttacttataaatgattaatactttagcttcataattatccatttagtttatgattatgggttgcctggttaaccctactgggtgtagtgatgcatgctttcatcagaaacatttttggcctgcagtttctaagtagccagattttaaagcatatacaggtggcagttcattaaacatgcattcgtttttgtttttatttggcacctactgtgaatcagtcactgtgttaggtgctgtgaatacagtggggggacaaaaacagatacaattgtgttagagaaaaataaactttgaaggaaactgcactagaagatacagcatttagtcattgctgggattctcttcattgcaagcagctactgcattccgattattcaccctgaatctaaggcaagctctgctctaaaatgtcacacaagaaagaagtggaaaacctcttctccaggaggggtttgcaatgtaaataaagagacaaagaatgccttaggtgtttcctctacctagcataatcaaatactactatgaaatatgcaagagtctgtgtcatcactgacattcagtcttggatttattttttttaactctgtgtactagacactgcctcttggatgtcccatagttcattgaactctccaagtgcaaagttaaactcaatctccccaccaacctctaacctcaacccagccccagacttttttttccagtgtatgctttctattttagcaaatcaagggtgctactcaccgtgctgttgccaaaaccacaaacatgggcatgattctcggtgtttctgtaggcttctctcacctaccctctagtcaggcaggtcttcatcatttaaccttctacttctctctgacagatttgcttctgtctatcctcatcttcatcctagatctaaaccaccattatctcttgcctgcaaccttttattcctaattctagtctttaatatctaatttctgctccaaatggcagctgaaggattattttcaagctcagatgtatcctgccacaccctttggaactcctcatggatcgttattacccccaggtttaagtccattttctttaacatatcagagccttgctccaaatggcagctgaaggattattttcaagctcaggtatatcctgccacaccctttggaactcctcttggatcatcattacccccgagtttaagtccattttctttaatacagcagcgcctgtccttcatgacccagcccctgatgccatctctggttttatctttacccactcccttagcagatgcttgtgttgagcagagccaaaccaaatctcttactatccctagaatgtgccaggttctttcacattggaaagtttgcataagatgagctttgaaaagtactttttcaataacttgtgtctcagtggatttctattaattaggatatgggtttggatgccatagcaaagattcaaatgtcagtggcttcaataagatagatgcatattactctctcaagtgatggttcaggcaggagcagttctagattgacatggtggccccactgtgtcacttagagacaaagtggagacaggggtggagagacataaatctatctgagagatgtgtaggaagctgaatctttaaaacctggcttccctcttattttatggcatttgtggaatgtatcctgtgtcctcatggccccagacaactcaccaccacatccacattctatcccagtcagtgggaaaggggaaaggggagccatatcccttctcttgaaatacacaagtggaaagttgcatctaccacctctcctcatatcttcttggcgagctgttgaccatatgactaaatctagctgcaaggaaaatcaagagctattggtctttctttgggggacaaatagaagtttctggtaattattttatgtaaaactaatccgaagaaataagtacattttccttccaaacatggcaatcctggcagggttgtgggcactggaatcacaccattttttgctaactaaacaaatttccaagtcaacaatgtcagatattggaagttcaagatagataaaggccactagtatgttggcaatagcatgccctctttacaaatgataaaatttagagaagtcaggtgcctcccaagtacccataacatgtacacgcccccctgctatcttctgaatccaccctctgtgctgaacaaacatgcagggcagtatactttagtgattaagaacaccagctttggactcagaaaggtctggatgcataatcacttattattgtgatatttacaaattccctaagttttctgagctttattttcccacaaggatgttatatgcattaaatgggataatatctagaaattacctaggaaatatctggccaatgattagcacttaagaaatgatctctagtataactataatgaatatctcttaaactttttctgctatgaccagttattgcttcttttggagacatgatagctggaaaatgtgcactcataattttgccagtgtttatttcttcataaggcaagacaaaaggagtcctgtggaagacgcctcttcactttcttcttaatgtacttggtctaaggtatccacacttgtctgagagatggcagaggtgggtgaggcaccacagctctgtctttctcttagtaaactcacagattcctaactaagtactcagagtctgctgtgtgccatacctaacctaaaatcccaattctacccattcctggctgtcagatcttggaaaagattcttgacctctcttagcaccaacctctgcttctaaaaatgagaataacttgaatacctacttaacaattgtcctcggaggaatagctgagacgcttcacctagaagtgcttaaaactgtgtctgatatatcgttcatgcttgataaatatgagctgacttaaattcccccatttaagcatgaatttcagcagaggcagtaggggtaaaaaggagaggatgcggtgaagaaaaatttagaaggcataatggaaaggacccagtgatggtccagtgtcagggagatggcccagatagaaatgtagcaaaattatcctgaaaaatttgattatttgatagaatggttcaccaagatggaaaacacagtcggggaggagagggcttgagaggaagacaatgagtaaaacgttaggcatggtcaatttgagtggtcaagggattcaccatggagatattaaacaggcattagatagccaggtctgaagctctgtagagaagtgtaagttcaaaacattcatttaggagtcacttgacccaggaggcaccagccgcaggtcacaggctccattgtcttcagggaccagtagcagtcatgtgaaaagcaggaaagagagacggttaacttggggtcaacaatgcgatgcacgccctgcccaaaggccttcaagtgcattcacctgggtgagtactcagcctgaggtctgaatggaaccttccacctgggaagatgttaaagtggttatgaacgaatgaaatctacccccaaggttttcctggtgcagaaagagaagactgaagatcaaatttacaacgtgcttagacttctacagtgttgctgaaatctacatcagacagtattttggcgaggagcaaggcttccccagcagtgttcatgatctgacagctgtaaccaatacctgacatttcccttttggatataaataattatctttcacagttatggcacatacacaacaagtaaatttccccttttatttggaaagcctctactttacaattcatgtttaccttcctgaatcttttctacatttcaaattcatgttttgtttaaaaagatgacagacacaggaaagcgttggttatggcaatataattaaaggacattcatttcactcaaacctgcatggtgatttttggcaggggagggggctggcaaatgatgttttgcctcctgtattagttttctatttcttctgtaaaaatttatgacaaaatttgtggcttaaagcaacccatggatgtctgaatggctttggttcctttctggaggcccaagggcagaatccactttcttccctctcccagtttctagaggctcacagccccttccttcattttcaaagccacaaaagttggatctctccagccattttctgagtagttacatctcctttgcactcttttcgacctccatctctaattttcaggacccttgtgattgcattgggttcacctgggtaagtgagaagactctttttaaggtcagctgattaacaacccaaattccacctgcataggttctgtttgccatataagtttataagttcctttatatctccgagtagtactgcgtggcatggatgtaccacacggttgttgttgtttttaaccctctacctgctgaaagacatctggtttgcttccagttttagcatttatgagtacggcagctatgcacaattgtgtacagatttttcttttaatggaggttttcattctctgagatgaattcgcccaaaagtgcaatgtctgggttatataattgcatgtgttgttttattttttaaaaaaacattgctaaactgttttccagagcggctataccattttacattctattgaagagttttgagcagtaaggtgatgcaatcctattcatgttttaaaaacattctctggatgatggatcaagaatgccagtagggagggcaaatgcagaagcagggagatcagaagggagcctctgcagtggttcaggtgagaggtgagagagagagtcaaagcatgggtgggtgtggctgagatgatgagaagcagtaggataagggacatatattgatgatataattgacagttgctgcagaattgtttgtggaaattgggagaaaagattcaaggaggatttctgtgctttgggcttgaggatggtggttcatgatggacctatttgtcttgataatgggaggacaggggtgggagctgacatgggaaagagatgagtgcctgttaaattctacagtggaaatcttgagtgggtggttagaaataagagtctggagccaaggggagatgtgggaagctggagagaaagtggaaaaggactatgtctataaatatgcccgatgcaaagcgtggcatagtcacaggcaaaagctatccacttgatctcaagaacaatcttttttcaccttctgggcttcacaaacaaaatagcaccttcagtttccatttcggtatagcaggtacggtaaccacaagaacgtgcaaagcagaaacaaagagcacttggcacccaagtcttatagaggctcatttctgatatcttctagggaacttctttgtataaggacgtcatagagaaggtttgtctttcatttgtctgtagcaaggtcgtaattttttttaatctttaaaaaaaattattgttaatacaaataagtctattgtgatttttaattctaggaagaatgccatacaaatcttttttagtacacgtttctgttttatactgtgatttggaggggtaaaaagggtaatacaaaatatggatagttttttcattgctggaatgttccacattgggttctgccttggcaacgtctcctgtgagctacagttgagggccaaagcagatgctccgtttttatgcatctgtcgatagccacatgactctgcaactgccactgcctccccacaccccctgagctggcgccagcacggagcagctgaatccgactcaggcttcatcccagctcacattccaccttcccgacaaggacactgaggcccagagatgaagtgggacttcccaccacaagtcaatgaggagatggggtagccaggcctaaaaccccggcctttggcttacagccgcccgtcattttcccaggtgcccacctcagaggccatccttggaaaaggaaacgtcactaacctatggttctggggaaatggagacgagagaggaagtaatatgttgttcttcttttctttaggcttctttccactgggtaaatcttctccatacataataaaatgaaggccccagatgatttgtgaaagagttgaaatgaacttcctgcaattgaacaaactattatgaagcccctactgtctttatcagcaattcacagtcttttgtccataagaataagcaggggacttaaaaaaaaaaaaaaaaaaaaaaaactactggtacttgggccttaccccagactaactaaattagaccctctagggtggactttgctctcagtatttttcaaagttacccatgctattccaacgtacagccaggaatgagaacaaactggtctatggtactgtgctaattgatcctgtctttggttctcaagttggggtgatttggcctctgcagaggataaaaggaaatgtctggagacttttggttgtcaccgttgggatgggggctgccgttggcttctagtgggtagaggtcagtgatgctttttaacctcctacaatgcactagacaacctccaccacaaagaattatctggccccaaacatcgatagtgccaaggtggagaaaccctaggcttatggatgccatgggaaacaccagttacctggatgtaaatccatggtaaaataacatagatgctatgacatgtggcccactggaagacacccatgtcaaatcccaggagccagtgaatgtgagcttatttggcaaaagagtctttgcagaggtaattaagttgggggtcttgagatcaaataatcctgaattatctgagcgtatcctaaattgaatttcaagtggccttgtaagagtcatagaggaaaacagatacacaggggagagggtgatataaccatagaggcagaaattacagcaatatggccccaagccaaggattcccagagccaccaggaggtggatgaagcaaggaaggatccttttttagagacttccaaaaaagcgtggccctgctgacaccttgatttaggtcttctggcctccagaggtatgagagaataaatccctattgtttttttgccacaaggtttgtagtaatttggtatggcagcaataggaaaccgatcagatgcctgtgcctttgtttgcaaaattcaacaaagcacattaggagagatggggtccatgagaagggataggatgcatgcaactcataaggctgaagacagacgggagtgggagtaggaaggtctagaagagaatctgacaaagatgcgggtgaaactctgaacccctggccagggcagggaagtcatgaaggccaagcaacacatccagtgatgattcttctgtcgacatttcatttctgaaaactggttgtttcattaaattttttggtttttcagatctcaaggtgtcagtatcttgtaacagtaatgagcttgattcgctgtgaaaagcaagacgtgtgaaatagaaacaaacttaaacttttaataatttcatttactaatggtcactaatgacctagaacccaagacacatatctttaaaaaaattagattagggaaatgatatataagcaaaataataatttagtaaaaggtgtaattatttttcttccttttgtaaaagttatttgtaattaacaaatgatcatttgtatatttttctagtaacacctaaaacttcctgatctttatccgtttaaccaacatgtatggtgttaaagaaacaggccaggtgtggtggctcacacctgtaatcccagcagtttgggaggctgaggcgggcagatcacctgaggtcaggagttgaagaccagcctggccaacatggtgaaaccccatctctactaaaaatacaaaaaaaaaaaaaattgccaggtgtggtggtgggcacctgtaatcccagctactagggaggctgaggcagaagaatcgcttgaacctgagaggcagaagttgtggtggaccaagaatgcaccattgcactccagcctgggcaacaagagtgaaactctgtctcaaagaaaagaaaagaaataactggaaagaaagtaccagcaaggaacgtcctttctcaatacctcttacatgatccctgtcccctacgtcctatggtttcaccgtatcacatcctcacacactcccctctaactccactttttaagtgactctgtttcctcttacattttcccatagtctgtcttccccttatataactgtcattatataactcattctgtaatgatttacttaaacctgacttccccattaggaagtatgctccatggggagagagcgcatatctgcttcgtatttcccccctaaatcctcaacacctgttacaattcccagtgtacagtaagcagtccataaagctggatgattactctgcatgtgttagtgacatgcatgaagtacccatttccccttggcacgggaagcccaggggaacagcattttcctgcctgacttctgaagccctcatactcatgatcctacgggagcaatggcaagggcaccggaaagccaggtcggagaatagagacccccagcctgctctcacagttggactcagcagtgcaacatcagtgactcctttgtgggagtcccacacaccgctgttcacacagggaacaccagtgcccggtggagctgcgggcttttgagacctcccgagtcgctttgtgtgcacaatgccgtgactctggatttgtacagtatgaccctcagacgctggaacaggagcacacgccaaagagaaaaaggagtggagatcactgagatctcataaatccataatgggcctgctctgtattaataaaacaatctcaatggtggagctccataaaagagaggcataggctgatgtaatttccttgaagtcccctgtaaagcattttactctgtaatacagctacatttatgaagtggttttatcttgaaagatcccaaagggcttactagactgaaaaggaaaatatcaagtacacgacatctcaaaacaccaccaatgtacttcggtgataacagttggggattctgtgacagcaggtagccctcttaaaaagcagacagcggcttagcccattaaacctccagggagaagtaaagagaaagaggagataattgtccacattggataagggccacacaggttttctttattaataaaggccatggcttgtttccatccgccacgtggatttaagtgggtgagctttatcaacatcattctccttatttgaaataaaagaaagaaaccaacttataacacttcttcataaagggactgagaaaatatatgtaaagcttccagtggttaatagaggtcaggtgtagccagtgtaatttagaagctgtgcattttaaaaagtaaaatataacctacagttataaaatatatccgacaggaaaaatatcttttcccagccaaattttactgaatccagtcctgtcgaaatgactgatcctgggtttttttcttccttgttgctgtcctggttaggacatggtggcactaacttttagtgaattagccgaggatataggggaatggttggcaggggccagaagtccttcttgattatcctccaagaatatcaccccactgggagctaagaaggaaggtggaagcaccaggtgatgtaagtttagcaatcgctgagtactgtcaaagaaagcagtctgagacttcaaagtaaataaaaagtagctcccctttcttcaaaaatgttaaaactgatccactctctaaccaggaatactgttgtctcacattccctctgcagtttctctcatcccacttctgcttccagcccaaacccctcacccgtctcgttttcccaccagaaagtactccttgtctttttactaatactttgcttcttccctccccacacgatctctccaaagcctgggaactgagctagcaaagagaatgctcttctgagcttggagctgaacaaggagcccctatggaggagacaaagatgcaaaatttttagtttggttttattctcatttaagttttctatggagtatttttcttgtgatttaatctttggatgagactatcaatgtacgtttcttctaattttatttttcaaatattccattgcaaacttatttagcatttataattgaatactgataagtgaatttatttattcatttatttattcatttattttgagatgcagtctcactctgccacccaagctggagtacagtggtgtgatcttggctcactgcaacctctacttccaggttcaagggattctcctgccatggccagtattattttttaaatttttagtagtgacggggtttcaccgtgttggccaggctggtctcaaactactgacctcaagtgatctgccagcctcagtctcccaaagtgctgggattacaggcatgagccactgctcccggccagtaaactttattttattttaaaaacctgttttggagtattagcccactggtttacattgtcttccttacatacatcacacccatatggaggagtactttaaagacaaagttgcaatctggtagcatagctgcccagtggagaaaaagtgcacatgtaaagcctgagtaattcagggcatgaaaatatccctgtcagccaatcagtcaacgagttgaccaagcgtcttggctagcctcagaggtaccttggcaggcaggctcaggcattgtgcagccctgtgtaaaattttcctcatagtaactacgttgtctttacatcaacctgagaagtagatactatttttcctatttttgtttgtttgtttgtttgtttgagacaaagactcggtctgtcgcccaggctggagtgcagtggtgcgatctcggcccatggcaacctccgcctcccgggttgacgccattctcctgcctcagcctcccgagtagctgggactacaggcgcccgccaccacgcccagctaatttttttgtatttttagtagagatggggtttcactgttggctaggatggtctcgatttcctgacctcgtgatccgcccacctccgcctcccaaagtgttgggattacaggcgtgagccagcgcgcctggcctatttttcctattttattaatgagaaaactgaggctcagagatgctaaataacatatctgagttcatcactgccagtcaatctgggctcaaacattccgatccagattgctctgattctagagcctttgttctggaaatctgtcttttataatacacagggattttatttttaaccttttattttgaaatgaattcagacttacaggaaagttgcaaaaagaatgtaggtaattcctttatatttttagttcaaatttttcaaatgttaacatattatcacatttacttaatgattcctccctcccccaactattgaagagaaaattgcagactcgatgccccttttcccctcatcttcagtgtgatatttcccaaaaacaaggatgttttttctctctcatagaatcacagaacaatgatcaaatcagcaaattaacgctattaaaaattatctaatcaacacacttaatttggatttatccaattaccgcactaatgtttttttattgcaaaagaaaatattttggcccaggatctaatccaggatttaatattgcctcagatctcatgtctctttaggttcctttaatctggaaaagttcttcatctttgttctgtctttcgtgaccatgacatagttgaagattataggttggttagtttgttcggtgtctcccatgattagatccaggttaaagaaacagctggaaagaaagtacaagcaaggaacttcctatgtcaacacctaaataatctctgccacccccacccccatggctttaccccatcacatcctcacaaactcccctctacctccacattttaggtgattctctttcctcttacattttctcatagtctgccctccctttatagctctaatcacaacttgaattgtataacaaattctataatgatttttttaaaactgacttccccattagggtgtatgctccctggggactgagctcatacctggttcgtatttgcgcccgctgaatcctcaacacctagtacaattctcagtaagcagtccctaaagctaagtgattactctgtatgtgttagtgaaatgcattaagtgcccatttccccttggcgtgggaagcccacaggaacagcattttcctgccttacttctgaagtccttgaactcacgctcctactggagtgatggcaaggccactggaaagccaggtcggagaacagagacccccccagcctgctttcacagttggttccggcagttgttgcatttgtggcaagaacctcatggcagtattgtgtccttcacagtgctttgtatcaggcagcatgtagcaggcttttgtgtccttactggtgacattaacttggaccacttacagagggtggtgtctgccaggtttctcctatataaacttaatttttcctcctttgtaactaacaagggtcttggaaggagatatttccagactacacaaataccttgtttcttttcatattttcacccactgattctaggcttctttgataatttttgccctcctgccccaccaaaaaatattttaccattatggttaccaaatggcgattctctaatggcatgagtccttctacatttatttgttggcattctattttaaggaaaagctccccccaacttaagaatttatttccaattttaaaagtttcattactatggttttatgggttctttttttattctgtagggtaacaatctgttgctacccttatttattcttgtgcgccaattgtccaccgtttgtccagtgggaagcctaacatgcagtttttatattcaagtatcctagcacgtcaacttttattgcttcacttaaaatctgccaccttccaccttcatgtcctgaatcctttatctagaaaatgtgtaattttccaagaaggcctcagacctagtggtccagttactgtctgtttttgctgactaactcttgaaataagaatttttttaaaagctggtagtagggatgaagggggttaagtgacagttctcctaagaagcatactcatggccctgccagcggcttggagacataagggaggtaaactgaaatctttcctgaacacttcatgctttttggtttctctccactttttaacacactgcagtgtaattccctccactatcctgaaaacatggatttagattccaagacccatctctccttctgtgaagccatcctccctgccccacccaggcaggatgaattattctcttcttggcagctctagaagccctggtataggcttttgttctagcatcagtcatatggtgttataactatttttgacactccgttcccctcaataggctgtgagcctttcacaaatgggtttttacatatatctgtgttaagtaataataaggctgggtgtagtggctcacgcctgtaatcccagcagtttgggaggctgagtggggatgattgcttgagctcaagagttcaagacaagcctggacaacatggaaaaaccccatctctacaaaatatacaaaaattagttgggcatggtaatcccagctgctcaggaggctgaggcaggagaatcgcttgaaccctggaggcagaagttgcagtaagccaagatcgcatcactgcactccagcctgggcaacagaatgagactctctctcaaacgaaaaagaaataataaacatttttaattatttaaaaatgtgttagaatcgatatctaggtcattgtgtaaaccaaaggccagcaaactttcctgcaaagggccaggtaggctttgtaggtgatatagtttctcttataactagtaaactctgctactgtatatctaatggccctatacacgatacataaaagaatgaatgtggctgtgtttcaatagaactttattcatataaatagacgtggggctgaattttaccctagggctataatttcctgacccctgatctctcccacctcaaggtcttcctattagctgaatacctgccttaggaaatccctcattttctctggctattttctgcatattctttttttttttttttttttaagcagctttctagcttctctctggaagagtggaaagatgatggggctagcccatagtttctcaacctgggcaatattgacaatttgaactaggtaatcttttgttgtgagggagtacattatagaatgttagcagcatgcctggcctctacacactggataccactagcagcactgcagtcatgacaatcaaaatgtctccggacatcgtaaaattacccctggttgaggagaatcaggctagtccgtgcacaatatatttttaaatttttctttagttcttcaagagccttccaggtgaaggaatggactgccacagccaaaaacaagatggctagcaaactcttctctccaggaaacgtcttcctaataaggcatattttattattttgtcagaaagtccatttctacacctttcttaatcctccatttagtatttctctttttttttttattatactttaagttctggggtacgtgtgcagaacttgtaggtttcttacgtaggtatacacgtgctatggtggtttgctgcatctgtcaatccgtcatctacattaggtatttctcctaatgctatccctcccctagacccctacccatcgacagtgtggtgtttccctccctgtttccttgtgttcttatcgttcacctcccactcaggaatgagaacatgtggtatttggttttctgttcttgtgttagtttgctgagaatgttggtttccagctacatccgtgatcctgcaaaagacaggaactcatccttttttatggctgcatagtattccctggtatatatgtgccacattttctttatccagtctatcattgatgggcatttgggttggtttcaagtctttgctattgtgaacagtgcatattcttttttttttttttttttttttttttttgagacggagtctcgctctgtcgcccaggccggactgcggactgcagtggcgcaatctcggctcactgcaagctccacttcccgggttcacgccattctcctgcctcagcctcccgagtagctgggactacaggcgcccgccaccgcgcccggctaattttttgtatttttagtagagacggggtttcaccttgttagccaggatggtctcaatctcctgacctcatgatccacccgcctcggcctcccaaagtgccagtgcatattcttaagggctcagcttaaaccttacctgtttgagtgtaaggcagagctccttgatctgcataatagattaagttccagtgctgtatttaccaaagtcccctctattatttccctattagagcattcattagtattaactataatgactataatgacttgttttacctttgaaattttattaaaattattgcaagagcacttttttaccttccaatgcccagtgcttcagtacttactcagagtgcaggcacatttaaaatatttgttgaatgtacaaataaatgtttaaaaggtttcacatagactaggttgcaaaatccatagcagacactgtaggtgctccacctatatcctttccttttaccattctggggcatactggcctaatttacttgcagaagaacaaacacattctgagaacagccaggcctcaaccaaagaccagcaggagcaggtgcataaataccccaactccctcacccttcgaatgcgatgactctaaggcttatgttttaaactggcttccataactcaccagcaggattcagttctagttatccacattgacagctgatttgataacagccgttttgttggctgctttccctgccttatctcatttcctattctcactgtcactctcattcctgttctcttattctcatgtagtgctcccatcaccttccacatcaaccccgcacacttgaatccttgttgcaaggtctgttcctaggacagcaaagcataaggtttccaacaaccctgtgagatgtgtatcatcacctgtattttaaaagtaagaagtgcagggcagagagattatggccatctaccaagtgcatcgaagaataggcatctaacccagacctctggctacaaactctggacatcatccagttcaccatgttgtttctataaggtgttcaactagtgtgcgttaaatgacaagatggctgggtgtagttctgatataaactcttcccaaattcaaccttgaattcaaatggtttctttctagtcgtagtatggtaccaaatagataagtctgtttaggtaagaattaaatgtaaaaaaacacaaacatttaagttcattggattgtttccccttaactgcctgtgccccttaaatgctaccttttcctgatcctatttgaggggggaagtatcttttgaatcccagacttgcagggacggattctgcatggcctgtacccttgtttgcagcgattactctgctcagaggaggatgacctgtgtggggagcctcttcagctacttgaggcactaaccctctagcccaggaagtcccattattgctgggccctgccataagcttatttgtatttcacagcgacttgcacagatgtgccagatatgtacagatggatttttatcagaagagagtctacccaagtgaagcagtgtagggtgaggctaaatcccaaaattgaaatttggggacactgattaggcacagagcaggaccaggggttaaaaccatgtgggaaacagatcaatagaatggaggaaaacagtccctgaggaggaccctatgacagaaatctactatagagaaacggcctgggcagaccaagcataatattcagtggagagtctgggtgtgagagctgtgtttgggtgagaagcagggaatgattgaaaggtaagacaagagaaaacatttccttttgttcattccatttctgcagaggctcttgtatttctgagtcccattttgaaagtcacacagcccagcatctcatctcttctttagccgaaaaacatactgcattagctgagtctccagagcaagttgttgctagccttgggacctggggaggttatttcagctgtgagtacctcacttccctcacatgcaaagtgcagtagtaacagcacttccatcctatggtagctgggacggaaaatgcataactccatgtgaattgccaaggatagtgcctgtcacgtggtaagcatttaacacatagtagctgtttttaatattatgtgtggtagattggcaccattccatgaatccaagccatttgggtatgataactgaactggttgtcaaagcaagaatcagccttgtgtttacaaccactgagaaagagcttgtcaagctcttagctgaaatctgtacaaaatatctgctgcaggtctctacctttttaccatttaaggtccatgaaggaaaccaggtcactcaggcacaacctgattttaatgaaccctcgtaggcgtctaaagaatcaccactttatttttttaaagtgttcaaaaccattactttaatgatttgttctggagtctcgacccagaacaatgtcagtctcgttacagaatctcagaatttactgccactttttgaaatagttggagatactttctatcctctgtctcagcatttctgccactcttctggattggatttatttagaacaattaaatgctgtcttacaatctctttccccaacttggggtttctcttcccttctaccaacgttcactctgcattttcattctgatgctcatttttcttggcattttgtctggagaagtttgaagcagagcagatgctcagacggtctgcatccctcctctttgccgtccttctcctttgctcacctgcaagaatcaggctttacgattcaactttctgttccaaacatagctttaaagcctgtttgggtgtccttagaaatttttctaagtgtcagctcatatgagacacccgctccagatgtcttgttttcccactgttcactgttcaatttaacaaaacacatattaggcacctactgtgaggcaggcattgtgctgctcttgaaagatacaaaggaaaacaaggtgtagtccctactttcaaggcgctcacggtaaagctagaaatgtaaacaaaccaacacaaaacagtgtgcaagaatcctgttaaagacctgccctcactgaactgtgcccctccacctggaggctgcagcgggtcaaggatggcttcactgaagggatgatatttgaacaagacttatttttatttctttttattcttctatcccatgacatttccttttctagtctcctaggcagccatcaacaaggtgcacaaatatgtctttttgcttatacagtagtcatacaaaatgcatgttgcagttttgtactcagctgtttcattgatgtaaatgatcctgtgtcacatactcacacaccttattttttgctttccctctctaagcatttttggtttttggttttttttgaaacagagttacccactgttgtccaggctggagtgcagtggtgtgatagctcactgcaacctctgcctccccggttctagcgattctcctgcctcagcctcccaagtaatccctgggattacgggcacccactaccatgcccagccaactgttttgtttgtttgtttttgtattttcagtagagacagggtttcagcacgttggccaggctgattttgaactcctgacctcaagtgatgctcccacctcggcctcacaaagtgctaggattacaggcgtgagccaccatgcccggcctaagctttctttgtaagatgcattcatgtcagggtgcaaacatccaggctgttatttccattcactgtgtgtccttgcatcttccacatccttcacttttccattgtctccatgtagaatgcccacattgtctctggttcccaacaccctgaataactgcagcaataccctttacgattcacatgcagatgggtgtaaaaggttccttggcttatatttgcccagaaatggaatttctggatcacaggtatgacaggcagaataatgaccccaatgatatccacattctaatacctagaaactgcaaatatgtgaccttgggtggcaaaagggactttgcagatgtaattagattaaaatttttgagattgagagatcatgttggacgatgtaagtgggcccagtataatcacaagggtccttatcagaaaaaggaggaggcagaagatccagagttggagagagatttaaagatgctctattgctgtctttgaagatagaggaaggggccaggagtcaaggaaagtgggcagcatgtagaacatgtaaaagaaaaggaagcagatttgtccctagagccttcaagagtctccatgtcagacttttgacctcaaggactataaaataatacatttgtgttgctttaagccattaagttcctggggatttgttacagcggccgcaggatgcccacacataaactacgcccagactgactttgactgtaatggcgctgggtcagtctcagaatggctgtccaggcccacatttctgatagccgcacatgaagtcctcacgtctgcacaccctcggcatcacttggcccaactcgtctttctgatttctttcagtccgatgggtataaagcataaacaagtcttgaataaagagtcagaattccttccaataaagtagggtggttgaggtgagatgggggatggccttggggccctggctgctgtggttggatggtctggtctttgggagaggatgcacaaatcattaggaaagcagagataaggctcccaaggggctacatggagagtaagtggagacaaaacccgtgcgccttgtgaggacacagggctgtgtggactccatggaagagagggccccagacagtggcaggcagtgtggggtcacagtcgtagtcaggcctgggtgtcagtcacagttctgcagctgccgtgtgaccctaggcatgctcttaacctctctgatccttggcatccttctccctgtgacagggataataatactatctgctcataggactgccatgtggcttacatgagatcatgcatgcaaagcccctaatacagtgaatggtatagagttggcacccaacaaataatcatcgtaatgatactattttcattagcacaataattgtaataataattacagtttcttacattcctcaactccaagaaaattggatttttcttgtaatctgcaggatccattgctgaccttgctcttctatctggagaataatgtattgcaatcagtttccacatatttatatgcaaaggcctttatatattattttcaaggagatcttcccctccttaaccattgcccttgtctatacccccatccctgaaaaatgggggtttccttttagggcttttaacagcataatgcagttgaatacaacttattttactgacatctctcctccaagcgctctcccccagcactttccaggactaaataatgcatgaagggagagaataacagggattgcataaacgacggaaaacagcacggtaaggattctgtgttgtgaagagatgaaagcccctggtcagaaggccagtaacaaagcaaagaagaaatgcaaaggcattgacgagggagacaagaaaagtatttttcaagataagatttgtggagagttaaaaaggagatgactcaggagacagtcaaagactcttcattagacaggaactccagagtgggtacaccagggggcctgggcttttgaagggctggggctctgaagaagttaacaaacaccagctccacttcctgggcctctgaagccttctttgacgtgcccaggtgggggccgattcttcttgcttggtgtcctatgcctccctcttcctacctttattagagaatgtatctcactcaactgtaacggtggattcctatgtcctttttcttcactgtgctggagctccaggcgcttttccagttatcctcatgcttttccatcttagatgcttttccagttatcctcatcatagattaaaataataattgttggtcatttagtctgtccctgtgctaagtgctccatgtgcattagataaattatgcctcaagacagccccagatacccattttacaactgtagaaactgaggcaggaggagattgagacttgcttgcagatgtgcaaatggtggagaatgtaggtgagattggcactgaggggttcagactcccaaatagggctgttgagtttcttttactcccaaaaccaagcacagtgctgagcacgaaaatgcactaagcaagagtttgatttgtgaacacattattctgcctggaactcagctagctagccaggtggtactcggagttggcatttctgttgctcaggccgggctgcatttggtgagttgcgggaaggggatgatgacatcttctccagttgacaaaagacaatggcttgttctgaggagagggcctggaactcttggtccatcagtctggctttgtcctgtctattatacacagtctaatcacccccaacaaatggtgctaggaaaacgaaaacaaaagctatatatttcctcttatagaatttttaaaacaactaaatatacctctggaatacactttacaaatttatgctaaaggcttccacaccaatgtggctcctaagttcccaaaattgagctccattttgaattgcccttggccctgctctctctgggattgctagagagttccagcatggacccagtgtcctttgtgggctgcagagctggacaacactgggatgagtaaggcagccaaccctcagccctgggaggcacagtgagggccagggtattaaccagaagcttagtagtcattttaccatcagcattaagtcacccacatgcacactgatatggtttggctgtgtccccacccaaatctcatcttgaattgtagttcccataatccccacgtgtaatgggaggaacctagtgggaggtaatttaattatgagtgagttctcacgagatgtgatggttttatatggggcttttcccccttttgcttggcacttccccttgctgccaccatgtgaagaaggacatgtttgtttccccatccaccatgattgtaaatttcctgagaactcccagacctgcagaaccgtgagtcaattgaacctctttcctttataaattacccagtctcaggtatgtctttattagcagcataaaaatggactaatacagcaaattggttctgagggagcagggtgctgctctaaagatacccaaaaatgtggaagtgactttggaactgggtaacaggcagaggtaggaacagtttggagggctcagaagaagacaggaaaatgtgggcaattttggaacttcctagagacctggaaggctcagaagacaggaagatgtgggagtttagaacttcctagagatttgttgaatgtctttgaccaaaatgctgatagtgatatggacaatgaagtccaagttggggtggtctcaaatgaagatgaggaacttgttggaaactggagcaaaggtgactctcgttatgttttagcacagggactggtggcattttcccctgccctagagatctctggcactttgaactggagagagatgatttagggtatctggcagaataaatctccaagcagcagagccttcaagaggtggcttgggtgctgttaaaagtattcagttttatgtattcataaagacatggtttggaattggaacttatgtttaaaagggaagcagaacataaaagttcagaaaatttgtagcctgacaatgcaatagaaaagaaaaacctattttatggggagaaattcaaggctgttgcagaaatttgcatcagtaatgaggagcaaaatattaatcaccaagacaacagggaaaatgtctccagggcatgtcaggggtcttcatggcagcccctcccattgcaggcctggaggccttggaggaaaaaatggctttgtgggccaggcccaagtctcccctgctttgtgcagcatgggaacttggtgccctgtgtcccagccactacagccatagctaaaagaggccaaggtacagctcaggttgtggcttcggtgggtgcaagccccaagccttggcagcttccacatagtgttgagcctgcaggtacacagaagtcagtaattgaggtttgggaacctctgtctagatttcagaggatgtgtggaaacacgtgatgtccaggcagaagtttgctgcagggacagaacactcatggagaacctctgctagagcagtgcagaagggaaatatggggttggagcccccacacagagtccccactggggcactgcttagtggagctgtgagaagagggtcaccatcctccataccccaaaatggtagctccaccgacagcttgcaccaccatgcacctggaaaagccacagacactcaaagctagccatgaaagcagccgggaggggggttgtaccctgcaaagccacaggggtggagctgcccaagatcatgggagcccacctctagcatcatcatgccctagatgtgagacatgaagtcaaaggggattatttttgaactttaaggtttaatgactgccctattggattctagacttgcatggggcctgtagctcctttgttttggccagttactcccatttggaacagatgtatttatccaatgcctgtacccccattgtgtctgggaagtatctaactggctttggattttacaggcttgtaggcctcgtctcagatgagactatggacttggagttttcagttaatgctggactgagttatgacttttggggactgttgggagggcagaattgtcttttgaaatgtgagtacacgggattttggagagtaggggcagagtgatatgatttggctgtgtcctcatccaaatttcatcttgaattatagttcctgtaatccctacatgtggtgggagggacgtggggggagacgactggatcatgggggtggttaccctcatgctgttttcatgattgtgaattctcatgggatctgatggttttataaagggcgtttcccccttttgctcagcacttctcctggatgctgccatgtgaaaaaggatgtgtttgcttcctcttccaccatgatcatagtttcctgaggcttcccaagccgtgcagaattgtgagtcaattaaacctctttcctttataaattacccagtcttaggtatgtctctattagcaggatgagaacagacaaatgcacagaccaacaaggagtatgtggtgagctttttcctgccttgcttttttgaaagaggaaaacaataagatcagaacagattatcactaaaattggcagggggaaagtgtggcacagtcattagaaaaaactggactttggagaccattttaggaaatcttggaatactagcattgtttggggccacttccttgggtcatgtttaagtaagatttgcagcagcccatagatgactcactgaaatttaatcattaatggaatattttataaaggggcagtttataaatgcatagttgaagtacagggaaaccacaagggatggcaccacccccaggggctagtgatggcagggacagttatctgccctggtctgaagggttaagaggagaggagggagccctctctgaagtggagacagtgaggtgtgtgtgcagaaggccacctgacgtgtctgagaccttcctttgagagatacagccagccctcagtgacccagcagggaagaagcaaggataaacacctgattccttttctccctgccttccctctgtaatgagttttgtctgttggtcaaaactagagactcacagagtgctttggctgggtccgtaaagaccaatctccagggaccaaagaaaggtggtgaagggaggagctgggtaaacagaagctatccagcctggttttcatctatccagagctgtacacaagatggtggattgaagatgattaaacacaacacagtattataagttttagaggaccaaataatgtactttaaaactaatgcaaatgtgatttttttgaaggctcatttcatggtaacactgtgcggagctcttaagtcaaacatctctttcaatcctcccaacaatctaggaagataagttatggtctccgtgttctctagtagaagaaacagactttaaagattttggtgacattttcaagcaaactaccatatacagagtcagagccctcaaactgtgaactgtatccttttggggttgcctttgtccccaagaacctccttgtcttctctggtcctcatttttcaacacagtcaagaaaatatctgtttgtttcatgactgagcattcatgagagccaaaaggaaacaatgatttattaaagtgtctatgtcaggaagttcttattggctgctcccgttgttaattgagtgtcttgaaacccttctggtgctttgtaattagtgctccaggacaaaacatgctgctgcttttttctcatcccctaaattttgccatttcagcacaaagggagctcaggtgcatcaggagccccagcctcctgcgactggactgcatacatacaaatacccattctaggtggtttccaaaaggactccatttctatgggaatattttccattgagctgtttatgaactttcacttagtgattaaaaaattattcaaaaggagggcaatagtaataaacttccactttccgtttcaccagcatatctcaaaactaaattaattatcagcctgtgtgaataaagtttgtgtcctgataaatgtattccctcaagaatgctcaattcacctttccccaggtctccagctcacacactgcagtccaatttcaaattcttccgtctcaccatgaatctccagtcttgaagccctctccttgaccccctccttggagggtgatgtggtaaatcaagtcagctctctgtgaatgtctcatcattctccacctgccacagcaattttgccccctctgctctcctcctggggtaaagagtctttccttgttagggcttaaccctttaaactagtcttcccctgctggtccaggcaaggagcctgttccagcatttggttctttcttctccatcttcttcaggtgttctccttccttctttaggtcagaaaagaaattcatgaaaaacaccataaaataaaattttaaaaaatccattttctacctttcttgcaagtgcttttatgtttctatgcatctcctcacatgggatgctcacattcagcctttgctgcaacattgtgccttcctttttgaatgttctacccaattttctcccgtaagcccttcaacagctaccagtggcttcctaatgaccattcacagtgtatgcttctcaatctctgcagcttcgaacactgttgactttcttcctttcctaccccagccttgaaataggtatccatggcaaaacattcagtccctactcttaaccttgctgtctgaatgctgttgcttgccattggactattctggaacaggaagtatagcattctaacagcatggtatatgaagccatatttccctgaatcaacttctagttttagcacttattagctaataagtgtatgatcttaggcaatttattaggaaaaaaattaatctcagtttacccaactataaaatggagataataatgctttgtaggaaggtatatgaattaattcatataaaccaatttcacaagctctgtaaaataagaatttcttcttattttataaataatacttatcttataaataataagatgttatttatgccaataatatctacaagttgacattttccaatattctgcttttagaactgtattaggttcctattgttgtattaaaaaattaccccaaacttagtgacttaaaataccacaaatttattatcatacatttctggagctccgaagtcctaaaaaatctaaagtgtcggcagagccatagcggagaatctgcttttttgcctttttcctgtatcccttggcttagggactattcctccatgttcaaagctgcatttgcatggcttcaactatcagttctatgtggaagattttttctgattttcaggccagtctcatatccccagagaaatgcattcttatccccccaactatttgccattgaaagtaatggcaaaaaccaccattagttttgcaccaacctagtagttgcaggtcgtctccctgtggctgcactccacacaaatacaagtaaacgcatcacaatcctataactaattctgttccttgtcctgatgagcttccttctacaaatggccctaatattccctccatttcccagtatttattgagggatgaagagtctttctgtcaactttcagtgagaagaagtaaataaaacagctttgatggatacccccatgaaccggagtgaaagggatactcctttaaatcatagttatttcgtttgctaagcatggtggccctgagaatatgcctcccagagcctccaccacagggaacacgactgacatgtgaccccagatgctgtactctgaagcccatgacagtatttgggctgacgctatggtttttattatctttcctcaccaaagacttcagcaagggagggatactaaggcaaatctgtttctgggaatcttcaaactcattcaacagctgatcttggctccagggcttccatatggccttgcaggacctttcttagactgcagagaagtccagaacactttttacttagccttcctttcctctctccttcactcaaggtcagattttcatctcagtttgatagctctccccgctcctcccagcttcgtccccattttttctcacccggctgtttcccctaatataataattggtcttcaattttaacttgcatttgctcctcaggagatctgaacttatatgtcatagtctgagtttggagggttgaagggtcaagacctgatggtgaagcccacttcctttgagttccctggattccaggaagacagaatttacaactgccagtaagggagcaaccagacgatgcaaactccttggcaccaagaagagaatgtgggaggaaaatgagatgttttagaaacaacagaggaatctgtgagacagggctgctgtgagatgatgtcacacttgacataaattgacagttaattgcctggagatttgggaacagttcaggggtgtgtgtatgagagagattgtgcataccatgaacaatggacacaaatatatatgcctgcttctgtgttgtgtgtctctctgaattagtgttccctggtccacttcataggatatttcaccagcacctgggactgactgtaagggggaaatggatttgctcatggacctttcagcagagggaaaaatgggtagaagcttctaggaagcgggaataatttcatgtaaagagggcttttcctgaagacacctgacagagtgggtagctggaggcatatctgccatagatacaaggactttctgccgtgggtgggaagctggactgggaagcccacaagaccttccacctcagacagttgtagaaattcaaaagtcccagcagttttctaaacctggcaggtcacttgaatcacatgggaggccattaaacacaccccaaatattctaaatttggatttcaagggaagggcttgaaaggaagagcaaggaacctggataaaactctaaaaccttctttcccttgcaattgaattagccagcctaatttgaaaaccacactgctttgttgaacagaattcccggaaccaccccagacttgaagtatcattcagctatgtcttcacatgggaaatgtgttgtgctatcagaagttgaattgcttgtttcaatgtgtttaagacaatgtacctccgaatctggcaggaatgagtttaaattctgactctgctacttatcatctgagtgatcttgaataagatattcaacttctcagaacctcagatttcttcgctgtaaaataaggatggtaatgacacctttttcctaaatttactgaaattatcaagtgggataatgataacagttaacattcattttcaacttgctctgtgccagtcactatttcaactcatgtattagctcatttgtttgtagcaactgtctgaagaaggttcagctatgattcccgctttacagatggaaagattgaggcatcaagaggtcacataacttgctaaggtttgcacaactaaacgggatacagctgatatttaaacctaggcaattcagtcaaaatctacttttcaggatagtatgctttatacacacatactatgctatgtgtgtataaagcacttaacccagagcttggaacacactatgtgctccataactattagctaatgttataatcactgcttttaccctgggacttacagtgaattgtcacaactctccagcatctgcaatattcctacttagctgcttgcaaagccagaacacctgtgtcttcatgccctctcctttttgtgcccagcccctgtctcagtgatgagcaggacagcatgcatggatcattaacttactgagactgagaatgtcaaattcaagacctgttgaataaggtcagtaagtaatagtagttgctgtatttctcataagtgttgaaaaggaatccttacagaaatacattactttaatcctaatgtattttgacttcttcaggatgcacaggtgtccagggaactgtagtgtcagtatctctgagaccttaggagaacttcttttgaatctaaaggagggggagttgaaaggcatctctattatagcaaaaagaaattagagggctgattcatcctattctgtagggaaagcagaactctgctcagagatcttgaagtaagtaaaacatggtagttacttttggaggaaaataaagtaccatcgaatgtagaatctgatggtttcagtgaaggtaataaatggtgctttgatgacaactgtattcattagacatatttgtggctttcctcctcctttctcttgcagataaattctcactcaggccctacagagataggtgcgtggttttagagatcatcagatgtgggtttaagatcacttttgccacttcccatatgcgagatcttgggcaggaccctcaccctctctgaaccttggcctcttctttctgaaatgttggtaattgatatggtttggatatttgtccccatccaaatttcatgttgaattgcaatccccagcattggaggtgggacctggtgggaggtgactggagcatggggacagatttctcctaaatggtttactaccatcttggtactgttctcatgatagtgagtgagttcttatgagatctggtcgtttaaaagcacatagcacctccctctttgctctgtcttgcacctgctctggccatgtgttgtgcctgcctccctttcaccttccaccatgactggaagcttcccgaagcctccccacaagcagagcagacattggcatcatgcttcctgtaaagcctacagaaccatgagccaattacacctttcttctttttaaactaccctgtctcacgtacttctatatagtgacgtaagaatggactaatacagtaatactcttacacttattgtagagatgttgtgggacaacataagacaattgtaaacacagtctgtgcctgcaagttcagccaggcactctgtagagatcaatactgtccctaggatgctgtgaattttcatattggtacgtctgagcctgagtaacacttggcaaccagagtgagccccagaactggctcatgtggaggtcagtgacaaacctttgacatttgatacaatcaaaaccaagccgctttgtttaaaatgctcatcaaatacctaccatgcacactgtgtatataaaagtcattgtcacaaaagccctttttcagaatctctagcttgccatttctctcagatttcttattgtcctctgggtcaaaaacactgcaaaatttcattcctttaccacagcaagcttttatttctggtgtacacacccgagtgttatctggaatgtggctgctctaagctgggcctctgctggatttaactctagactattggttgagctaaggtcttcttcctgtgtctcttatttttctagggatagcagaaatgaaagaggcaagtccaaccacacaaacatatctcaagcctttgcttgaactacatccaatagtacctgctggtcaaaccaagtcacaaggataacccaactgtaagaccatggcaaggtgatgaatgtctacaaataccgcaaatgggtgaagaattgagaccatatctcattctgtcatacctggaactccaaatttcccagttcttttaaacttttatgagttaggtactttcaagttgtgtaggacagactcacctggtttgggtgagttaagtctatggaaagggaacagaaaacatgtgaggaaacacttatcccatctattccatcttatcttgatggaattagaatttagggattcacttttcagggacaaaaagcattcaggaaggtgcctcacacaaaatggctactcaggaaatgtttatggagaggacatgtgaatcagtgaggagcggctgtagcactggtcaccttgccgttttcccagaagtagcctccattgctccctcctctgtggtcttcaatattctcatgattcaacttccctgtcttctttggttcttccagttactgctgtatcccttaaactcgcccaaaaggaaggattgtgttgcattaattagctgtctttctatctactgggcagagatcttatgatatgctgcctcattggcatgaatcagccaatttttgttttgttttgttttgtttgtttgtttgtttgtttttgagactttgagatggagtcttgatctgtctcccaggctggaatacagtgtcacgatcctggctcattgcaacctcctccttctaggttcaagcaattctcctgcctcagcctcctctgtagctggtattacaggcccctaaaaccacgctcagctaatttttggattcttagtagagactgagtttcactatgttgaccaggctggtctcaaactcctgacctcaggtgatctgcccgctttggcctcccaaagtggtaggattacaggcatgagccactgtgccaggccatgaatcagccagttttaaaaggcttctttttaagttgctggtcactggttgaatcgcaaagagtgtaaggaccatgcaaggaattccctatggctgcattcttcagcaagggtctgtgggttttgctattgcttagagactcaaggattttgtgttgggttgccccatctcttgctttgtgattctgcctcttgggatttggaaaggtaacctggatctagcacagagaggtctttctccctttgaagtgttcatcatgatctgatgagtcaacagtgcctcgtctcattgtttgctacactagctggctggaacactaccctcccagcagagcactccctgccagagcatgatactgccactgccaattgaagcacggctatgtttttacatcttgtagcaataaccctccttcctcaatcattgaagactgatcagctgggccaaaaccaaagcaatataacccagggtcgtgtgtgtacatgcatatgtggtgtgtgtatgtgcacatatgcatgtagtgtatatgtatgcacatgtatgtaagagcacgcacacacgtgttctttttaatataaagaaatgcctttagagaatgaaatgcactgggggcatccaaggtgaggagacttgagggaatgttttttgttttttttcttggcaaatcagtgaaagatgggcagataagtatggtgaacccctagtgtgaagtagagaaattggaggctggagttatagaggcagatgttgaagaacgtggaagcttctagaagagctgaaaacgtccatagactgagtaatcggccaggcacagtggctcacacatgtaatcccagcagtttgggaggctgaggcgggcagatcacctgaggtcaggagttcgagacctgcctggccaacatggtgaaaccccgtctctacaaaaatacaaaaattagctgggcatgttggtgggtgcctgtaatcccagctactctggaggcccgagacaggagaattgcttgaacccggctggcggaggttgcagtgagccaagatcgcaccactgcactccagcctgggagacagagtgaaactccaactcaaaaaaaaaaaaaaaaatgcgagtaatgaagggcagattcaggaccgggactggatgctcactcagtaggttgctgtgtcccgcaaggtaggaggtgttctgtgggtgaaaggcaaagacagagaggacatcaggtcagaacattccaagtgagactctacgttccttgaagactccattgtctcatttctttttatatctccagtgccaaagacctaagtgagccctctggatattagataaataaattaacttattaaaggatgaaagagtgaactactaagttaatttgaaattgaaatatagggtaaggcctgcacttacacagagaaaatgaactttcaaaaatgtacaaagcagacaaaggggagacggagagagagaatgaagactgaatgggtatccaactgatacctggaacatggcagtgtgagtagctgaaaaaggaaaagacctcaaggaatggggctgtctgtggggcctatatttatgttgacatcactcacaagtacaagtctgcatccctgggtgtcctcagacaagcatatagtttgcatatcgtattaccttttgtgttagtaatcactgattttgaatcttagctgactgtggaggtgctgttctgcctttgacatggcagtgtgagctggagagggatggggagatgaagaagccacatgtcccaggaatatcaggatcctataaacttattctgggtaaggcagtggcaagggtgaccagcaaagtggtgcctgaaggctgggaatccagtcatgtcaattttcttgtttgtttctctctggcaccttctctaggcccagagcctagatgaggctgtgtggaccagtgatacaatggagactttaattttctcgattagtgcagaggatgaagaaatctcagcagtcatgctgtattcaaggtgcagggtattgcctgcttctgttctcaatgctggctctcgtagcttaacccacctatacagaagtgacttgttttcatccccgtcctggccagtgactctttaaccaggcaatgtgatttacgtttagatgttagtttaatccctttgtttcttaatgaagctgcccttgttaaaatccctgggacctaatcatagaaattctctctagccccacgtctccgttcaacaactgcttagcaaatttctcatcagtcccatttttttttttaccagctcccctcaatagccatttcttgtctccaaggttttttgaagcccagaggcttttcttgtcaggcaattctcttatttcagccctgcagtgaactatccatatactgtatcacatcatgattttttttttctctgcaacctctcccttccccttgaaacaacttacctttatctgtgttccaaccccaatctgttgcgtctagaagtcagagagccaactgccaatcattctagaattcagcattttcaaagttcatctttgaaatggatagcctcttgttctgcagaaaagcaaggatcctagaaaaaacatgcaaactgcatttcaaggaggatggcatcatctttttgtttctcttggaatgactcaggagtgaggaaacaggaatacattactgtggttcccactcatcttggcctaccaatctctcccatctttctaggtacagcccatcttgtgatgggctgggacctgggcccctcctggacttacgttcaggatttcaaataacttggatggcagtctagccaaggaagccaaaagcttccatctcttccttgtcgtttgtgtgggttttttggtttgggttttttttttttttttagagacagagtctcactttatcatccaggctggagtgcagtggcacaatcacggctcactgccgccttgaactcctgggctcaagtgattctcccacctcagcctcctgagtagctagaattacaggtgcatgccaccaggaccagctatttatttatttattgtagaggtggggtcttgctatgttgcctaggctgattttgaactcctggtctgaagtgatccatcttggcctccaaagtactgggattacaggtgtgagccactgtgccccacagtatatctttttaaaatgaagactttcttatcagatttcagcaccaaggctcatacatatgttgactcaagaattaaagggctttagtttcatgtgctggcactaatcaatggctctggtttgagaacaattttgaaaccatactcgtctcattggaaaagagggcagtagtggtgcctaccagagatagggcatgaggaagcagtagtagcatccctgccatgcacctgccatccttgatttgataaagtccagaagcacatctgatcacaccatcttgcacaatggccttctcccaagcaacagtgacaacttagatggcctggaaaactatttcaaactaatagcaacatgtctaccaagagtgcattattaatgacacattcaactgaaaaattgatcacacgctcttaggtattacatgggtcacatttgcaataattttggtttttactgctgaaaggcaaatttaaggtaaaaatcaaatactttaaaagtatatatcttaatatgccttcctcttaacattcatctagtaaggggggagatgtagaattttgatataaattggccagccttatgttgatttatctttaacacagatttcaactccttcacttcagttgccatgaactgcaaggcccttgttcagtctggcttttcatctctttcctgcccaagtccaatttagctcttataaaacaaccagactactgcaatccctcatctcacggcaacctccaggacataatatataaaacttacccttgacatgtgggtgggtcaaataagtgatcaaagggcaagtcatgatctgaaagcatggtaatctcaagcaaccgctgatgtgaacattgcgtgtggcacagtgaaactcaaaggactcctgattttggcaataaaaacgattgtgtctataaactgagagaattatagaagtttgagcacagctgatcttagccttgaacatagttgaggaagagggaaggagaaatttaaaactttaattctgccaatttaacaaaaccgcttcacatcattatctaggatgagagtgatataaagaaatttaccagaactttttccattaatcaaaaagaaggtagtgaatgagatggaggatcaatcatgtcaaaaatttcagaaagggatgaggaaataatttctagcaaattatataataaaagtatgtttccactgaaaggagcattgaggaagaagaagagtatttcgtagaagtgaaacggcactgattaacctcattaaggacatgacttcctcatactttaataggaagtggtaaacttcagaatgagaccagcactatgttgaagtatgtcctagtccagcctctgttgtgagctagctgggaaagcatggccttatctgtttcagtatccttatttgtgaaatgaagagcttggcctgaaatcagcagctctcaaattttcgtgggcatcagaatcaccaaggatgtttgtaaatgtttttaaaagtcaattttcaagactccattaaatggagattttgatatatacaatcagagttaaatatgtgtatatataaaaaatatctttaagctagagtctcttatcagtgagactttgggctctacgtgcagagagactggtttacaaccagtcaaggggcagggtggggatagaattcagaactttagagataatctaacattctcagagactagaattctgcagtgttctggaacaataccccaaggtcaaaaagctttaactaaatgtttgtatgatcaataaattggtctgatttaaaattagcctataaagacattttttaaaagcaaatgcttaacttcaatactacatgacaagagggtgatatacaaaaaaaagttactatgtggttcttggcatcaagcagattaaagtctactttgaaataaagaccataataagtagttgaccccataaaaattaagcaataatgggaagaagttcagaggaacagaaaatcaattcatgctgagatgataatcaaattattggtaaaaatgaagatgctggttaggcatgtccttggctagagaagggctcaggcttgcaggtttaatgacctttagctgagaccaccccacgtgtccatctgcctcaggatactctaagtctcgtggctgaagcaaagtcttccttaaacagggcttccattgggccatgccagctattttgtttgtttgtttcctcaagacttaccaggccctatcttctgattccacctttgatcttaggtaggttaattcagttaatatattactaataactgtctacactctttctgccctcgatatctgtttccttctgctaacattttatgactattctttgtgggttaatttcacattttatctcccaaaggcagcccaagttccctcctttccagatgtcttgggctctcccaccgtagagcattggtgctgcctatactgttgttcttgatttcagagaacgttctacatcatacagatgcttacgcttattaaactactgatttaagttgttgcaggttttgagttaccactggcttttgactcagttgaaaaaaaacaaagaatggtccagggtgagagaggtgtgtaaattgactccgtgaggactctaggaactgatctttgacttcctcgccagcctctttgccaagcccaaattcatcatcattgtgaagtagcattgggccatgtttaagaagttttctataagaatttattttggattaatagcaaataattgcagctgagtcagcattaaagacatgttatatcagactgtgtctgctagttcagaggatgctgcttctcggatgggacttagctgaacacgtgttacacctctggggaagtgtctacagcattgtaccaaaaaacacagaaaacaggccactgaaacaaacaccagcagacatagcattggcaggatctaacaagcaggttttcctgaaacgtcattttgacagggttatagtcaggtggaatctcttaactgcagtggtcacctggtgcttcgttctttggtgcacagagagggggctgcagaggattaacatggaagaagcaagcactccccctccgttgttacccctccctgcaagatcctgaagccctgattctttccccatcattatatcccttttcaggaacggaaatgtcttctgcagagccagcccattccctctggtgctggtctcaggggaagtacagcatctggctcccaccctccatctaattacccatctgtttgtggggagggaagggatgttctattccccttctcttcccaaacattttaatgtgctgatgcatgaagacgacagcagctgcacctcagaacccatcctttgtgcatcacactcactggcttagcttttctgttcagttcttggatgggcctctttatagctagagacccacgtctctaactcctcctcatcctgacttagtacaaccctggcccttgcattagactgctccagattccatgttgctctctgattcagcatcatcaagcctcagcggggtgcctgagaccccctacctttagggaggggcagggatttccctgctctgctcttggcctagggcttctatcagctccagcaaagagaccatggagagcgtagcctttcatcgtaatctcccaacctttactcagctaatggcccctttggttatttctctctcactctggaagccatgtttagaaagagctgatatactgaacaaattgcacttaataaatattcacttattttccctctttttaaaaattaatcaagttctttgtaaggaagaaaaacgtattagtctttgacaaatgaaactaccaatctccattgatacctacgttgatagtattcaagccccaaacaaacacttcttagctggctcagatgatctggttaaggggaactttgtcagtttagttcagctttgtgaaatactgaaggatttcagaccactattaatacctgagtaaagtggttaagagaataactttggacatagagacagatgggtttcatttggccacatactagctacatgacctcgggcaagtttctgaacttgatgcggctccatttcttcatgggtaaaattggggtaattatactattgatcctgtaggattatcctgaagatagaatgcataatgtttacaaagcacttggtacaaagaggcataaagcaagaagtgagtaaatgttaactgctgctatctttattcccgtcattttaatcatcactatcaattatcatcacaacccaagtggctcagggatggagagaccccaactaggaccctctctccattctaggggaaacatttattcaactcaactgtggccagaactcatagtgaatctcgctatagtcatcctccgttttgcaacagcagattttgctgggctcgtggtcactcagctaaagactactttctccagccaccttgcatctaggtatgaccatggaactgggtgatggccactaagacatgagtgagcgtgatgttagcacattaatccatgcctttgaaaggcaagaagtctattttcccttcctgtttttcccttcttcagctgaaacgcaaacgtggtggtgaatcatcttgaattaagctgaaaagggtaacatggaagagatggcatggcaacaggatgcatccccaataccatcaagccaccattccaattctggactgccaacctagactcttaaataagggagaaaaaaagtcctttttgctttaaactactgaatctgatatcacctattataacaccatggtgtatcgtaaaaacacaccaaacaactattttcaaaatagatgtgatacttctccccagttatacaacttctggaagcaggaagccactgcattcccccacccagcttgtcatggtttacttctgattggatataactagatgataacagggatcacgctgcatccattgaggagaaagatgattcaaccctctcgcgggctgctggggaatcgatatcgtttaattatgagaaagtaaactgtgtttacattttacacagtggcaagaggaaggtcaaatcacaatcctcataccctttatcaaaaccatgcatcgctgtttgtcaagtgagattcaaaatgggatgaacttggagagttgccatcttcctgttttctcccttgtttgttcatatggctgtgctttacaagattaaaaggcttaccgggcaaaagcatagcagaaggaagtaaaaccttcgggcagatgaaataattcttccattttaggaaaaaaaggcaattagttatttgaggttttctgggtggggcagtgagtagaaggtcattatgttcctttcctgttgtatatcgaaaatcagttgagaagtaatgaaaatggtaagaaaaagaaaaaaaaagagtaaaccctcttcctctcccagtggcctctaccccatgactcatcagcttcctgaactggaacaacactgagctttatgactacagaaatgtcagctctgagcacagtgcatacttctttgtgtgaagatcttaggcggttgtgcaaaagccagcccaggacccagcatggtcctgctttatctctctgccgggctagtctccatgttcattagaaatgtgtgatttcttgacaagcactctttggatttgctgcagagtcaggtgatacattgaaatcagcaaaaacattaatgatagcaacaacaaaaacgaccttgtttaagttttacgccttataagggggcaatgttagccttgtaataaaaatgaggtaactgcaacttggaaatattaggaaatttatttaggatatcttagaaaatcataatgagagtgatgatgatgatgatggtagtgatgatgattatggtaatgataactatagtgatggtgatgacgatggtgatggtgggggtaatggtgatggtgatggtggtgatgatgatagtgatggtgatggtggtgatagtaatgattacggtggtggtgatgatgattctagtgatggtgatgctgatggcggtgatggtgatgttgattattatggtaatgataattacgatggtgttgttgatgatggtggtggtggtggtaatgatgatggtgatggtggtgatgatgatgatagtgatggtgatggtgatgatggtgatggtggtgatgatgatgatgatgatagtgatggtgatggtggtgatggtaatgacggtggtgatgatggtgatggtagtggtggtgatgctgatggtggtgatggtggtgatgatggtgatgatggtgatgatagtgatggtgatgatggtggtgatgttgatggtagtgatgatgataatgatggtaatgggtggtaaagatgataatgccttactctaggctagatattgtgctaaatatttcactgacaagcaaatgtgtaaactcacagtgctcagtattgtgattgaccctaatacgttttcactaattgttggcttcagggctaggactagagtgaggtgaatgaggtactctctttgggtccaaatttaaagggatacgaaaaatctcagtaattaaagtaaataatatttaatgcaatattttataaaaataaaaattagtgcaaaaatccatggtaaacaaaatgtcaacattttaaataaaggttctgtacatgcacaatatattctatttaccttcccctaatcccacccagttgtctcagctaatggcaatcttattttatacttgatgaaacaagcctgagcccaggttgttcttatccctgttctataggtgaaaatactgggcacaagagatttttccacaatcacatagctaatatatggaaaagctgggatttgagctcagctatatctaacatagaagttcagcagtctatctggcttctaaggtaagtttctgtcacaacattaaatattcagtatcattttctgggctatttttaaatggtagggagtcaaagagattaactaccagttgcagctcttatcaggccaacaatatcagctaaggtgaatctgatactagtagaactctaagaatgtgcatttattaagtcactcatataaataatatatttaacctacttagaaactctgtatagaagatatcagtgttgtatttcataaatagagaaagagaatctcagagttgagcactcacagtcatggtcaattcatggcagagttggtgaccagctcaaattttctaggttgacataatcctgtcctttctatggcttcaaagccatccacgtttgtctcttgatcctggaactttttatatttcgtcatacagaccttcctaagatcctcactttgcttgtatcattttccctagaataactattttctaaaacgcattaatgcattgattttaataacatcttgtgtcttatgtaattttaaaaatcagcatatattgactgaagacattttgacaaaagagaaagaaagaacatagcaaaaaagcatttccaactttcataaataagcaagagtatcactttcgtgaagttcttttctattttgttttgtcctgtttttttatagtgacatgtaactttttctttttctggacagcctgtcctcttggtgataataaagcatgatgataaaacaaatgagatctcactactagacttttctgtccaggaaatactcttgacttcatctgtcctcacctctgcttggaccttgtttcatccaatacctcatgccactctcagctttccaatttagatccttctcttgggtcattctcctctgctatgaattagcagacattgatcttgtcctctgacaagtagttatcagcagttattcataaatggatttagtatgttccatatccttagaataacatatacatataagcaaaaattaaatataatcttaggggtttcacaggctcccctaaatctcattcatgtacgccttaagcctgacttaagaaacgctgccatgtaatttccccttgatcctttttttttttttttttgcagatactgccccttctcatttttaactttcaccaacacttttcttgttaaagaagctttcattctctgccgctgtaattttccttacgcacatgaatatttatcttaatcaagtttctcctcccaagaacatcccttcagacaccaaaacgcgtattcttccacgttccatcagcagaaactttccttcatttgatacttgaagtccatcgctctggtgaaagcatccctcttcttgtttttcattatgttacattctttggacttgtcctcttatctatgtaccttgtaacttccatttagccctcttttctctttcaacttccttattgtagatactccttaatgttactagcatttaagttgtttttttcccccctcctttgtcagtcccaaagctcctatggctcaactgttggtgcacataaccttagggaggtgatttgaagaaattttaccgaaatgttgtatgacaaactcccaataacaggatttaagagaataccacttgttcttaccccttcagttctcttaacagggaagaaatatcataaccacataacacatgtttatatatatagatatgcccttacatcaaaataaattcttgatgataccaagatacgtgttcaaggcaaccataaaacactggaaaaaaatcaatcagaggtgaattttttcttatcttatggtcaggcagagtttaagcatgacaccaaaagttaaaataagctgaaaattgatatcattggctacataaaattttaatgcttctgtacaataaaaactgtataagtattaaacaaatgacatgtttaaaaacacagtttgcactatatattccgaagggcaaggacccctctccagcagctgtcgtccagcacatatttaacgtttccatatatctctgtcctcatcaataagatgaggctaatgacgctgcctctgcggtccttctaagaagcagatgggataaaagagtgtgcaccagtagctctaaacccgggacaatttcaccccctgagggcatttggcagtgtctaatgacatttttggtggtcatgctgggggatgctgctggcatcttgtgggtagaattcagagatgctgttaaacatcttgcaatgcttaagacatccatgcagaacaacaacaacaaaaaaatatcctgcccaaaatgtcaatagtgctgtggctgaaaaaccctggtctatacagggtggaggatgttgcggagcgtttggtacctggtaagtgctcagtaaatgtcagtcatttttacatcttattgggcaattctatgtaaatgccttgtccctaggaatatccacaggtttagcttatttttttttttttttttttttttttttttttttttttttttgagacagagtttttcctcttgttgcccagactgtagtgcaaagctgcgatctcggctcgctgcaacctccacctcccaggttcaagcaattgtcttgcctcagcctcgcgagtagctgggattacaggcgcccgccaccacgcccagctaattttttgtatttgtcgtagagacacggtttcaccatgttggccaggttggtctcactactgacctcaggtgatccactcaccttgggctcccaaagtgctaggattacaggtgtgagccacctcacccgaccccaaggttgtctcttttttcttttctcttttttttttttttttgttttgttttgttttttgagagggagtctcgttctgttgcccaggctagagtgcagtggcgcaactgcaagctccgcctcctgggttcacgccattctcctgcctcagcttcccaggtagctgggattacaggtacccgccaccatgcccggctaattttttgtatttttagtagagacagggtttcaccgtgttagccaagatgatctcaatctcctgcccgcatgatccgcccgcctcggcctcccaaggttctgggattaccggcgtgagccaccgcgcctggccatttatctgttaaggacagaacatgacttgagggacagcttactcattctatgcctatttgcttttctctctttcctcagcgcttttcactctcagctaccccttccaaacctcagctgattttactaccattcagatgtatcacttgtctcctgaaaaacacatagagcttcctttgtgaattcttactgctctacttacctgcttttaatctgtttatgtgagaatgttgtcaagatcttctagtagatcgtaagtcccttgaagaaaaagatgactttatatttattccaaaaaacccctgtggtgaccacacagcatagaaatctgcacagagcaggcaagtaacttacgtttgcttcgcaattccatcttcttaagtcgttcttgcaattgagaatgcatttctagccttctattggagctgcttagcacaagtagtgttgcattggtgtgaattcctccaacccatttaaatgagtttattgtgcattcaagtgagggttattcagcatgttcaagcaaatagtgaccaataatgataatggatattttttcatctcttcctgctccaatgggccagtattcaaaatgccattgctcacatgaaaacagagctgccagaccgtgtccagggcctcagccagggagctgccactttcattttaatttaagaaaaagagaaattgactgggaggtatttatgtaaatcagtagagttctaaggagttatctggcagccatgttaatggatgtgccactctgagaagcgaatctcgcattttgcttctcttgtcagaaggggttctgtgtgaccatttacacctacggatgattggctgtgacccagaggacatttgatgtaaaggatattttgtgcatgtcaatgagtcctgtccaggtggtgggatacaggctcgagacacatgttggagaagatcacttttgactgctggggagctatgggaagcccttccaaatgggcagaatgtgcaattactatctcagtaaatttgtctcaggagagctgtacacctcaggaacatcatatcatagaaaagggaagacaaaaaaggagctcaccttaaaagttccaaccacattccagggactgtttgtatttgactcattcatttattcaacaaatgtgaactgagcacttcaacgtgccatactgtcttctaggcactgaagatacaacagtggatatgatgggttgaatgtcggccccaaaaagatatgtccacatcctaatccctagaacctgtgattgtgaccttctttggaaaaagggtctttgaagatgtagttaagaatctgataatgagaggagcctggattatctgggtgagccctaaatccattgacatgtgtgcttttaagagacacacagaggaacaacactgcaggaggaggagaaggccatatgaatacggaggcaactcttggagtgatgtggcctcaagccaagaaacacctggagccacaggaagctgaaaaaggcaaggggtggaatctcctctagaacctatggaggaagtgtggtcccatcaacatcttgattttgcagcttccagaactgctagagaaaaatttctgttgttttaagccacaaagcttatagtttgttatagcagccacaggaaattaatacaataggctaaacagacaaaaatccctgccattgtgatgtgttcattctcgcttggtgcagacaggcaataaacaaataaaatgtattcaatgttgggttgtgatcaatgtaacacagtaacgaagcagaataagcggggaagaggtttgcttgtgagtggcatgatcatcaggaaagatgctactgagaaggggcgttcagagactgggaggaggtgagggaatgtgccgtgtaggtatgtggaggaaaagctgtctagacagaagggaatgaaactgcaaaggccgtgacactggagtgtgcctagtgtattggaggagatataaggcagcaaaggctgacaagaccagattatttagggcttttacttcaatttacccattgacttaacacttatctattgagcatgtaccaaatatattgttttacgacattcttgcaaaagcctggagaggtaggtaacaaaattcccactttaaagaggaaaacactgaatactggtccagcatgactcagctcatatgtggtggtactagaataggaatcttaatttgatgccaaccccagtgtcctttccccaacactggaatgacttatgtaaatatttatctcatttgtaatttgtctgtgtgttcagtcccatatgacagtcttgataagcccagctggcctctgaggccaatgcaaatatattttgagctgagaattgctcttgggcggtgagaggactgtagtttggaaaaggtcaagggctgtggattgccatctctcatggtgtcttcagaatgtttcagtagctttgtgactccaggtagcattgcattgataatttatctatttaactggcttaagtgggtttttttttttaattttctatctcaaaaatccaggctcataaatagggacagtatggaaaatgctgtatagggagaataaataaatgtataatcaggttagtaacatattatcattgatgcagctactgagcaaggaaaagcaaacaaagaaggagctttatttcatacccaagcaagtatagctcaattgcaaacctctcagacttgaatatatcacattggtcagtgcatatcatgtcctggaatgttacagaaagcagtaatggagagacaggtggatgaactaaaacttaacttacctctctcttcacatagcattagagcacagagaagattactacgacccttgggcatctgtgactactccattcaaaggttccttagaatgtttgctggaagcagttacagaaatgtgaacagggcttaaccagtgtactccataccctaaataattctgtataaataagagcttacatatctatgatgcctctctgtcacttcttttatattctcctttagtttgttttggggaaaattctaagtggatttgctccatgtaaatactgtacttccttatcgtattaacaaaggaagaggtaggagaatcaagacaatcgaatgtgtcagactaaagtagataataaatgctctttgggaaaaaaatattctcagtcaatgacagggaattctgatttgataaggaaattttcttgggttaatgaatgcaactgtagaatactgagtccgaccagcagaaacctacagccccaggccagctgaatcccattccttataccgtgagtatctgtgttcccttgcagcgggttttgtaggagtcagggataaagatagggaagcaggaggaaagggtcatagaatgctgccaaaggctctggaggctcaaaaggaagaactttgaattcacaaaacactatgccagctcagacctgggcatccaaatcagttaggatattggctaacagctgtaataaagaatgctacaaaaacagaagcttaaaccaaatagaattatacttcttcctcataaaccactccagggcagcaaggtaactcttcttttgaatgtcatgcaaggacccctgttttgttttgttttgttttgtttttttcccaagactgagtctcattctgtcacccaggctggagtgtattggtgtgctcactgcaacgtgtgcctcccaggttcaagcgattctcgtgcctcagcttcccaagcagctaggactacaggtgcccgccaccacacccagcaaattttttgtctctttagtagagtttgtctgtgttagtcaggctggcctcaaactcctgacctcaagtgatccgcccacctcagcctcccaaagggctgggattacaggagtgagctactgtgccacccagccaaggactcatgttttgaaaaggctgtggattatcatctcacattatgtctccagcaagttacagcagctttgtgattccaagtagcatggatggagatggcacttgtcatccccagggtggtatcctcattcctacctcctgcaccatagccaggctgtaggaaacagactgggaggaacaggagaagagcatcttccttttaaaggacattgactagaagtttctcctaatgctccctttcattccctgttgagcagagctgagtcacatggctatggcccgctgcaatggaggctgggaagtgtagtttctaactaagtagccaggtacctgaataaaacccagagggtaggagatgagattctattattacaagaagacacaatttctgccagggctttaaccggtggctctacccttcacagctggacattgctggatttttggatgattatttcattgtctccactcaaagattaagtttggaaaatagggaatttttctaccaaagcataggaactccaggccccagcccctcctcactctttctccctgttcattctcatctctttccagttccttacctcctgtaacctgtgggcatactaaagtaccaaggtaggcttagctgcaggcacggtacttccatgattcagtgccccgcccccaccactgagctaggccactcccaccaacaacctcaggccttcagatgcccaatttctgtgtagagctttgagcagtgttttccagttgtgaagggcaaaggaaattctccaattatttgtgtgttcatcttctctacctcccaggtaaaaaggagttgtctcaccattatagcttgtttcagaaacagtgtcaaattctcatcacagctcatgcatgccttctcaccagaagtaccctaattggttctctgactccaacaagagagctaggctttttgtttcttttgctttgttttgttttgatttgctcctttaaaaatgtttatggtgagctcagttatttaaaacaattcctggcagaggatttaagaggcctggcagaaattatgtaagcttgtacagtcatcttcactgataatgagtaaatcagatagcagacattaaaagattaagcactggtgtttggttttttggttggttggttttgttcacttgtttttaatgttgcaaaagtccttcatatgtcattgacaatagaatttaagtatttttgaaatgtactcagttcagattcaccattacatttcatgtccttaaggttggtagcttaagatagcttgtgcttcagttgcacaatactggcgtcagctctcctttaactcaaagctttctggtaattttcatctactggcagctcagtgggggcattttcaagtctcaatcacatcactttaatacataaacaaaaaagacccaacacaatagcaaatgaccatgagcttagtgccatcttgagtgtatgcttttagaccccagtgatgatacaacctttccttaatacagagaggaaaacaattttgatccgagaggctttctcccaggtgcatctgaaaaaacgttcagatatgtctcctgaatggttttgactaacacaacttactttcccccagaatagctcctctctaaaaaatgccaaagcttgcctttcagggacaaatcaaaggctaagcctgaggatgatggggtgacttgaaaaagactagccaagcgcttgactgctcagtgcagcctcgataacaccattcttggtggtgccatttgctccttgtccacagcccatatcccaatgagggttattcacttttgtaaccactggtttccctctgatagtgtctaaagaagcaaataatgatgaagtgagctgtacctccaacagagtttgaagctagccaggagcccttactgatgtttaaaaactggttcttttcaaaattgtggcaactttattttcagaaacaggtttcatcccaataagttatttggatgttttagaatagaataacgccatttgttgaaattcactgaagtaaggaacaatgtaatttgccactaaaattttgcacatttcatttttcttcaaaacacccagttttgattttttttgtttgtttgtttgtttgtttgtttgttttttttgagacagagtttcactcttattgcccaggctggagtgcaatggcatgatctcggctcatcacaacctctgcctcccgggctcaggcgattttcctgcctcaacttcccaagtagctgggattacaggcatgcaccacgcccagctaattttttgtatttgtggtagagacggggtttctccatgttggtcaggctggtcttgaactctcgacctaaggtgatctgcccacctcggcctcccagagtgctgggattacaggcatgagccaccgcgcccagcatgatgacttaaattctaatcatagtgatgttatgttcattgacacattactctgtgctaggcaccgtgacaggtgatctatgaatgctgtctcatgtagtcttcactataatccatgaattatatatattaacatgaaacccatttcacacgtgaggaaactatggttcaaaatggcagttagcttctccaaggttatataactcttcaggttttatccagaatcaaatctgagctctgattccagagttcttgctctgaactctattgctttcatgataaatttccctaagggctaaaaaatacctcgtaagaaaaatgtcttaaggccgggctcagtggctcatgcctgtaaccccagcactttgggaggctggggcaggtggattgcttgagtccaggagtttgagaccagcctaggcagcatggcaaaaccctgtatctactaaaaatattagctgggcagggtggcttgtgcctgtagtcccagtaacttgggaggctgagatgggaggatcacttgaacccaggaggcgggggtggcagtgagctaagatcacaccactgcactctagtctgggcaacagagcaagacgactctgtcaaaaaaaaaaaaagagagaaaagaaaaatgccttaaaattattatgcatgcaactttttctttctttcttttatccatagctatacttggccaaacaacattaagtcaggttatatttgtccttttcctcaattgttcctacctacctaccgacttacttggctattttcattcatcattaagtgattgatggatcatagttgctaagagaagacacggaaatgaaggaaatcaacccattccttcattgattcattatgtttagagagctaccatgtatgaggtattttccaggactttatgataccttaagcttacattctcgtgaaagaggcagacaataaatagtataaataacaaaaacatactatgggatacgttttaataataagaagtgctaaggagaaaaaaaatagcagagaaatgtcagggtaaacatgtattgaaatgttagatgggctgtccaggaaggggcagataacaaaggtgacctttgagtagatgccagaaggaagttaggaagttatgcaggggagccttggaaatgtgggggaattgcactgtaggcagaaagtacagcagatgcaaaggccctgaggcggagaatgcctgggggattgaggaagaactaggagaccagtggggccgagtgactgagtgagggtgagagtagcacaaaatgcgtacaacaaagtatgttatggagaaggctgtaggttagaacaggaactttaactcctaattaggtggttttcagtagacgagtgacacaaacataatgttatacttggacctttgctgtgttgagaccactgggtgtgggagatgggtggatgagggattgggaaatcagtgaggagcttaccaccgtaacccaggcagaagatcatggtggcctgtgccagaacgaggccttcctctctttctccctccttcctttcatcttcacagattattctatattagtccattctgacactgctaataaagacatgcccaagactgagtaatttatggaagaaagaggtttcattgactcacagttcagcatggctggggaggtctcaggaaaggtagaattatggtggaaggggaagcaaacacgtccatcttcacttggtggcaggaggaagaatgagagctgagtgaagcgggaagccccttataaaaccatcagatctcgtgagaactcactatcatgacaacagcatgggggaaactactgccattattcaattccacccccaccgggtcctttctaccccatgtggggattatggaaagtataattcaagatgaaatatgggtgaagacacagccaaaccagatcatagtccatgtctacttcattcaagagaatgaatgactgaatgacacttaattgggtcttttgatattagcatccagtattttgtcatcttctgagaggggctacttctggagacagtgacacagaaaaccagtgctcttgatttaagcagagtggatcagtaagaggtgtctctttcatttgtttagattatgatatttattcaaagagaggagcagtgaactgtggttgagtttgttattttaatgaaattacacttgcaactattgtaggtgtctttctatgtaatggatgctttacattctctcactttttttcctccagacaattctagacagcaggcatcatgattcccattttatagatcatcaaattgaggatcagagataccctgcaaagtctcatatggctgagtagcagtactctttacatctgaacccaggaccactctgactccaaagccaatattctctctgcatatttaatagctgttctttttaaaaaattgtatctattagtgcatatttgatggtggataatgtatatttaataaacccactgagtcatgtagctgtacaagcatttaggagattatgccatctaggaaattaaatattatcaagtgttgtcacacttgagcatgaacaaatacagactgctgggctctatccccaaagattctgattagaatggctcaggccgggtgcagtggctcacgcctgtaatctcagcactttgggaggccaaggcaggtggatcacctgaggtcgggagttcttgaccagcctggccaacatggtgaaaccctgtctctactaaaaatacaaaaaattagctgggcatggcggcacacgcctgtaatcccagctactcaggaggctgaggcaggagaatcacttcaacccaggaggtggaggttgcagtgagctgagatcacaccattgcactccaggctgggcaacaagagcaaaactctgtctcaaaaaaaaaaaaaaaaaaaaaaaaaaacaagaatggctcaggtaggggccaaaaatctgcatttctaacaagctcctaaggctgctcatgctgctgatcctggcacagcactttgagaatccttggtccacgccaatcccatcatttttgcaagaacaaattggaggtcagagaggttaacactattttcaatgatcagttaatacccctcccacctgcattaactgtaagagaaagcttgaatgacagagatgcacgactgtcagaaatggaaatgtagggtttttttggcccctttgcttgttttaattcaagagtataaaccataggtaatgttgtgctctcactttctcctgatttatctccttttgagcacttaatgaagaggaaccccactcattcacacacacacattttatttctcctgccctttttctttcctttccactttgaaatttctgttgcactttgtagttgtccagaatattttcagaaatacctccttgtgggtgaatctgctgcaaacagggctgatgaagtccctaatggttgttacccagagccctactgaatcaaaagaaatacttattttttctaaaaaaggaatcagtggtgggtttgtgaacctatgattagaaacatcctgcggggacatctacttgttcatatttaatgtcatttactagtagtggagcttacgtgcagttggttgtagcaaacagctctttggttctccccattctttaaggcgaaacttaaatgtaatttcttagcattttgtggctgaagctcaaaccagatggctccttcttttctttccagagcacttagttcacacttctaatgcgtagaacatgcaacatcgtcgcctaattttaaatggcttactcactggccagagtcatgataaataaagatggtgtggaacgtttcttctgtttcatgctcatggaacacagcacaatctttggggctcagtttactgagtatgagacagcaggacaaagtagtaaggggtgtgagcttcgaagccaagcaggttgtttggagactaggtttttctacatctaccacacagcttcactgtaggctcagtttctccctctattaagtggagaaataatagtaatatcacacagagttgtaaaaagctcttaaaatgatgacgtcatgcttgcaaagtcttagcacactgttcagctcatggaaagggctgaataaatattaaatataaaccagacctcatgagcacattcaatccccagggaattagtctgaaagaaggtgagccctcaacttctacaagtagtgcaaatcgaaagcccttcctctcacatatggtaatccccaggggcttgtactgtcatgacccatgttgcttctgggtcctgtgcttgaaaggctgtctctttccccatctgagtcaaccgggcggtaaaacgtggctcctgtaccaggttgcacaagaaacatgcatacacacatatcactgagcaaggtgaatgccactgagggttcggggaccaggggacacctgtgtgatcttctaccacctttccggccctttcctttcttcccttcttcttctactcccagttaagctttcattttccaatgctcttcagcaatcgctattttactctcccaaacttctacagccaaacccagcaagtgttcagttcagcagaacaaagggtcttgctctttgctggatctacctttctttcttagaggggagttggggttgaacaactgtttcgttcattacagctattattaatattttcaaagttattattaatgaaagagtgagtaacgctgccttattctccttttatttctcacccactctttttgtgttcagatcactagattttaattttacgccctttccccagcccaggactaggtctgtgttacccaggaccatttgaaagttgaaagaggaactcattggtgatacactggcttaaaaaactttaggaattcagaaaactatccaagaataacttataaaattacagatgaaatatgtgttatagtttaaacacaatatttttctgagttctttggatttttaagtacttaaaatacacagtgactatctcttttcaattttccaaatatagcatctaaatttagagagatgttaaaacaatttgggggttgtttggtttctttcctttttttttttttttttttggcccctttgctcaaagaaatagtgctttgctttcttctaatgaagtaagccctggtccaaggaaaatataaaataaaatcgctattttcctaccacctttgggctatgtaattcccatttcattttccaagaggctaaattttcaaatggtttcacttacacagtgcagaaaaattagacatcttcgtcatttgggggaaaataatgacagactctctacaagaaaaaactatatatatatgacaaatcatattaaaagataacggatcactttaagtatgggaaacagaccttgaagacaaacagttttgcacccgaacttgatctaagcatgattcccagctaattgtttggttctaaattaaattattccttttgataccgaaattatagatacagttccatttggcacttcagggtatatttattttctctgtaagtgcttgtccatatatttaaagactacagataatggatttttaagtgtatttaaaaagttaagcctcttgagaatttattttaaatggaaaatatctcccagcagattgtaatttaaaaaattaaaggcaatacaatacacatgcatagagataacattcaggtgtttgtgaatcattttccccactctgctgattgtctttgtggttaatcatggaactgatggtgcagaatacactgtggatgagtttacttgcctgagcacttaggtggcttagagcagatctcttgcaaaatgcgagaaaaaatatgaccttggcctacagcagtgatcaacaaacttattttgaaaaggattagaaagtaaatatttaaggcttatgagcgagatattctgttgcaactatccaactctgctgttgcagttcaaaagcagccatatacatgtaggtgaatagtgtggctgtattccaataaaactttatttacaaaaacagtagtgggccggatttgacatgcaggttgtagattccagactcctggtttggaggcctgacttcacaactttgtgtcatcctataggagtatgagttcagctcctggattcagcatctcagttaggcccactctagtgagttagcagagcagccttctttacgcagctgccataaacaaaccaagcaagccatgaagcccacgcttcagtgtcataatcacatttcccttccacatgatctgtacacacctcaaaccccaatcctcacaagtgggattaagagcctcaggaagagctccaaataaatcctcttctcctgtccatctcaccacagaaaagcagatgaacagaaaatcagaaagtcagtaacttgtctattcctcagagttagatgtcagtgtgatacctgacatagagacaatctgacagatcacaaaagtctgattcatttataaaatatctggtgagtggctactgtttgtcaagctctgtgctagtgcgagagatacaagggttgctgggatggcccggtctctgcaagaatggaggttttattctagtgagagagacacaacatagggaggaatccaaaagacagaaggagggtttgccctgagtttcctgttggaaattgggactctggtaagcagctgtgtgataacagaaagaaacatcagcctcatctgtataagcacgtcttcattcaataaaacacatataacaggcctttgctaaacactcgaggtaaaatggcaaacaagacactttcttccctcaagaagttcacagtctgataaggaaaaaagcaaaaagaacaagtaatgacaagttgaactcctgaatattctgacagatcaggcaattcacacacacaaaaaaaggaaatagaattgccgatattataaaacaatctctaaccttcccattcattgaaaaattttcaaactaatactacactctcttccaaccatcagattggccaacaaaaataaacattgtattatcaaccgttagcgtgaggagacaactcttagagcccaaatcgataaaaaaaaaaaaaaaaaaaaaaaacttagcatctaactaaattttaactgacgtttcatttgaatcagcactttcagaatggctctgaactacttaaatatatgtataaaagccaggtataaaggtatttgtggccgaccatggtggcttatgcctgtaatctcagcactttgggaggccaagacggatagatcacttgaggtcaggagttgaagaccagcctggccaacatggtgaaaccctgtctctactaaaaataaaaaattagccgagtggtggcccatgcctgtaattctagctacttgggaggctgaggcaggagaattgcttgaacctgggaggcagaggttgcagtgagctgagattgcaccactgcactccagcttgggcaacagagggagactccatctaaaaaaaaaaaaaaatatatatatatatatatatatatatatatatgtatatatatatatttgtatatatatatgtatatatatttgtatatatatatttgtatatatatttgtatatatatatttgtatatatatatgtatatatatatgtttgtgtatatatatatgtatatttacatttactactacacagttggtaattaatgaaacggaaaacctcagtgttcagcaatagggaactgctttaatgagagcagatagatccatactaagagataatatgcagtcataaaaaagcaatctatataaactgatgtaaaaagtatttaatagctattaagagaaaacctacctactgaactgtttaagtgtatatatagcttgcaaatttggtagaataatttaataatcaaaatgtgtggctaatcggggaagtcagggcttgttgagatagtaacaggctgcatctcctatttcacttcagttgattccatttttaattatttttgtattttaaaatgactattaaataatatgagttaaaggatgtatacctatttaaagactatccactgagaaatctcacccttaattctaaagggcgctgcaattcagtgatcaatagaatgaccaaatctccaccctcaaagttccttggttattttgaaaaccgtactgctaaaaagagaaaaaaaaaagtgtcattcttttctgcctgatatcttcccagcatatgtaaagtagtattcctggtgatagtatctgaaaatcaacataatccaaaggtcctcactttgtaatgtttgcagtaagattccagcatcttagcatttaactgttttcagattacatccatttaaacatctgtgattcattatcgtaaatatcacagttgtggggaccatatgcttcagcttgcagcatatatgtgtgtgtgtgtgtgtatgtatatatatatatatatatatatatatatatatatatatatatataaagaaaaagcacgagcaataaatctcaggaaccttagacttgccgtgggtatgtgcaaaaagaacatttccaaacacatggggctgtctataatcacagtaatgtacttgagatcccatgtaagaattattcaattgcaaaagttgccacttgtgatggaaagctatgatttacatttggcttgtgcacttcccatgataattcaaatagggtggaaagcagcacaaaagccttctgctgcattggcttttacttcttaaggaaatatgtgagcgctattgttgtcgagtggagaaatcacagaaaaatgagatacctttaacaagtggcaaggcactcttggcaggcatccttcattcccatgagactggagctagagatgatgccatatggcctaagggatgtaataaaaatcacttggccactggaggatgaataggcatggcctacagggctgattattttcttgcttacaccagaaaacccacgtatgcacacaagaattaattgtgcttcatgtattgtaagccaaatcattgtcttttaatttcctgataaagtcttgtcaactagacagaaccaatctgtaatcacagctgatgagtatctcacacactgcaattagggaggaggtaaatgaattaattggttacaaccaaaaggagtctgctaatattttttgattgccaactctcttctagggctagcaccaagcctagccagagatatggagataaaactgtaggaagctcttgccctcaaggatcttccagattaccaaagggcaggttaggtcaggagaaaattttcaaggtgtggaagctggccttctgcagtctgctgcagtttgattggcatccctgctggttattatcaagccaccaaccttgtcaaagccttgtgcattccctttaggaaggagatccattgttgccttagatggtgttcttgagcccctaaacactaccctgccatctagaaacatttctggaccctgtcctggaatcaaggtagcacaaggccatctctgcttagaagcattctagatatccacaaggaaggaaggatggggtgtttaaaatgcttttggatctttttgtacaaaagatgctcatctacatactggctacacgtcatttatgacatttatgaaaaccaaaattgacattctgaagtccttggatcaaatttctgtgctgttcttttctcctccatggtgttttatttgatgcgatcttgggatgtgtgatgacttcgtagtggaatagcaggtgttgatccgtaggaacttcaaatctcaagagttatttgataaaagttatagacagatcaatgatagcaaatttcaaacttatgtttccccagtcattgaagaaagaacactagtaacagctcttgactacatttaggtgttcttgactatctttaatgggtgcataaggatttgcctgggccccattcattcattttccttgaccctcttcagagcttgagtgtttcctaagctttgacacacagggtcttctggcatctgctgtctggatttttgctgatggatttaattactgacttcaagattctactcaattccattttgacaccttttttagctcaagacacagactctttgactccctgttatgtcctgtgctgctaagctgtagaataacttcgaacatttactttggataccatcatttgaaggaatccactctctttcccaaggacctggaactggattctatattagttgtaaaaagcaatccagctttcctacttacagatgtgtgaccttaagaaatgttcttactctctgagcttcaggttttctcccctaccttcatgatactgttggagaattgaaagaaataatgtttatcaagtatttagtccacggactgacatatagaaaatgcttcataaatggtaggtattatatatgatagacatcaaacatgaaatactattagggctctgtactattagcactattagggttttgtagagtgacttgaatatatagggaaacaattcatgtaatccccaaggtgtgttcatatgaaccaacacgctttgatgccacagccatttataccagctggaagagtgcagaactaacataaatgatgtcctgctagcatctgcagctgggtcataaaccaaagcttaatgttttacaaagttttgatatgcagtagtcaatttatccatttttgtgaatcaagtaggttgggaaacaagcccagcaaaacacagtttggtaaattttatgtgaaaaaactctcttctttttcactcagtaatttttgcattttaaaaaaatacagtaatcaaaagaaatatgatgggccagtgaaaagcctggcctttggagtgtggtgaacctgagttcaaaccccagttctacaagtaaacctttgcactatgggtggctcagtctctcccagcttatctcattttgcctctgtaaaatggttgaaatatcggattatggggattggagtgaaatggaacactgacccttcaacatgacagccctgccaataattatggggtctaagcttctagacgctaagtatcatgaaaatagatgctattccacattcacctttagttgccgtttatcccttactgcctactgtcttgtacattgtaagtgaaaaaatgatgtttttaatgggttaatggatgagtatgttgaactttagaataacagaatttcccagttgtaagagacatcattcaatgctggaattgcttccacaatattcctgatgaagtcatataggttccacttgaaagtacccagtgacaagcacattatttcacccagaaggaactagatcttccaaatggtaacctgaattgctttaggcccctccagtatggtcatgcattgtttaaccatagggatatgctctgagaatgcaccactgggtaatttaatcattgttggaacatcacagagtagacttacacaaacctagagggtatagcctattacacacctaggtgatctcttacaacctatggctcctcggctactaacatatatagcacggtgctgtactgagtgctataggcaattgtaacacaatggcaagtggttgtgtatctaaacatatctaaacacagaaaaggtataataaaaatatagtctaaaaggtaaaattggcacacctgtatagggcacttactacgaatagaggtggtaggattggaagatgctctgggtgagtcagtgagtgagtggtgagtgaatgtgaaggcctaggacattactgtgcaggactatagactttataaacactgtacacttaggctatactaagtttataagaaaaagctttctttcttcaatcataaattaactttagcttactgtaacttttttactttataaactttaattttttaactttttggctcttgtggtaacacttagcttacaacacaaacacattgtacagctatagaaaatattttctttatatccttattttatagacctttctatttttaaatgttttctctttttctttttcacttgttgaacttctttgttaaaagctgagacatgaacacatacatttgcctaggcctacacaaggtcagaatcatgaatatcactgtattctgcctccacattttgtctcactgaaaggtctttaggggttataacacgcatggagccatctcctatgatatcaatgccttcttctggatacctcctgaaggacttgcctgaggctgttttacagttaacattttcttttttttttttttttttgagacagggtctcgctctgtcacccaggctagagtaccgtggcccgatctcagctcactacagcctctgcctcctgggttcaagtgatcctcctgcccaagcatcccggttagttgggaccacaggcaccagccaccccacccagctaatttttgcatgttttgtagatatggagtcttgccatgttgcccagtatggtctcaaactcctgggctcaagcgatctgcctacctgggcctcccaaagtgctgggattacaagcgtgagccaccatgcccggccagtaaaccttttcttaatgggtagaaggaggagtacactctaaaaaaaaaaaaaaaaaacaataaaaacgatagtatattaaatatataaaccagtagcatagttgtttattatcattaccaaatattacatatggcacataattttatgtgcttgacttttatgactgaaagtgctataggtttgtttacaccagcatcaccacaaacacatgagtaatgcattgcactctgacgttatgacagctacctcactaggcaataggactttttcagctccgttatcatcttacgggattgctatcatatatgtgttcctctgtagatcagaacatcgctatgtggcacatgaccgaatttggacaaatgtgacgtcatgcaaatatgaatatttgcattgttctggcttgtagccccacacctgcatagctgtaggacctcaatgtattctccttcctggccttttattctggttatttctggaagacctcagggcatctgtcacatgaattcacaaattcttcttccatgtcctctcattctggcctctttaattattaacattcctgggaaactcttggaggaagggcctccccactgccctctgtgggaaaagtccatctccaggatccccaaagccatgtacccctcaaggtgccaacagaccctatgactgctctagtgttctctctaccagaacaaagccaagctgtactccactcaaaaatggggccaccctgctgctcagcataacagtttgctattaggaaacaaaataacagtgcttgaaaatacctaagttgtctgtggtttgtgaatctttgagttgtgtatgtagctttcttttctctgaactatggatccatggggctggcctaggaaaccaatattgtgttcctctctctctttctcctggttctgcctccctctctaggtgctcatgcagaagtagtcctcctcagaggcccccttcctccccaggtatatctgctcttgcaatagagaggtaactgggaaatcacgagactgtcaaggcatcaaaacacaatcagggtctgaatcccaatttaggcttagccaggacactttgtcacatgtccctagacaaccccaactgcaaggccaaacaccctgaaagttgcagtggagtaaagctctcttcacattaatttacccttgagatgcacattcagaaggagacttttacacataattgctataaagtttaaaaactaagggccttgtcagagacgtgtgccagtcatgaaaataccaagaagggatctctgtaaatccgagatttggtgattctcaaacttgctgaatccatgatttttctttcgcttaatgggtgactttcaaatccacttactcaaatcttcacttgagttgatgccatcattctcagttgtgtttggggagtttcaaatctgcttagctgccaagttgcagttctgctatttattcattcaacaaacagggttgagtatgtactgtgtcaagcactgtgctatatataaagtaattccaatttgaaacacaaattcgtagtgattataaccaccatgggatagatgatgcatagcattctatcaggaaacaacctgccatgttttaaggaatccacggcaagaggagaacgtaagactgacacacatacaaaacaaagattcaaagctaacggctcagtttttaatggtaggtggagaaaatcccctgaaagcagatgtggcctctgtctttttccaagaggaagcccttaagggttacatggcaaaaataggtttctgctgaagattgttggactgtatcattcattatgatatcttctgctgacatgatagaattgaaactctattttatcaaagttggaactgaagcatggaatggaattaagactgttttatgtttgttctgcacttaccaaattctataaagcctttggaagtgaaattcactcctgggtcaaccagtcatggctagaatactcccagaaccttatagaagctctgcaatgtcagtgctgactctaggccaaacatggaacacggaagcccaatacgcatgttcaggaagcagaagagtagaaataatcaagtctgtagggtgtgcttcttgattcactcatggatctgacccaatgtgggtggaattgaacgtatgttaatgaaggcttgagtgactagaatgctggtgaaatgagagtattcaggaaagtcaaaagaaatgcttcctgtttcttccatttggaccagtctaaagagactctggactaagccctgtgagtgctttaaaaggaaggtggtgcctctggatgccagtggcatactgagggatatgaaaagcaattaagtgatggcctgtatcctggaaagagtctgtctgatatttctgaattaaatgctactttagttgtcagaaagacattgtcatgccccagcaaaggctttgcagattaaccaatatgcaggaccttcatgctgaggaagaattgaattctgtttttccaagtaggcaaggaataccaggatagctgggtctctccatctcaggcaaaacagacaatctacattcttatgctctggggcagttcctatctgtgtcatgtccttgagacagctagtataggtacttctgagagctggtaaaaattttagaaaagttgcaagccaactgaaggcacattggtaccttgaaataaacaacgtgtagagcatttaaaccacagaaatcggcagatgctacaactcgagactttttccaagactagcacatcactgcaagtccttctcttctgtgtgtgcgtatgaagatcctggaggtggatctgtgcatatctgtctgggggagggctacaacttccagggtgactgattcagagcctgtaattctgattcatatgcatccttgcacacatgtacaagtggaatctgaccatccactctgaaagggccccacaacttatgtgcagacacatttgcaaagcctctacaaatacatgcaaactctaggacaatttacccatataagatgtgagtgtataaatcacagattggcccaagcacgcttataagaatagcacaaaattcatatattagttcatacctagctctgcaagcaggactgttctatatttggcagataagtttaaatccatctgcatttcattttttctgggatcataacagagcttaattttctcccttatccatttttagatggtaggaaatctatgccttttggattttcatccccaagaaccaccttcaaaagaaagaaatggaaaagcataaaatcaaggtcgggaagattaagccccttaattcacatgtcaaacttgccatttcaattgtggttttgtctcccagctgaagtttgtctttttgtgacatttgcattaagcccaggggacattttgagtggaaaagcgctgaaagcataattgaaactctgagtgttgccttttgtctaatttgcaatttcccccaggtggggtgttttcactaccccccgactccaccccgccctcccagggtgttctaagattatctcaaagaatgatgttatgcaatttattccaataaatctccatgtacagtatcttatatgtgtatattttttgccttccagaagttatttcaaatccgtgagaaactatgtagggaagtcattcataggttcagaagagtacagatagttcatttcccctttcagatagaggttttgagtatttgttcacaagtttaattgtttagtcacatctttcagttatccacatggtgtcattctgagccacccaggaagttgtctctatagaaacaagcattttttaaatggacataaactgttcagttttgtccttaaatatgtctttgaactctgtgctcaattcacatatggtcttgatatctacttaaaagtttgagaatcactgacactttggtggcatcaacaaagtcaataacatgaaacacaatgcagggctgatgtcatcacatgcaccctttaataggaaatttaggatatgattataattggtgagaatgtagagtctgttttctccaggagaaagaagaaaacgtaaaagaaaatgttgtggcttgtttttcttttgagtcaatgtcttcctgtttatcagagctgtcctttagatattgccaaagctatggcaacaggagcaatttagattttgccctttctagaatttctgtttttatcaagacttcattatttatattaaataaattatttcttatctgatatttggatatcatagccttcctggattatatacctgagtagagtggatgcaggcatgaatttgtctaactgagggttggatggcaaggaatgtagtaccagccagcatttccagagggtacaacaaacgtcactgtggaggttttagtggatacaaggacaaacttttttagtggatacaaggacacacttacttcttttgaatttggctctttagatttattttaatatttatttgaaaaaatacctggcatattcaacaggtattataaatactacattcaaataattttataatttaaagggtcagtcagttaaaaaatattaagtaaataatcgatgtggtatgagaggtggcaatgaaattgtgagtctggaagctgaatgactaaaggaaagaacacattcatctagaaagactggcatagccctcaggagtgtgggctctagaaccagaaaccacactcccgagtttggatttgacctcggttcatataatgacttcgtggcctcggataactcatgcaacctcactaagtctcagtttccacagaacaccaaaagttcctacctcaaattgatgatgtgaagaagacgacatgaagatttattgcaatcattagtgtaaagctcacagtgtaatgtaatgtcattactttaggaaaactcttgccttacatttgtacgaagttgtcttcaccaacaatccgtttggagaatatcgaacaaaactttgttgattctattttgagcagggctctgtaatttcactcctttaatatcgtttttccttcacaactgttcacatgaagtacgtagggcttcaccaaaacaagtgaagggattcaacaatgggcaagcctgaatcagaatcatcagccccacccctttaaccctagcagtgatgcctgtagtaaccatttccatggcaacagcctgagactagcaaggtacctgactagaaggaatgacagaggaggaggtagaaaaatcagctggaagaaggaagctgtgtaggaaaaggaaaaggtagcttccttagtgcccagaattatggcaataatggtgatcattctcattcatggagcaacaagctctgtcctaagtgctttctgtgtgtaggcatgcattatcttgtttacacatgccataaggattatagtacctttcaggaggatgcccactctatggataaagatgtcgaggattaaagaatataggtggtatattagtccattctcatgctactaataaagacatacctgggacagggtaatttataaagaaaagaggtgtaattgactcacagttcagcatggctggggaggcctcaggaaacttacaatcttggcagaagggaaagcaaacacatccttcttcacatggcagcagcaaggagaaatgcagagagaaggggaagaatgcccatcagatctcgccagaactcactgtcacaagaatagcatggaggtaaccactcctgtgattaaattacctcccatcggcttcctcccatgacacacgggagttataggaactacaattcaagatgagattttggtggggacacagccaaaccatatcaggtggtttgcccaacgtcacagggctcctacacacaagccaggattagaaaagggcttagaaacctacccttaaaacttccctttcttggggcacggaaataacagttgctggcatgccagtccccaacctctactcttttccaggaatggctgggaaatgtggagacctggcaccttgacaaagagtttataatgtaaggtcctggttcctggctctgtctgcattagattaatcagggggagcttttaagagatactagtgcacacagaccgcaactcagcacagttgtatcataatcttgggagagagtgggggcaggtattgctattctttttaatgctccttcagcatttcttagatggccagccttgagaaagaaccatggcctaaagcacctactcctgagttggtaagtggtatcaaaaatatacaaagacccaattatgcaactgttagctatttgatttagaaagtattgagtgccggtgatgtgccaggtcctgaaactgcagttgttctcagtgtgacctcacttggtacctctgatgatcccaaaggggtttgtgagatgcccaagggggccatgttggggcaactgtcctttctccacttgcccatctattcctaggaagcagatgtgcccagagcttgggctgtagaggcagaatgaacagatcagagaaggttctcgctctaggcctttctggatatgggaccacgagctagtcagtcaatctctctgagactcagtctcttctcctgtaaaatataatatgatgcttatatatttatagactgtgcattctcattggggctatatttcccccacaggggtgaaataggttcgagggtggggggacaaaaattgcacttacaaatgtaaagtatagatatacttgtagtacctaaacagatataagtatatctgtgatattaaaattttacaggaatagtggcaattagaaaaaaatacttaaaagagcccttaggggagtagataatgaaaaaaacaaaagttaagcaaccctgctatagaattgctatgaggctgaaaggaggtatggacttgtacagtcctttgcatagagcgtagcactcagggaccactcaataaatagtagtgccatgactgttgtctgtccaagcatcacttcattcaaaatgcacacactgattccaaccattctttggggctatgcaagttttactggcatctttgggacagataaggcaccacctctgacttcaccaatgagctaggtcagagctaagcagagcggctgagtgccattctaaatggatacacacggggtccaggggccaaggggagagcatagctgagttcttcatttccttgtactccctgctgctgggttcaatgaaatcaagaggtcactacgggcctcttatcccaattcacagccttgtcggcagcctcttgctcacagcacagaagggagaccccccccccccaccgccccgcctccaatcctctaccattactaaatcatcattttgctctggagagtaactgagcaaagtggaattattactgatggcctcccatgtggaaaaacatgctgttcattgctgaagatgtaaagatgaatgaaagaacaagactcaatttctgctcttggttctggtgcaaaaaacaaatacataatatggacagattgatataatataaaaggttctatgggaaggaaattctggaacacaaagagaatgcttgaagaagttgcttgagttgaatcttgaagagtaagcaagagttaacagggtgaagaaggtgagaaatgccttctgcagagagggagcactatacacaaagggtgggacagtagagtagggagatgcaagagtgggtgaggtgtgagctatgcagtgaagacaaaggcagaggggaggctgatggacagcctagtcatggaggaccttgagtgctaagtattgttttgcaatgaagatccataattatatgagactcaggtggagaaaagctggtcttatagttgcaacaggagaatccaaggcttcctccagggagcagagctgtgtggcccccagtaccccacattgcctgggcttagcttatctccattctaacttccttcaattctcccttgctgtctgtgccaatctaactgcttacatccagttcggtagatgccgcaggactttgcatatgttatggttttctctgcctaagtaataggtccccaattatttataagagtagtaaattgatgtctgtcttccacattagacttcaaactagggactgtgcctgtctttgttcaacattataacctcagcatctagcataatgtaggttctcagtaaatatttatggtaggaagaaagggtgggaagaagaaacttagctgggaatccagaacccccacaaactttcatatgccttttcctctaccccattcactccccagctgagactgtcttctgtgatcctgttcgagggttaagtctggaacctcatgctggcgattgaagcagtcatttcctgtgaggccttgtcatttgagtaatttgcctccagtggatgaatactaattgatgataacagtgaaagcaaccttggtgtcacttcttcatagttcacttccaaaaactgaaactaagcatgttcaattcatctgggctaccaacatggttagagaaagtgagcaagtgtctgagaaccgcagggtcctgagagtccacttgtgtgtccatgcaaagatggctctaaagctgacttaaccacggaaagccttagaacctttgcagagcgatcaaaaggcaccgcagcgtgcagtgctcttcaggactgggcaggaacatgaaaacaggactgagcagggcaatcacagctctctacagtagtccctgcttgtcctcaggggatgtgtcacaagacctacgtagatacctcagtccgtggatactacccaaccctatatatgctaatttgtcctatacatacatagctatgttaaagtttaatttacaaattgggcacagtaaaatattaacaacaataactaatgataaaatagaacaattataacaataatgaaaatggcacacaatttgaaacttatgaattgtttatttctggaatttcccatttaatattttcagacctgtgttgaccatgggtatctggaattgaagaaagccaagccatggagatgggggaactactgtattcaggttttgataggatttcagaagggttgtattctccatggggtattgtctttattgaaaatgtgcagtggtgacaggcaaatggtccagggttcaaatcctggctcatcatttacaacctgtgtgtactgggcaccaactttgcactccatgagcctcagtttccttatctagaaactgtaggagaaggggatcaaaatagtactttatttgttgtcattgtaaagattaactaaggtgatgtgtgcaaagtgtgtagcacctacccttgaatgtggaaagtgctcaatctgcattatccactattattatcagttaatatgattattatcaccctaagtatcatcttcccagagtagaaatatcagtttagattttcagatatttatatggctttcacagtgtgctaggacctatgtagatgagcttagattctcagatatttatttggctttaacagtgtgctaggatctatgtagctgttgttaccaaaagatgtacacaagaaagttcctagcaacaatatttggagccccaaagtggaaatagtccagataccagtcgagagtaggatagataaagagactcaatacagccacataatggaatactctatgatgattaagataaagataaatatagtaacctggatactatacagtgatcagtgattattgttatagtgattagaataaactaccacaactcacagccacatgatgaatctcgtggcatgtaatgtcgaatgaagaagccaaataggagagagtgcatactgtatgaccacattagatgccatgcaaatgcaggtaaaaccaatctgtggtattagaggctagaataatgtagcctctggggaagaggttaggaattttactcaggaagggaggggactggtaatgtgtcatgttatggcctggttgctggacagttggttgtgcttactttgtaaaaattcattgggttgtatgttctgatttatgtgcttatatgtgtctacattatgcttcaattaaaggtttactaaacaaataagcctgttcagcagagaccaaaaagcacgtagtacaattctatgcttacccacaaggggcctcaaagtttacaggaggaggcagacaggcaaatgcatgcacagataatgagttgtgatacccataataatagaattgtgtaccacatgcagaatcaccattgaggggagcatgatcagccgtcacagcctctgcttgtgtcaatgccctgtgctccatttgttcatgcagggggcccatcttccctattccttcccacacatgaataaggtattccatggcaggaactttgctcacatctgtccactctccatatcagcaccactgccttcattttgtacagccatctttgatgcaacactgaactcgttggaactgggtctcttggcctctcttcctgcccttctttaaatcacttgctataacccagatctgccaaattataatcattgtattgggtcctctggattcttaaaaagtaccctgtgggccgggtacagtggctcacgcctgtaatcccagttctttgggaggcctgaggtcgggagttcgagaccagtctggccaacatggtgaaacccccatctctactaaaaatacaaaaattagccaggcatgatggcatgcatctgtaatcccagctacccaggaggctgagacaggagaatcactggaacccgggaggcagaggctgcagtcagccaagatcgcgccactgcactccagtctggatgacagagcaagactctgttaaaaaaaaaaaaaaaaaaaaaaagcaccctgtgtgattctgatgcaccccaatccttgagaagcactcctcttcactggaagcagagcacacacctgatcttgactctctccacacaacaaatcgtccagggctaccagaaagcaccataacttactggcttttcccaacttgtttcccagagacattttcagcctcatttccacccttcccttctagatccccaccattctagattcccaccatccctgccccgttttaagtttgcctctattcacctaaaaacatatggactattccatatggactgagcatgaaagaaatatagttcctcaaagtaaattaaggagctgttttcagaggaaaggaaatggatggtggataggcaagaaaatgtggcccactagaattctatatggtgctgcatattgtgctgtatacatatatggtgcatgcgtatgtgtacatatgtgtacatgtatacattacatgcacatataccatatgtgtgtatatggtgctgtaggtatatacatgcgcatgtatacaccatatacatgcgcatgtatacaccatatacatgcgcatgtatacaccatatacatgcgcatgtatacaccatatacatgcgcatgtatacaccatatacatgcgcatgtatccatgcgcatgcataggcatgtatatatatgtatatgtatacacgtatatggtatatacatgtacatgtatatgtatacacgtatatgtatatacatatacatgtatatgtatacacgtatatggtatatacatgtacatgtatatgcatacacgtatatggtatatacatgtacatgtatatgcacatcgttaattctcattccctgaatctgttttgctatttagccctcatccctgtgcctttgaatagcctataatgtcttccacattcttaagggccttctcatctcctacttatcttcaatacccagctcaaatattgactctgtgcagctctcctcaatggtcctgagcaccctgtggttctgctcagtcacccacacatgccaggattagatcacttccctcaaatgtcactctgccagatctgactcttcactccactgagaaggcactcaagtgtgcacactcagagcttagcacctgcctggaacatgcgagttcgtcaaggacatgtcttgattgagtgaagtccatcagcacaaagtcacttgggcacaggcatcttgctgtgggataaaacgtaacatttgtgaactctgggttgggaaactatgtggtaattcacacttaataggtcagagatatctcagagataagctgcccaacctactcatgctccttctgttgtttcgtttgtttcccagtgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggtaacacatctgtttgagataacttgggttcaaggaggacattaggttctgtctgtcttatgtggaaaatgggtctttaatttattatgttggctaagattccttttgttattgttgttgcaaatgacagaaatccaactctaaaaatgtagatgaggggcagcgggaattaattgattcatgtaactaattgaggcatagttcgtggattaattcatggaactattttagggatacttctgccttcaggcgtggctgaagctgtccaaatcagctttaatccctgtgcatctcgtggctccattttccttttattagatgtattgagacagtcacatctctccctgcctcccaaggtggaggtctcagcaactaccctctttctgctggtctgaagtcgcctgagaaagcatctcttcaagacgatgctagcaaaaccttggaattcagtctcgtaggttagatcatgtgtccacccctgaactaaacatggtgtccattgggttgtgatgttctggttggccacgtctcggtcacatttcttttcctgaagccagggcagagtcagccctattcacctgaaaactcatggactgagagtgaaagaaatgtagttcctcaaagtaaattaaggagctgttttcagaggaaaggaaatggatggtggatagaccagaaaaggtgacccactagaattgtatatggtgctgcatattgtgctgtatacatatacggtgtatgtgtatgtgtacatatgtgtacatgtatatattacatgcacatataccacatgtatgtatatggtgctgtatgtgtatatgttgtacatgtatgtgtataccatatacaggcatatgtaccatatacttatgtgtatatgtacacatacatatggtatatgtgcatgtaatgtatacacatatgtatacatccacatttaatatatcaaagatatctcaaagctaacctgcccaacctactcatgctcctcctgttgttttgttttgtttcccattgaccttcagtgacttcagtatatctatgtgtgtatatgtatatatgtatatgtaattgtttacggttctgtatatatatacggtgtatatgtatgtctatatgtatacatttgcatttaacaggtcataggtatctcagagataagctgcccaacctactcatggtccttctgttgttttgttttgtttcccaatgacttttggtgacttcagtatatatatgtgtgtatatgtgtatacgtatgtacaggcatacacatactatatatgcgcatatactgtgtatatgtatgtgtgtatatacatacacatggtatatctgtattatatgtgtgtgtaattgcatatcgtgcttctcgtttgccaggcagcagtgcttgttcccttccacaggcacatgcatgcagatccctgcactcccacacatatgcatacactttataagtgtcacaaactgccattcaggcttcccgattgtgccattcggagactttttgctactactgactcctgccttcttcaccaggagctcagggactccaccttcgtgagaaaaggagggcaagacacacagcaggattccagccaaacaatgacttaatgatggcatgcccctgcttggcatgcctagccttctctcctacctgcgagcttggtcttcctcgatttttcacagcccctaattcacatcccttttctccacctgccatattagccacatccctgcttgatctactcattttgttcagtggtggagcgagtgtgggtcacacagctgggagcagagacagtacaactggcaatgtgagagttaccttcccgccagtgctgtctgtgtgatcttgagagcatcatatagcttctttatctgcagaatagcgaggttaaacagcctgcagtggcaaataagtggctcatgtgccaccctactgtcaccgtgctcgtggcagatattgctaataacccctggcttagcctgagtatccttctcactgcaatgcttctggaacctactatcaattgatcatttagtggtgtttctgagggtggaacctatctgccattcctgggctggatgaacttcacaattccccttcagcatctgtgaagctgtgagttaaggatagatggcaacctaaaaacgaatgtacggcacgtcagtcatgtttcagaggaaactggatattggtgaattcataccagtgtggaaatccattgacaccacaaaggcaagcttttctcttacttagccatgaccaatggtcacagcatctcactaatctgtgatataaattatgtggcaaatatctaaagcaacaaagttgccaggatatacagcaaaaacaatgttccatagaaacatggaaatggtatggtgagggggtttgcccatgggcttgaatgcatttagatggcgattgttcttcgtgaatggtggctcatctttctatctggaaaagatactgtcatcgtattttgcttcaaagagagcagaagatcttctgggcaggttctcgggaccaaccccaccttgagggcctgggagagctgggttcattatgaaaactcagccacgcattgtttgtacctcaagtttctgtgagatgccatccagagacaaagctcccctgagtcctggctgtttctcgcttgctgctgtctgtacgcattttcgacaaaacttgcctgtgattgtttttgcttcttataaagggggcggaggctgccgtgtccttcagtttgccagacttcagcagaatggggcattcatctcccacgtccagtaattttatgagatttgaaaaaaggctttgtgaagatgtgtagctgtgtccttcataaaaacgcctcaaaaaaggaaaaaaaaataaaaagaaaatgaaggaaaacaaaatagatagcaaaagaatccctctgaagagagcacatacctcaatggatatgcacgtggtatgtttgcaggtcctactgtgtgcagccaagtgggccagctgctagagaagaaaatcagtgagtgcctgagtcagctcagctcctgttggggagggaatacgaatgtgtgcattgatgcttgggtaccaggcggggagctaacagtgatggatgatctctgcatttggagaggggagaggtcaaggggagctgggctggtcctcaaagcaccaaccatgtgccaggtgttgctccatgggctacaaatgctgactcacgtaacctccttagcaactggaggcagatgctactgtgttctgcctcatagtgagtttttactgattttactgatggaggaactgaggcacaaagagccaagtgacatttccaaggtctaaaaatgaataacaagctggatggaagtgagacttgagcctgggcagcctggcccctgagtccgtgcctccaacccctgcatgagctggactttgaaggacgggtcattgtgcatagttgggagggtctacgagggaaatgttggcctgtcttcatggtgtttctcttctaagctgtgttaccttcagtcaattgctttacctcctgagcctctatgtagttttgattttttcgtctgtaacatagggataatagacttgtttggatcttcctgtggattcaatgagacgatacatgtagcagtaatgtatagcactcagctgatgctacagcaatgaccaacactgatgcttacgtaatacttactatgtgctaaaccctgggtttattcaagtctttcatcctcacaacagtatgctaagggaagctgttactgttactggtgctgttatcatttgcatctactgggtgaggagactgagacacaatggggctgtttcttgctctggacacttagctagtaggtggcggaagagggcctcagaccttagcagcatggctctggctctggagctctcctctttttttttttttttttttttttgagatagggtctcagtcctgtctcacaggctggagtgcaatggtacaatctcagctcactgcaacctccacctcctgggttcaagtgattctcctgcctcagccttctgagtggctgagattacaggcacccaccaccacacctggctactttttgtatctttagtagagatgggatttcaccgtgttggccaggctggtgttgaattcctgaccttaagtgatcctcctgcctcagcctcccaaagtgctgggattataggtgtgagccgcagtgcccaacctggagctctctgctttaacagtaggttctattggctcaccatctggaacagagtaaacctgcacaatgttcactcccacaaatgcagttacaacagaggcaagcaaggcctgcaacccagaatgccagattgtcaggaccagctcagtgcccttcccactttccctcttcccgtggctgaacctgatagaacactcctgtggctgcctgtaaattctgacccttgatatctggctcccactctgcatccctctcccttgcaccctgtgttctgcttcttcccagccctttggttggtgatcttgtcgtgcagcctagatgcaattcatcttctcattctcaggcaggaaatctgcagttcccggagatgatttggctccacctcaaggattagcctgcacacccatacaccccacacaagccagggtccagcatcccagggtccacttttcttggccagaggaagctggaacagaaagggaatgctaaataaaagcatgggaacatgtgggcagacaggatggagacagcatctgaagaccaggaggagggattctagattgatatgacaggagctatggagccactgtaggttcttaagcagagaaacaggcaggataaaaatagtccttggtggtgttcatccaggagccttgactggagtagggagagactagagctactagttgaaataatagctactactattttttgagaattgatttcatggagctttcttacggtcatgcatcttagtctatgtttagcctatgttatttctaattctcacaacctccctgtggggttaccgagattaccccttcctgcagatatgggaaccttgccaagagactctaacttgaaactgacaaaaatgagattgaaattctggcctctgcctaaatacccattctccttcctgccactttgctgctagaaggctgtgccactggggaggctgctgccattgcccatgggtctaggagatgagagcatcagttagagcaacatgggagcaatggagggaaaccagaagcaagatttgccagaaaggaagaaagagccaggatcccgtatctggatgattccagattgtctagcctggaggatggagatgaattggaccagtcaggaaagaaatgttagggaaagacgtctagtcaggcttgagtgtgttgatttatatgctcctagggacatctttatagagatgtccaggagtcaatggacaatgtgggactggctgctagagtacaaatttgaaggaagaacagcatagtggtgggagttttggcttatgttggacatgagtgggttcaaatttctgctatgccacttactcattgtgtgacttgggcaagtgactcaattatctgaatcccaatatcctcatctatcaaatagggataagaacagtctgtgtcacagagttgttctcctgggcatagcaccagacatcaagggacagttcccatcaatggtataattttggaacctcaggaggaaggataaggaactgagggctaagtgtattcactgaggccctgagacagaagccagagatggggaacaggaagagaaagtaaagccaatgaaaagaaagggaaggcatgctcagagaggtaggtgggaccgccagcctaaccaaaacaggggcgatttcacacttgctcatttcatgtcactgtgttttggaaggaaagattctctaaggcaaatataatcacagttaagcctattttagctgtggtaactggagcctggctcttctttaataaaaggagcctggcctctcttatttttacctgctacttatgaccctgtctcacctgcaaaacatataccccaaatctgtgaggtctgattgttaatgacttaattatagactcacaagctatttctgcatttttaatgggcttcccagaatctagtacctgcctggcttatgtaagatcaccttagatctgagtaggcagaagagcagtttaattccaagtcttttgacaggctctgacaaattgttatggaagatagtgaggttaaccttccgtgcacaaaagggctctcctgtctgtggaaggtcatgatgaacttgacacaccaagttatgtctggacagaatcatgacttttccccaccaaatctgctgtttctcatggcccaacaaggatgaaacgaaaaacagtggatgaggggtctgcgtgtgtgtgtttgtgtgcacacatgcgtgttcgccttgtatgtagtttcaaaagtttacacagaaaagctccatgcttcgttcctcacgcagaaatgtctttatctgccatataaatgggattcaacaacttcattttctggcctggccaacgaaaacactcacaaagtaaaaacaccatacttactctttctttctgagttaagaacttgtagcttgcctgattatagatcatggcaagtaattctgacatcagttaacgaacttgatgaagtcaggttgggaagtgacatcaaggggcttagaggaatttattctgacattgggtttgggaactaaagatactgtacctccaggcttcgtcttgaaacatggaagcccacacactaaacagtggtagaatttagatgcctacggccaggcagctggtccttatgaacaaagcaaaagtctcccatggcccaggttcccacggagagttatgagggccacaggctatatacgcttggatccagcttcactgctcccagtctggagttattcctcaaatgcacctgatcacttcgctcctctgcttaataggctctcacttcctgatcagctcacctggccttggggataaattctaaagacagcatatgtctgaaaaggtcctttgtggtttagcctgactgatctctgcagccttctttcaagtctcattcctgctcatctctaagtggcttgacctgcggaattgtcaccttctccaagagccttcccttcctgtcaccctcgcctcttgtccccatcccaagaaaggatctcccctactggtctcactcttggcatcagtgcttttccttcctaggcttcttctcaatttgtaattatgtatttactttcttgttcaggtgtttaatgtccgccttggatgaatataggaacagtctcttccctgcctccctcccttccttgtttctttcccttcttccttcctgtgtgttcaccactctatcctcagcaccctgcccagtgcctggcgcagagtattcagtggatgccttttgaatacatggatgagtggagcgagttacccctctcacaccctacattgaactctccctccttcaataccaaatcacttgtggtttcttgaattggccaagctttcccatcccttcacactggctactcctctgtctggacattgttccttccactgaggttccacctaccctatggtcagcaccattgatgcttcagaaccagccaagattttccttctttgggaacagctctctgaatatcccccagctggctaggtgttctttctccaggctcctgtagacacctgcctggctctctctactcatagtactaaacaaaacagtctgctttcttctgcttgtgcctgtcttaatgctgagctcctgagctgaaggccctcgctcccatgcagcacactaagatcactctggggccagaccaccttggcatgaatcccagtgctgcatttactacctctgctccaggttcctcagctggaaaaggggttcataattgtgtgaacctcatggggatgctgtgaggattcaatgaatcaacacgtgtgtattagtcaaggttctttaaagacacagaactaatgtgatagatgaatatatgaaggggagtttattaggagaattgactcacatcatcacaaggtaaagtcccatcgtaggccatctgcaggctgagaagccaggaagtcagtctgagtcacaaaacctcaaaagtagggaaggtgatggtgcagccttcagtctgtggccgaaggccccagagcttctggcaaatctctggtgtaagtccaacagtccaaaagctgaagaacttggagtgtgatgttcgaggccaggaagcatccaacatgggagaaagatggaggccagagactcagccagtctgctctttccatgcctggttttatgctggcagctgattagttgatgcccacccagactgagggtgggtctgcctctcccagtctactgactcacatgttaatatcctttggcaacaccctcacagaaacaccggggaacaatattttgcatccttcaatccaatcgagttgacaatcaatattagccatcacagcatccaaagtacttgggacagtcagtgtctcacaacaaactggagttattcatagtgattgcattgttaaatccagacctatgataaatgttcagctaatgaacgaggcaaactgaggtgacccagtcctccatccatgcccaacatgaccaaattctatgatttctgtaacctgtatatattcaggattatgggcgaacttacaccatcaccactcttattcctcaggtgctcactgtataggaagcactgactaaacttcctagagaagaaattatttctacaggtccacttaacaaactccaaaagacctggcagtatttaaaagttcattatgaacaatttacccttcttaactggaagtcaatacaagttgcctcaataaagggaaactggtctcttaatcaagttgcttcaattaaatgcaaaaaaatatttttcccttttttgtcattacaagaatttcttaaaaataaaacaaagaagaaaagttatgacagaagctgaaaaggctaaatttaaggctcgtttatcatgcttgttcatcatcgttgcaaacatgcaatttaaaagacgtaattttggctcctaatccagtttcaagaatcaggatggaaatggttccaaaaaaaaaataaaaggagcaatcagtagaaggagccacttgggagaaacagttgtttttgtttttaatttttttaataaaaatataaaatatatcgtcaattgcccaaaagccaacgaccctgctaatacgtctcttactgcattgggtggttacaacttttaaatccactacctatcagaatctcaggaattatttggtaagtaccttgaggaaaacctggagctaattgccccctgtttctacacacatacattcatggggatatttagcgaaaatttttgtggatgatactaagaggtacctgaaatgaccaaaaatcagaaacgaatcacacatttttcagccacatgatactgaaaagttacgtaacttctctgaggttcagttttctcatctgtacaatggacataatactctggccttgtgtggatgccatcatgagacacatttaataaaacaaatgtcatgcttcattcagtgccttgctaatggatgattcttaatcactgatcaattattcttaagtgaagtagccagtaagttgctatcacttctatacatttttcccctctttcctgatctcacacgttctagacaaaaatacttttgcacatttgttactgatgtaaactgcaatttttttctactctgagccaactgtttgaatcctctgtttgttttggccatgatgccatctaaccttcaagacacccgacacgctgcagacatgtgactttactttatttctttaaaacaagagtgtcccccacccacctgtctgagtaccagtccgtggcctgttagaaaccgggctgcactgcaagaagtgagtggcaggtgagcaagcaaagcttcatctgtatttatagccactccccattccccacattactgcctgagcactgcctgctgtcagatcagtagcagcatcagattctcataggagtgtgaaccctattgtaaattgcacatgcaagagatctaggttgcaccctccttatgagaatctaatgcctgatgatctgtcactgtctcccatcaccccgagacaggaccatgtagtcgcaggaaaacaagctgagggctcccatggattctacattatggtgcgttgtatacttatctcattgtatattacaattaactaataatagaaataaagtgcatgataaatgtaatgcacttgaatcatcccaaaaccgccaccatgaacaccctcagtccatggaaaaattgtcttccatgaaacgggtctgtggtgccgaaaaaggctggggactgctgctctaaataattcctgaaaatgagagcaacaagctcgtggtaaattaattaccttgtctctaaaccgtctcacattgactgggagtgacatggaatctgttgacttgggtgattatatcgatcctgcttacatgaaatatgttttacaacaatcccagtggagaatgaatctgcacatttgctgtgaccataaagaaatgatgagttaaagatgtggacacttaatatgccctgatttaacaagtgtgataacttcaaaaaacctgtgaagtaccatgctccatggcaaaagcctccccaggtactgttaaggaaagttagtatccatttaactgtcacctaaagtggagaaaatatatagcttgaaaattattgtacggatccaagaattgggcctagaattcaataataggctgttacatcttgacacatgcctaaattgttatgtttatgtggctcttagctccaggatactattcatatatagataaaaagacatccttcaattcattaatttaaatagataacagattactttaaggatcagaatctaagaaaactatattctggagattaattttaattgaaattcttgggggaaaaactgatcccatagaaagtatagataactaaaaatggcttctttttggcttttgaaaattctaaattttattttatacaggagcatggtccaatagaaatgtaatgaaagccacgtatgtcatttaaagttttcttatagtcatgttaaaaaacgaaaccagtgaaattaactttaataatttatataataactgtatatatgagtgtgtgtgtgtgtgtgtgtgtgtgtgtgtgtgtgtgtatgtataacagatatatctaacatattatcatttcaacaagtaatcaaggccaggcacaatggctcacacctgtaatcccagcactttaagaggccaaggcaggcggatcacttgaggcccggagtttgagaccagcctggccaggatggtgaaaccacatctctactaaaaatacaaaaattagctgggcatggtggtgcatgcctgtaatcccagctactcaggaggctgaggcaggggaactgctaggtcatgccattgcactctagtctgggcaacggagcaagtgtgactctatctcaaaaaaaaaaaaaaatcaatatgaacattattcataagatacctttttacattcttcttttcatattaagtcattgaaatgtagtatatattttatgcttaaggcacatctcaatttagagtatttaatttttaagtacttaataagcacaagcagtgaatagctaaggattagataggatgctctacagttctacaggaatattgcattttttgaaaggatggaaaggatcattcactgagttcctaccacatgttagaacattgcctttggccttagagcccctcacacatccatctgtttttctcctatagctagcctgttcctatattccagatgcagaagtagctcaggctcagaaaagttaagtaacttaaccagtgccatcatccatcagtaagtggcaggactggaagttgagctgggccttctgattttgtggagtcattgctattttgctaatactgacatttatggcagaactattgtgcttttctatttttcagtaaatttcctgaaatagcataggaaattaaaaagttgttagtaataaaaaataaatccagagctgagcaaaactcctaaagaaattttaggaaggtgggcaagccctgtattgtcatgacacattttaaaaacttttcctgtgaatagaacctttacaaaaagaaccttgtggaaacagcacgaggtgtctaaatgtaaatttctcccaggccagggacctgatctcattcatcttcatagtcccataggctagagaaaacgtcttgcgtttatatttttaaaactataatttacaactttgtttatatatgcattacccgatttaagctcacaacaatgcctggatgcagatggtgtgtttttcgttttctgagtgaggacagtgagactcagaggtgggtcttaggtcgcggtcgtggagttggttgagtggcagccagtgcggccatccacaggctttcccaagtgcatcgctgcagccatagttagctccccagcagctgctcggggctttcacatagatggaatatagtgttgtcagaggtaaatttccagctagtatataggatagaacaagataatgtaataaaatgtacattttctaggctctctgatatgcttctaccctcctatctcttgttattaccataaatcaaatactagtcaattctaaatgtaaatatagggatgataacctctttttacaattcctctcttatctgcaactcccagagagattcacatggagatacttggtcactgccggctttgcggtcggcatgactcctattagagattaaatgacatagagtaatctcaaagtagttagcaataaaaattaatacaaaactatgcaaaactcccagagaaattttaggcaagtagacaagtcctgtgtcatcatgacccattaataaaactttcctcgtgaacagaacctttggaagtagaatctcatggaaatagcatgagatttccaaatgtaaatgtctgccaagtctctctgtaagagatgggttggctgggggcgatggctcaaacctgtaatcctagcactttgggagactgaggcaggtggatcacgatatcaggagttcaagaccagcctggccaagatggtgaaaccctatctctactaaaaatacaaaaattatccaggcgtggtggcaggtgcctgtaatcccagctacttgggaggctgaggcaggagaatcgctcgaactcaggaggcagaggtcacagtgatccaagatcacgccactgcagtgtagtctgggcgacagatcaagattcctttaaaaaaaaaaaaaaaaaaaaaaaaagatgggtctgcatttctcaagggaaaaaaacatctccaatgatgagaaaatacagtgtttgataaagaccatggattttctctatttgattctctgttctcaacacccaaaacttaggcagtaaagaaacaggggaagaggtaccatttattcagtctttttccacccagcacatgggatgatcaaattacatggtctcatccaaagttttcaggcagaagcctgaatgtttgtagaaaaattagcctatttggccctagccaaatacatcctccagtctacccatgttgggcagatgcctgtggacttttggaccctttggcctgggagtgatgtgtgatagttgccagggtggcatctgctgttgggccagactgttggtgctgtttgattctcagcccaattgcttgtttaagcaaagccaagtctagtctcaaggcctaatctcatcatagttgatgttgtctttttttgatggcttctaataaataaatagaaacctcttttcctctggtccataccccttagaagtgccacatttaaaaaataagaggaaagccttcatctcactggggcccatagcagtggcagatattgttatttgctgaattgcttctatctttcttaattaggtaggaagtagcaaccatcaaaaaacaaatattgtatgtaggcggccatcaaaacataagacaactgtttttcttccagcagaaaaccaatttggcaaacacttatttttctttctctatcacacaaagaaagtcaattctctaagaaaaaggatagaaaaagaaaagaaaagaaaacttttaaataatatcccatatatgttttgagaattttatacatcaatacattaaaacataggcaggaaaatttcaaatgcaaacaaaaatcacatcttatagctcttagcaattccttgtcttcaaagactggaggaaatagcccactgggaaggcctttaacagagcaggtgcttccctaggggaaggagtaactacagatatttgagggctactcagaggcaaaagggctcaaaaaacttcagactgtcttccaagcaacagccccagaatgcctcctagatagtgaggctgccttcagttggcctgagattgttgctctgaccctggtgccacccttcctctccaaccttgttacaaacaattcagaagggaggattgtgaaatccttcctgctgctctttctgtcttctgccaatcagagaagactggacatgagatccaagagagggctttccctttccccgatggctacactgtgtctcctgcctcccagctgtttatggaaatcagatggtttcctcaactgtctatctttctgcagcaaatcctttgacagagaatgtgcactgtcaaccaaccccttcatcgagtcaggcaaattaggattcctttgacagcaactttttacaacttccttcctttgaagatataaagctttaaacagtagtagttctccgtgagacccaaggaaaggtctgcagactataagcagactttatctgaagaccacctcctgcccctcactcttactccagaggcctgtgtatttatttatttatttatttttttggtaaaggcctctgctgtgaatttaagtcatctaatcaaaatgcattatttctgtccttgcattgtccattctcgtaaaccgtggttaacacagataattgagacttgagtgcttttttattccaagtcccttattcgatttggcccttgttaacaaagcctagtctgtaagagcgtgaccaccagtcttatttaccttgttatctgtaatttcctctttccctcaggcctttgcgtaatattttctctgcatggaaggggaggataagaaagaagacctaaaaactgaatttttaaaatacaaacagaaaaaaagctccctgtattttcccaaattctgcataaataaaataatatgctccataatggcagagatttgactgacttgttcgttgctataaatctagcacttacaatatctggctgtgaataaataatttcttaatgacttagcaaatgctggagacagaatgaatattgatattaataatgcagatcgtagtcaatttatttagctcaaacgttgtgcggggcaccactttaagtgcatttcttacattaagtcatataatctttataataactctataatataggtcctattttatcttcattttacaggtgaataaaggaagacggggagactatgtgtgaccagcacagggtcatacatctagaatattttggagacatatttttgcactcagactcctcaaaaaaacatttaacaaaatatgttatcttttttgtcacaatagaaaaatatgaactgaatattattacagtaaagtagattcaggttggttgaatagctgtatccaaaagggttaaaatataatctgtgtcgtcctggagaatgatttccgcatgcagaaatctaattgaatttaattgctttcatctcagtgatggagaccaagatatgaacacaagttggttactttgaaactttcataactcaggtattcccattgtacaatagccttgagttttgaaaagaactcaagcatgtataaggattgactgaaattaataaattgatactcagcaggtataaatatgaagcccaatagatgggcaaaagaatttctgaaacacaggatgggggtgatacgaaaatgacttggttgatgaggtattcacgctcctggacctgtgccaactccctctctgcaggttcctgcccttattgctaccctgtaattattcatctttaatttattgctcttcaccttgagcaccactctaaggcttttccatttacctaaagcagtaagttgtactctagtgcctacagttttctgtagctggccttgcgggttcctctgctgagaaaagttcataccatccatttcagttcccttttccatctctgagtacccctaactcctttcctccctctcagagaaagaccgattcttcctccttttcatgacatatcccttcacttgtacccttgaactcactcttttctgcctctttcttcatttcgcatttcccctcacactcttacatcttaaattttccctcctctgtgaatcctcccccagcctccaaacgtggtcaaatcttcccaggcgaaaccaaattatttctccttcaaatcgctgcctcccttccccagtcttgttgaaagccatcttcactcaacatctctatttccttgcaagttcataccttaatactccgaaatggagctcctgtcctcaacattttggtgaaaattctctcttttgaaggtcgtggaaactgaacagctgatttccctcaactgtttcttagtcctgaggctgcttgaagtctctgaagcaattaatttttaattttaattttattgaggtaaaatttacataacataaaattaagcaagcgatacttaattactttctaatgttgtgcaaccactacctttatctagttccaaaatggttctgttaacccaaaaggaaactgtatacctgttaagcatgttctcccttccccagctcctggctttatgtatcacctatttttatatataatataaatgaaatcatacaatacttgggcatttatgactggcctctttttttttttttttttttttgagacagagtctcactctgtcgcccaggttggggttggagtgcagtggtgcgatctctattcactgcaagctccacctcctgggttcaggccattctcctgcctcatcctcccgagtagctgggactacaggtgcccaccaccacacccagctaattttttgtattttttagtagagaccgggtttcaccgtgttagccaggatggtgtcaatctcctgacctcgtgatccgcctgcctcagcctcccagagtgctgggattacaggcgtgaatgactggcctcttttactttgcataatgttgcaaggttcatccacattatagcatgtatcactacttcattcctttttagggataagcaatattcctttatgtggatggaccacaaattgtttacccattcatctgttgatggccatttgggcttttttgactgttatgaacaacactgctaccaacctgtgtgcaaatgtatttgagtactaattttttatttgtaaatacagtgacaataatgccacaaaaacattgcatacttacaagatttatgagttacataatttacaatgattgagtgtgggcagctctattatctggatttcattaagatgatgctacaaaaatagtaattgttagtaataataatgctacaaaaacgttgtatacttgcaagatttacaaattacataatttatgatgattgaatgggggtggctctcttatctggatttcattaagatactcaggattctttacaaacatgctaggtttccacttagagcaagatctcttaaaaaaaaccctgcttattgaccacagcagccagacccgggcctccttctgcctactgtcgccataactctagttataacttgcttttgggtttatacctaggagtggaattgctggctcaaatgataattctatgttcaactctttgagaaaccacccaactgtcccctaggagtggaattgctggctcatatgataattctatattcaactctttgagaagtcacccaactgtcttctacagcagctgaaccactttaattcccagcagagcattggcagtccttgaaatgctcttccgtttgctgtttaagacaccatactgtccttgttctcccactctttctgtatagaaacccatatattttcttcctctagttcttcttcttattcctcctgccattggaagtgcctgtccatttcctgtcttgattttcctttgctgttttctaccatcctcaacaattttatccaacctagcagctttaaagatctcttcttcagcatgtctccaaatttatagcttcatttctgacctcaggtccatcgtgtctacagcgcatctccacccgtacatttcacttgcctctcggggttaactgtgtgtttctgaacgctcatactggggttaactgtgtgagtctgaacacctgtacctcattacctcattacttccttacctcatcttcctaagtgcacggtttcttgcagtgccatcctcgtcttcccatgcacctgaacccaccaccttgtatttgtctttagttcctcaccacctgggaggtcagtggtacttcttatcctttctctctctcccatgtggtttctacctgcaaactcttcattacagtggtcacaactggtttgaacatcatttcctcttatccagccaagacagggccactttcttttaagtttatctttctcccttttcctgtgatccaatctgcgtgcctgttactatctaattgacttcccaaagaataactgtgatcatatcatgccctcttcaaaggctgtcagtcttcccatgcttactgagccacaacgaaatgagtcccaacctgctttgtcactttcagccctcacaattccctgtcattcatgtgattctcctaccaaagtaagctgcttatcttctatgttcactgaaaatggtatgtttccttccacatctatctctaagggatggcataagtgggttgcaataggtttacaggaatgaggatcagattaagagctgtggcatcagtaaaaccaataactcttgatttattatgtaacaatgtatatttttagccaaacaaatgctagataccaataggtaaacctggtactaggaatttcttttcatttttgctttctttgagatctgtaattaatcatggtgaaaataatgctacagaaacatcatatacttacaagatttgcaaattccataatttacaatgattgcatgtgggtggctctgttatctggatttcattaagacactccggattcttcacaaacatgccaagttcccacttagagcaagatctcttaagtaaacctctgcttatggaccacagcagccagatctgaacctcctgctaccatccctgtaactctagttatgacttgtattatccatcacattatttgttgtcttatgaaggatgaagtgttcaaatccctgtaggaaacagaccgaaaactttgagtctgttacccctaagagacacagccctcttttctgaggcgtctttctttccttgatttatttggactatggtttctttggccaaccatttaattttttttttgttgttaactttgtccttgttaacattaattctctcatgtcatgtggaaatgagaataattcagatattgtaagagaaggaaaatggttagataaattagaagcatgaataattgatagagaaataattcaagcagctaactatatcatgcattctctgcttacttcatgaatgatccgtatgccatgtccatacgacttaatatttatttttagaaacctttaccaaaatgagcaagaagtagtaaatgcctcattatcctttcagagcacctaatgatacattattttctgttataaaacttcaaggtttttgaatgcattgttataaatccagactgtcaacatttctttggcaagaagcagcacaccatcctatagaaataagatgtaagattaacaattcaggttcatatattttcatctgtccctgaattccaccatacatggcagaaaaccacaatcatgttttcatagcaaatatgttatgacaaactatacaacatttaagaacatttagaaaagccaaaatggaactttcagaaataaaaccttggctgttgtggtggctcacgcctgtaatcccaacagtttgggaggccaaggcgggcagatcacctggggtcacgagttgaagaccagccaggccaacatggcgaaaccctgtctctactaaaaatacaaaaattagccaggcatggtggtgcgcgcctttaatcccagctactcgggaggctgaggcagaattgcttgaacccagaagacagagactgcagtgagccaagatcgcaccattgcactccagcctgggtgacagggcgagactttatctcaaaaaaaaaaaaaaaaaaaaaaaaaaaagaaagaaattaaaccttaaatagcaaaatagaaaagacagatcatcagcaatgattaataaaaaagctattttataaagcggtgattgggaaagtaaaataggttgtacagattgggccaaagcctaaagatattctggtgattctttccacgatagaagaccgtgaaagaggcaatgcagtgagaccataagccttgtggtttgggacacattcttttcgaaggcctaactttttctgttggtgaaatgggaataaaaatagtacgaatttccaggagttaaattagagttgaatgagataattcatgtgaggctcttagaaagatgcctggaacatagtaagaattaaataatatcatctaataaagtgagaatgaccacagaatatgtctttatatggtattcattgttaaaatgcctagggatggagagttctggctttagctgtaacttaatataggagttaaaaaggtatcataaccttaatattaggtctcgggaggtgtcactaggactctgttatcctttcttcccttctttcttttttggctttctatatgtcttcattttcagacaacctctctcctggggtatcagaagacacactcacattaggataatgcagataagatcaattcacagtaagaagatttatcaaggtaaagtgaagtataggagaagcacatgagaacccaggagcataaattgataaacacaccaattgaaaacagattggctgaattttaaagcaatagatatatgtttcttaaattagatagaccttgaatggaagggtacagaaaaatagaaaatgaaaaaaagtaagaaaatatatcctgtaaatattaaccaagagaaagttgatagagctatgctattatcagaggaaatagactttaaggagagaagtatcgctacagataaagaacgctatatcatatttatagaactatacagcaggcagatataataattccaaattaggatgcatccagtaacatatacagcagccccccttatctatgggaaacacatttcgagaccccgaccgggtacctgaaacctctgatagtagcaaagtctgtgtatgtatatagtcacgtgtgacataacaacgttttggtcaatgacggaccacatatgtgatggtgatctcataaaattataataccatatttttactgtactttttgtgtttagatatgtttaaatacacaaataccattgtgttacaactgcatacagtattcagcacagtaacatactgtacgggtttatagcctaggaacaataggctataccgtatttcctaggtgtgtagtaagctataccatctaggtttatataagtgcactgtgtattgtttgcacaatgccagaatcaactaacaatgcatttctcagaacatatccttgttaagtaacgcatgactatagtatgcttttcctatacatatgcaaatatgacaaagtttaatttataaattggacacaatcagagattaaaaacaataacgaatagtaaaatagaacaattacagtaatatgccagcatcactaatcttgaactttggggccattaagtaaaataaagcttacttgcatacaagcactgatatctcagcagttgacataactacacagctactgagtaactaatgggatagtatgtacagtgtggatacaccggacaaagccatgattcatgtccagaacaggacagcaggatatttagtcacactactcagaatggctcagaatttaaaacttacaaattatttctttctgaagttttccatgtaatattttcagactgcaattgactataggtaactaaaactacagaaagcaaaactacagataagagggtgactggtgtataaaataaaactaatatatataatagaagtagtcaaaatagaaaaacccatcatcatagctgaaaactttaacacatttctacatagctgatataacaagtagtctaaatataaaaaagagtaataaaaatttcactaaaatctgtaatatagattttactaaacaaaatttggttctaacaaaatttacaaaaactaagggtatgcattctgcagtgttcacgtggaatacttatcaatatattgtaggctggtcatagagtacatccaaacaagtttcaaaagatagaaatcatacagattgtatattctgaccattttaaatttaaaacagaaattaataacaaaaaaactaaaggatccccacatatttagaaactatgcaatatatgttgaaatattccatgggtaaaataagaaataatagtaagaagtagaaaatagtttgaatggaatataatggaaatacaacataacaaaacttgagaatccagataaagtagaggaaagatttacaaccttgaatgcatatataaatcagagaacaccaaatttaactctaataaaatggagggaaggaaataacaaaaatacaatttataacatagaaagtagacatgcaagaggataagtcaataaagtttgttctttgaaagttctgtaacttgatatcaatagtccctagtaagggtaattaagaaaaaaaaaagaaaagacactatggctaattaaacaaatggagacagcactagagatctttcaagaataagaaaaaagaagaaggcattgttaatacatttataaaaattaatttgaaaattaaaactggcaaattctgtaaaataaataaaaaatcagtgtaccaaagcataccaaaaaaaaagaaatataaaatctggtaagttctacatttattaaatgaaaactctgtagcctaagataattccaagtccagatggcttcatggtaaattccaccaaacttttaaagaagaaaatacactaatcttatgcaaactcttctgtaaaatagaaaaaaaatgaaacgctttccagcttctttctgaaggccaacataatcttctttgcaataactgacataaacattgaaagaaggaaaaattataagccagtctctctaatgaatgtatatgagaaggtagataaatttgacttcaataaaagtaaaaacctgtgctcatcaaaatacatcattgagaaagtgaaaaggcaggctatacagtggaaaaaaaatctttgtaatatatgggtctattacaggacatttatctaggacatgttaacaactcctacaaaaatataacaaaagggcagagaacccaactaacaatggaggaaatatttaacaggcttttaacaaaagaggatatctacatgaccactaaacatattaaaaggtttttagcatcactagtcatcaaggaaatgcaaaggaaaactacacggaaattattcagatactattatacacacatgtgaaaattaattagaatttaaaaagtaagtataataacaatagcaaggacgtgtggcaatcagaattctcacacactgtaaagctgaacattcttgacctagaaatcctacttccagatctataactaaaacaaatgtatacacatgtacactaaaggctcttacaagaaagtccagaataacactttgtaatagctaaaaactggaaacaactcaaaagtccatcaagggacaaatggataaattttggcacatatatcatatgtatataccaaatacatagcaaaaaaaaaagcaactgttattatgctcaaaaatatggataaacttaataggcataacattgcatgaaagaagccagatagggaagggaatatcctatggaaatgaagttcaacagcaggcagaactaactaatctctgttgagctatagatggtgatgtgaactaatctatattgagccaggatggtggtgatatggtttggccgtgtcaccatccaagtctcatcttgaagtgcagctcccataatccccacatgtcacgggagggatccagtggcaggtaattgaatcacgggggtgggtttttcccatgctgttctcgtgatagtgaataagtctcacgagatttgatggttttatagaagagagttccctacacacgctctcttgcctgctgccgtgtaggatgtgcctttgctcatccttcaccttctgccatgattgtgagtcctccccggctatgtggaactgtgagtccattaaaccttttttactcttttttgtttgtttgtttgttttttgagatggagtctcactctgtcgccagtctggagtgcagtggtgcattctcagctcactgcaacctctgactccctggttcaagtgattctcctgcctcagcctcctaagtagctgggattacaggcacgtgccaccacacccagctaatttttatatttttaggagaaatggggtttcaccatgttggccaggatggtcttgatctcctgacctcgtgatccacctgcctgggcctcccaaagtactggcattacaggtgtaagccactgcaccccagtctcaggtatgtctttattagcaacctgagaacagactaatacttgtggttacctttgaaaaggtgatgactggaaggggcctgagggaggtttctgagatcatgacagagttgtatgtcttcatctttatggtggtgacataggtgtgttcactcaaaaaaaattcaccaaactgtacacttacacttttgcagtttaatatatgaatgatacatgttatgctttaattagaaagttaaaagtaagtttttttcaaaagtagtaattggatgactcccgcttttattgagttagcaagtatcttttactgccactttctattgttaaaaaaaaaaaaaggctcaccactgaggctgtaaggctaaatccttagcatgacacacaaaaccatctataaaccagtttctagcctttcttcctggccattccctttgacctgagctgtcttgaatattcttaagacttgacaatactaattttaaaccgtctaagataagatcacctcccactccagaaaaggggtgagggtagatgttaagaccagagtgtgcttccagcacacttgtattttttatggtactaagaaagaaaaatgctgacgcttaaacctgcacacagtaattccttaacatcaatggtaaggttcctccctaattttgaaggcattaaaatggggtcggggaaatgtcttacaaatgatattttttaaaaaaataaaataaaacaaagataatcatgtcttggattatcatgactcacagcaactttactttcaaaagtaagaatatttacttctaaaactatgaaatcttcactatattcttaaaaatataaatcgttaaatgtcattctttagctctaaatacaaagttagtttgttgaacttcatgagttacgtcttttatcgggcttggggtgtgaccttagcccctctcctttgtgaggggagatggcagaactctcagaagctttttctattctcatctttgttggttactggggaaaaactggatttcgctgcactcatcaaataaagaggcccaggtagcagcgcctccacgttttgttcaagtggggttttctgcgtgtgccgctggccaattcttcaagaaaagtgtttgttcttctctggcggtttggtgttcctatgtttcaacatgggggtaccaaataattcatttccccttttcccaacagatgcattcttgtgacctcactgatgacaggggcgtcgtttattctaacaaatgctcttgtccaaattccaaccatgttgccaagagatggcatagctggtgagggctggactttaggggccaatctccactcctgagctcccctgaccacacaggaagaaaacattaatgatgttcccatactgatgttgtggtgtaagtgtctcctgtgtaaatagaactaaatatttaggaaagaaaacagaagagtcttatgtagtgcattacaaactagaaagcttttgaagtcagcatctgggatggtcttaaaaacaaacgtgcagtctgagagaaagaattactgctgacacacgctgacctcacagaaactatctggtgatgagattatctctcttccaggactctaacaaggctttgcaaggatattttcttgctttgctttgctttttttaatcttcttaactggtggaacctcttgttatgtgcaaatctaatccattctcattcaaagatggatgtcccggttttactgtatctgccttagttggagattcccgggaagaaaagcccaggacaagtggtcaggtgcaggaacttgatctgagaggtggtcccaggaagcagaagtgagttcatggggacattgagaagaggaaggaggccaatcaaaaaagagcatttctgaggttgcttctgtacacaggggcttcatttcttcaattctcccagatcctctgggaaccctatgaaatgcttttcagaattctcagagtcatccacctgaaaaatagagggactggagccttttttcctagtctccctactgtccatggattgagagttgcctgggagcagggagagcgggtgttaactgccttctgtttagaacaagttcctgtatgtgtcagagatctggggcaggatgatttgcagtcatgtaagcttaggttgaactctgggagagccaggtgagtgtgtgctcaaaaagaactgtccagtgcagctgctgctgaaatcagaggtgactgcaaggatgtaacactggcgctcgggtgtctgccatggcctaggtttcttatgagagattgaactcttcggagattccatcattcagagcaggcacaagacggtttggccaccaatctgggtagagccaggctgttgcatgacaagtcagtcaggagaaaactgaggctagcaggctgactttctggttccatgacacacatcacatctgcaatagagcttaaagacagggtgcttatccctcaaacctccctgtatcactaactttcttaatccagacttttgcctttgtttttttttttgtttgttttttttttttttttttttagaaggagtctcgctctgtcacccaggctggagtgcagtggcaggatcttggctcactgcaaactccacctcctggttctcgccattctcctgcctcagcctcccgagtagctgggactacaggtgcccgccagcacacccagctaatatttttgtatttagagtagagacggggtttcaccgtgttagccagggtggtcttgatctcctgaccttgtgatccgcaagcctcggcctcccaaattgctgggattacaaacgtgagccaccgcacccggcctacttttacgtctcataacccaaaagctctatggcttcaaaaattcccaactcctcaaaaagctgattttctgttttatcagtgcccctttgattgataaacaatatattaatataagatggatataaagcagatgtattttgttgccacaacttctttggttcaaattaaagaatataggtcatttgtcccagagagtcagtccagctgaaaaattgtggatgttgataaatgcgtaggtctccattcttaaaaatccagcatttttgtataggaacaaaactttacttggattataaattgcaggccttctttgaaaagacaaagtgtgaaagggaagagaactgtagagtcttcctgatgtttactgagcccttactccaaaccaggacttaggcttgttgcatcccctccattaactcatgtcatattgcctaattcataaagaggcccagagaggcagtcgaggtgtagaaaggttaagtaacattcccactgcctcataacttgtaagtaatgaaactctccggaaaagttgagctcagatctgaatccagagcctgcatgcctaaccgcagtgcaatgctatcctcacctcactgtgcaaatacatctcagatctctgcattaggatgcacaggtttacattttttaaaagcaggtaataactgtcttattctgtacctattgtctgttttcacagtctgctgtgaacccttgctttcagctgggacactgttgccttccactgccttccacagcctctttacttccccttaaacaacctattccaactggtactacttgataatagtcattttctctcacctgaaagcatgcctctgtcaaccaggctcttcccctcaatggctaatgactctcactcctacactcctgcagagggcctggcacatagtgggtgcttaatacaagttccttggcacaaagaatataggaataaatacggggactaaggtattgcgctctccattttacaaaggagaaatctagccttggtctctctgataccacagtctttcccaaagttgcacagcacagtggaggagagttggacctagggcccaggtttccaggatcctggtctagtgtaatgtcagtttctaattatgtggtccacacacatgaatatttaaatcagcatctcctggagataactcaagaggtgactctaatggtagacaattgaggctgtacatcagggttgcaaaggggctttgtccggatgagtggattttttgtgtcccttacaccatgtgaattcccagcatcatggtttatgctaatcctctttccaaaatagtttcctggtgaccttctccctgtgccaaccccggaatacaatgggatgagtaactggcaggtccagatacagaaaatgagtgagcaatgcctttcccagctaaaaattcttccagctcacccatggtgtgctagggaagatgttctcctatgtcctgaatgaccagcagcagaggattcagggcacccaatgcaaaattgtcaccaaatgactgtgacactgaagtggctcatgctgctctttgcactgcattaagtgaaaccagacgcctccagttaaactccagtgagctaaaaagtatagtgataaatatatgaaatgagtagaaagaacaaaaataaagaagcctcaccccagatacggcacttatgaagaatctgtgtctcagtctcccagcaaaattgaaacgtaattcaacttcagatggtcaatgcctgccttaatgccccatgctaatgtcagccctgagatgtcacaatagtccaggagatgcttacctgaaggagaggccctctagagaggctgtgagaactgtgatttggagctcgaaactgagatagtgagctgggcagggtgacaatttatggagaatgggaaaaggaagagggaagtattttagcaaaacggatgctatcaggatggctgaggctttagaaccagatggagtgctgtggcctctcttggatggatgctgtttctgagctttgcatctggaaagacagagcctgctctaggaataatgatgtcaaagatctttctcattttactgtctggttaaatatcacctcttcagagaagccttcccttatcaacttacttaaattgagtaccccctgtcagttttctatcacagtacctcacttgtgtgtgttttccattcatagcatttgttacactttcacatttttaaaagcgttgtttctttttttgttttttgtccatctccagttcctatcagtgccctaccatgtccttaacatttagcttagtgcctgacacgtagtgcttcagtaagaagtatcaatgtggtaagtgaatttctaatcgaatagcagttacatcataaatagtcaatgattcttgtgatgtctcatggtcccagggatcatgagatacagagtgacagaggatggaagttcagttttcttctctatgtaacaggaagcaaggaagtgatcgtcagaataactgcaagatgaccctgctggctgctgtgtgacaggggattagaacagtcataaaagcaggtagagaggtgtttcagttagctatggctgtgtaacaaactactccaaacttagagacttgaaataatcattctatgtggtcatgtttctgtgggtcaagaattccagcaggattcagctggttgtcaactgggtctttcacatagcttttttcacctggtaacttagctaggctggaaaatccaagaaagcttcactcatacacctggcaccttggtgattctttgcatgcaccttggtgattctatgtgctgttttgtctccctcatagctaatcagatgtcttatgtggtggttggcattttttttttttttttttgagtcagagtattgctctattacccaggctggagttcagggtgcgatctcggctcactgcaacctctgacttccaggttcaagtgagtctcctgcatcagcctccctaatagctgagactacaggcacgtgccagcacgtctggctaatttttgtatttttagtagagacagggtttcaccatgttggccaggctggccttgaactcttgaactcaggtgatccacccacctcagcctcccaaagtgctggaattacaggtgtgagctatcacgcccagcctggtggttggcttttaaagggagcaggtcaaccatatgaaaacagaagctatggctctcttgaggcccagccccagaagttacacaccatcagttcccctgtgttctgttcgtcaaagcagcccaagattatctcaaaatcaagaggaagggaaatagattcagctcttcatgaagattggcaaggaatgtgcagccattttcaaaccaccccgcagagagaatggttaggacattgttatgataaacccagcctaaggttatagcaatagagatggacagagatgatttagctgaagatatagctgtagttagcatgaccagacttgccaatggttgtaatagggtgtctggattagggagatgttgtttatctctactagtttcctgttaattactctatgaacaaattagcacaaactttgtggcttaaaacaacacaaatttattctgttttagttttggaggccaaaagttcaaaatgagtttcacaaggccaaaatcaaggtgtcagcagaactggttccttctggaggctccaaggagcatttgttccttgtctcttcagtctctggaggcagtcgtgaccccttcttacaacttcaaaggcaattgtgtaacatttttgcagggagagtcctgggaacagtgagacaagttggggagaggcaagtggaagggacagaatcaagattgaagcaggctaagtatgaaaaatttgtaagatgtccaagcggagatgccagaaaaagtcagatgagtgtatgagtctcacatttcagagctaaaaatatacactctggatttatcaatataaagttagatgagggccaggtgcggtggctcatgcctgtaatcccagcactttgggaggccgaggtgggcagaccatgaggtcaggagctcaagaacagtctggcccacatgatgaaaccccatctgtatcaaaaatacaaaaattagctgggtgtggtggcatgcacctgtgatcccagctattcaagaggctgagataggaaaatcgcttgaacccgggaggtggaggtcgcagtgagctgagatggtgccattgcactccagcctgggtgacaaagtgagactgtctcaaaaaaaagaaagttatatgagtattgttgaagtcatttaggaacagattttttagcaacatcatccagtagaaatgtaatgtgagccagaaatgtaaatgtaaatgttctgctagccatatttaaaaagtaaaaagaaaaaggaaaattaatattagcaatatcttctttaacctgattattatataatgatcattccatcatttaagcaacataaaaagcaatgagatattttagataactttttccatactaagttttagaaatccagtatgttagctcactttccaattcagactagccaatttctttttgatggagaaaatgtatttaattaaaagaattattcttactattatttttgattggcaagtcataattgtatgcatttatgaggtacaatattatgttttgatacatgtataaaatggtataattaaatcaagctaattaacatgtccatcacctcagttacctatcctttttttgctgagacatttgaaattgactctcttagttattttgaaatatataatacattattattgactgtagtcatcatgctgtgcaatagtctcaaaacctctttctcttgtctatctgaaactttgcactcttagctaaaaaaaatctccccagtccctcccctgcacccccagccccaggtaatcaccatcctactgcttctaggagtttagctttatttgatttcccatacaagtgagatcatgtggtatttgtcttctgtgccttagccatatttgtattatccactggccacctttgtctcctggtgatatactggacagcacagctttagaaagaagagattctagaagttatccctgaggaatcccagcatttaatggtcggatatagaaaaagcttgaaggtagaagaaaaaccaggacagtgtagtattgcacaggtaggaaaagccttaagaagtgagttgatcagctatgttgaatgctggtacaaagatgggtaagatgggatggagaagtttctacaaaactgctgctaattcaaagaaacagatatagaccacttccaggctgggcgtggtggctcgtgcctgtaatcccaacactttggaaggccaaggtggacagatcacttgagatcaggagttcaaaaccagcctggccaacatgctgaaaccccgtctctactaaaaatatgaaaattagccaggtgtggtggtgcacgcctgtaattccagctagtcgggaggctaaggcaagagaatcagttaagcccagggggcagaggttgcagtgagccaagatcgtgccactgcattctagcctgggtgacagaacgagatttgtctcaaaaaaaaacaaaaaaacaaaaaaacaaaaaaaaaaaaacaagactacttttaggttctcgctctttggatgtgttgctgtttcctgcactctcttcctactgtctttgggtggtagatggaagggtgccacaggacacacagctggggaaacttcctcttgcaaagcctctactaaaccatgccacaccactgtataataactggaaaatggctttgggacttaaaagcaacttcatccaagaagaattgcagtttggatgcagtccaggtataaaacaaccaccttcactcctgtgtgttactgtaaagcttgccttctgtaaaatgtcttaagcataagagctgtaaaggaaaatactcatggattatattgtgatttgaaatcaggatgtaatacgatagtgacagcttaaagattcttctaaaactagatatgaaatttgaatgtggcacctgtctataatttgtaaagcactttggctttttctcagctacatggtgatgatgagttcttctcaacaagtgactaagctctaggggaatcagtttctcaatttgcatgagatacgggagcttcctaagacatgagactttcagttttaaaaccaggatagtcttgagagagctgcccttgtttttcggagacatgcaggcttcccaagatgtgagactttcagtgctaatcccaggaaaagtcctaaacaaaaggcaacgagttggttgcccaaccaagctgggaggccttctgaccgaggacctcctgaagtcatcaacccaaagagaagaactgcctcttagggctgactgatgcttacaaaagggattataaagcctgaataccaatttcttaatttgcaaagagaaatgatgtgacaaggaccaggaaactcaaagtccatatggtcagcattttctgtctctgtataaagccaatctattaatttaaagaacagaatgattatcacatgcattgaaatacacaaagtccaaacgatcagcaaattctcgcccggtgtgaagtcagtcttttaatttacaaagaaaaattactgtcacagagactggaatgctcaaagtccacatggtcagcacattttctgcttctactctacccttcatggaagaccaattcataatcagaaggctgcttagtgagcatgaagtgttggttagagtgagtgcttaaaggcactggactaagaaagcctaactttaccaaggggttcagactgtctttgtcaccaaatgctgaagtctttgcttcagcaatttttcctgcctctaggatgagtactgcaaagttgcctccaggaggcatcttattttccaagctgccatggatgactgaccgttttaagcgtccttcattcttcagatgtgctaataccatcaattaggtagtagagtttcacttccctaggagccattttgtctttgctacatttatctttgctcttattccaaagagcagccttcattctcttcctatcaaatctttcagcagcagaaggcaactgactgtatctctgagtaatgttgataagtattgtgttgtggaggctctgcatagtacagtggttaacggcacgggctgagaactgaggaatacctactgtctacttgtctactaccatgcagaactatagtaagtcactatatccctttgagccatagtttccagttctataaaatgggaaccatccatagttggttgtatcaaggactcaatgacagcaaacaagtaaaagaacccatatagtgtttgagacatgattgtgctcaagaaatgataggaaacaaacgtacaaacgacaagcattttttgctgcagtttggaagtattaatgttttacaacctccacaaactaaggttcatgatcgaagaacctcactgaatatttaactttagggataaaatgcacaacctataataattttagtgcaattgatttattatagtcaagggaaacatgactgaataacaaaagtaggttaggaaaatactgaaacagaataggatgaagaaaagcattttaatgaaaaaggaaaagcagagagcagagtagtaatctctcttggttcctctccttccgtcagcctgctgttcctgcccctctcttcttctctctggcctctagataccggaatgtctcaggcctcccatcccctctatcctccatttcgccacctgctctggccaaaaagtttgaaggaggacctatgaaaaatatccctggcctgggcttaagaagccttcaccctcattctcaactctgaggctaccagagcatgatcagttcatcatctcagtcaatcctcccagctcctctattagatccatatgactgccactttgtgaaagatacaaggaggacttggcaaaacaagggccccacctgaaatggatagctgagagcattaccacagtcggatctgctgggttgaattgtacacagcagatgccaacttccaatgaaattagaatcatatttctatacattttcttaagtgccagacatcattctaatcattttataggcattatctcacttagtgtctaaaaaaccctaaggttttgccatataactttcatccccactttattatctatctagaataactgaggcttatggaggaaaactgactgactcattgctgcttggctattaagtggaacttcccaagactctgtaactttggagactagtcacatatgaaatatgctaccctctcacttgtgtgatgacgttcagggtttggcgaatgttgagcaagccaataaggtaaggctgtatgcggtacaattctcacactcgttgctctttttgttgtaaccagcctctttaaacactatggcctgaccctctgaaccagccacctgaccattcttctgacttcccaataagcctttgccatcaccaaacatactggcctccatggtcttcatctttaatgccattaattaaaaaaatatgccccacagctctgcaagaagaattcagcaggcagttggcataaaaaggttgggaatggtttacatctttgagcttcagtattttaagtctgcaagttcatggagtgcaagggctgtggacaccctgcttgccaatttttctgccttaaccgttccctgcccccttgttgttcaatttctggccaatgtctaaattttccaaaaggaagtatggtcttttgcattatgacacatgattgccacccactggttaagaatgttttcactatgaaggtttagaaggtttgctgttgaggcaaaagttacccatttcccatgcccccagttcagttgtctggatatcccagaacaagaagcattaactgcttcaatttaagtcagattctcaaaatcccaaaggcatgtctttcacttatcccataaaacatctaattaaattatttcatttaattgtacatcttgaattatttgtttgcatcttgaattatttttgtcaatgcgcattttccaataaaggagtaatcagtggtctcaatgtcattcagatgaggccacccttatttatcagagttctaacaccaatcagtattcatccacagggctctttagtggaactgtggcactctttagtggaaatgtgagtttcagatttctgattaataaaaataatttgtaaatatgatcacataatttttgcaataccgttttcttttctaagaatcacctatagaaacacctactacgtgccaggcattgttttatgtgaacatttcatgtatgtaacagccccccctaaggtagaaattgttattgtcattcttattttgaagatgaaaagctgaggcatgaagagggtaagtcaccatccaaagtcacctatctaaaaaatgcaaagccaagattcaaactcaggaaatgtgttactagaatcttatctactatgccatgctgcctctcagaaagactatcactgcttcctccagcctcatcctcttgtcttttcctgggctggggccatcctcaccctgattggctctccccaaaggctcactctgacacccattccagtgctaaccctgttcagagtggacaggaactggtccatgcatctccttagatttaacacgataggctctgtctctcacaagggcaggcagcaagcaattgtcttttagaggaaaacaaaccatttgaactaaatgttgattcttgctctctctagaaatgcagacagaaatcggcaatcagtgtagttgatggataccagaaaaagaaataaaagtaaggaaatgaagaaaaattgggccaatggcactttaaaaatttcccaaaattttgaggacaacttccctttttttcaaggcacttgatgcttctctagatagaaaaattgttttcacctaaaatatcacactagctgttctgaaatcctcttgcttcttggcatgcttattaagaaattctgctcttgcagcaacaaatctcagctttctttgcttctagagaactttaaaatcattaactatcctttaaaaactcactcttggaaatacatgtggtctctttccctataactaaatatttgatacaagccactatcaacttgatactgacagtttaagggtgttgggtacgatgacctttgaggtgccttctggccataagtaccaaggaattcataaagttggattaaatgataacaaaaattggaactttccctttatcttcttttcttcttaaagaataagttaagatacattgatttcatttcacaacttgcacggaaatgagtgttttactgttgatgtttttatgatctgtagtttccattctttttaatagccttggtgcagtattaaaaaaactatcttggtgataaaagttattttagaagtaaaagttgctttagaaaagcaaacatgactaatataatccaagttttctcaggaaggaaagcgctagtgtgactggacaatgctgagacgcccaagaagatgattgaccttcaattacattgaagggaatgactgaactatttatctgtgagggattgtaaatcaggagccaagggaaagccttggaaattcaaatgtaaaaacctagttcagcaaaggagttgtcttaagcaatagtatataaatcaggcagggttaggttatactacagtaataaacagcccccccccccccaaatatcaatgacctaaacaacaggagtttatttattgctcatgatatacaaccaatttaagttaggaggggagttatgcttcacgcagtcatgccacatgaggtcatgatagcaccgtcttaacatgatgcacctgagttctcctggcaaaggaaaagaacattccagattctgcattcacaactgaaggctctcctaggcatgagacaccatgcctcttactgtgatttattgatcataataatgtatagcctcatttaattgcaaagggatcaggaaagtgtcattctgaacattctcagaaaagcagagacctgattatacatgagtgttagaagcctctacaacacagcaattgtggactgaatgcttcattcaggcaataagcaaaagcctccttcagcagcgtattatttaatcctcacataaccctgcaaggtgtgggctttcatgatccccctttctcggataaggagactgggaatcaaggaggttaaatagtctgcccagagatgctccccttcctattaagagcccagttgtaaacctgtgctcctgactaccatgtagctcttccctgagagctcctccaagccttggttaaagggccagaccctttgctctctgagcaggaggagagcaacgtctgccctcactgacccattaatagacacctgtcagtgaggaagggaggcttgttcacttcagggagctgtggtcgcttcccctgtgccactggaaaactaataattcatgaagttggctttcaggtacgagcaagctggactgaatagttgtttcaagtcataaacatagaaaagtaagttgataggagaagactatgtggagaaaatttaaccatgttaaatatttgaataaacatttaaaaatacatagcatatataggtgcatatataataaatttgagacagtaggcatgacagagttctgaaatagtttataagtatgtgagttgtaaatatcccatttatattatgcatagattataagtaaaatacacagaattgattctatgctccatcatctatgtggtcatctaatcatccatctctctaaactaacgtcaaagagacatataatttaaagcacatatgcaattctaaattttcttggataagcttttaaaaactaaaaataaatatataaaattaatttaatagtatattttatttaacccagtgcatgcaaatatgattatttcaacatttagtcaagtcgaaaattgttccatctttttggtacttagtttctgaaattgtgcatgtattttacccttaaagctaatctcaatttgggtgctaaaccttcagtggaaatccttgctctgtattcagtttataaaagatgcggttaaagaaaccaaactcacttgtccaaggtgttccaaagatacttcaaagtttgcaatcgtttagttaatctgttgacaatggttagattgctgttgtgtttatatataatgctagaaataatgcatatgttgggcatgtacattacaatatgatcctgtcttccagaccataaacacaattagtttttcctggaggattctaactcaccattgggtacctcttatatggaaaatcattagaaatgcctgtcctctctgcaaccagctgggaagaattttctgtcaaaagctagagatgtttgtgtgtttttgtcaatgggatcacaaacttgaagtcagaacagttggattctggatatgagtcttcttttaccagctgtgtgatcttaggtgttctgggtcccatttgggaaatgaggggtttaattgcctccaagcttgatctgtgcatggagcaatgtcgttatgagaattccccacattttgctcccttttggacctccctaaaattcccctaagaacacccctcactagtagaaatgtagaatcccagaccttaccccagatctactgaatcagagtctgtatttttaacaagatcccctacattggaggaaagttgtagaaagactgccctggaggatttctaacatttctgtgggctctcatattccttttaaatatacattagaatgaaatgcagatattttaagatgatgtggcctttcagagagtagttgcatttactaggatgtgaaagaaacacttttcaaatggtaacgatgtgaaggtgtcctaagtgcttgtgttgagtccagcactgtgctggtagctcacgaactcctcgtgacaacctggaaccccatgaaccccattttacaggtaaggaagcacaacctgagagacatgaaattatccaggcaggcttgcgtggctagtgattgtgaagcttggatttgagtacaggtcgtctggttccagagcttgcacgaaatcactgtgctagtaagaaacagagttcgaggttgaacccgggtgactcagcatcaaggaatgggctctctctttggggtgtgtgtctgtgtgtgtgtgtgtgtgtgtgtgtgtgtgtgtgagagagagagagagagagagagctttcttaattaccacaccatactacctccattttatattaaacagaatattggaatcttgacctttttctgtatttaattagatgctgctgtttaataacctatcacaaaagttaggcaggcattcacacacatggcgatgagaattccccacattttgttccctgtgagccctccctaaaactctcctgagaatacaacagctgcatttaaagaagctgaatcccctattgcagattttattcctgtaaaaatatattgaacttgacgaaacagagaaaatgtggcctgcttagtcagttaccctgacactatagctcttcacaaaagttttaagatatgatcatatatttaatataatatacttagtataacatgatatatgtgctatactatagcatagtatgtatatgtaatatatataatatacagtacagcatagcaattgtctaccagtgacagatttatttttaagttttttattgacacataatatttttacatatttttaggatatatgtggtattttgttacatgtacagaatgtgtaatggtcaagtcagggaatttagaatatccatcatcacaatcatttatcatttctatgtgttgagaacatttctagtcctcccctctagctattttgagatgtacaatacattggtgtgagctgtagtcaccgtactttactattaacattaaaacttcttccttctgtctactgcctgtttgtacttaactaatttctcttcacttaccctcccagaccgacaaacatctgcatccttcccagcctctggtaaccaccattgcgctctttttctccatattttaggtcccatctgtgagtgagcatgtgcgatatttctctttctgtgtctggcatatttcatttgacataactatctccagttccattaaggttgcagcaaataatatgatttcgttcttttttatagccaaatagtatttcattgtgtaaatataccacaattttttaatccgttatccatttatccactgatgggcacaaggtccgttccatatctttgctatcgtagatagtgctacaataaacattagggtgcatgtatccctttgatagactgattttctttccttggtataaataccaagtagtgggattgctggatcatacggtagttctatttttagtgattttttaagaaatatccatactgttttccataatggctatactaatttacttttacaccaacagtgtatgagtttccttttctccacatccttgctagcatctgttattttttgcaatgactgatttctatgaacaggagtctttggagccttccttcatagccatcgtctcacacagtcctcactggtgctattaccagctccatttgcagaaaaggaagctaaagccaaagcttaagtgagttcctgataaatagtccatattttacctcaggtcttctgattccagacatcacgtggactgtctgaaagacgcaaaattagacaaacagcaaaaaagagaccctgttggtgtccaacacttataatgaggctcacttctgaggacacgtgcagcctaagcaaggcagccactgcctctcaccttacagcttgctgggctgataatggccataggggatcctcagccaatgaggggtaagatctgtagataaacatccttgggtccagcatccttgacccttaatggacaattctgggggatgtttctcactgtctcttagagagtccccagtaggattgagctccagttgcccacagtggaagtctttccatgaatgcaccctttattggcttgtgtccacaccctgtcttacttcccaactccctcacttgtgattcctggcataacctcccaaataaaagagtttcaccccagttcttgtctcaggggaccacaaagagagtgactatgtggccccgtgaagatgaacttgtgacaatggcatgaccaaggtttaccacctgagctctccctgttagcgctagttacatgtagcatgtgagctgggttcttctttcccagtcattttcctgtcttaaccttggggtgaaggacaatgttcttgacctagaatggcctaggcagagtctgataagattgttgtggatgcaaagggaacagggttgtggttgctgagcattgcatccagtgcgtaccttgttcccttgctgcactctcatcatgtttggattcagatgaactttgatgttctgtgtgaggtggacgttagcactgtatctgtactgagttaggcgaggcggtcccggcaaagtaattacaaggaaatgctgtattttagattgtttgagttttccaatagagacatatcaatcttgcttgggaatactttgacttgtgctttgtgatcagatttccctgtgcttctggtgaagcttatggattcatgagttagctctgcaaatggagagtttgtgttagaagtcaaatcagttaaagctctttgatactgcacatattcatgggcagaattgctgcaaaaatcctctaaacacatacgaggagctacattatacctttaagtggcaggatcagcttcgtgacaaaaaccaaaccaggaatgagaggggaaaataatctaaatgtgttaagggaagtatgcaaaatggctgaaagctgacaaatggcagagccagaacgtgagttctgctgattccagacatcctgcctgatgaacataaaattggaaggaaaaaaaagtaaatgagctatgatgagaccaagtggcccatatgggtatcaaactcaacaggatggcatgaccaggcttttttactcaggcacaaagagcttttgagcattgtttgataatattccaaaaagaaaatgatagagccaaatttcccaaatgttccatgtaaaactaggaaatgactgaagcattcaccctcatttctaagtattgtaagtgtctggatcagaatccattgccatggcttattcattcagagcttgttgctggggattgggatgcttagactggcaggactggtgtctccttggctagacaaagatccttgcatggcattaagggagcctgtcctgacatttcataaaatcatttctgaaccgtgacgtttccagtattttattgtgaacattttcaaacataaagttgaaagaattttacactaaaccaccatgtgcccataacctcgattctacagtttacatttgacatttccatatacttgctttatatatataaatatacacatcacacacacacacacacagtccctgcctctatacatccaccttactttttatgcatttcaaagtaagcaacagatatgtaacactccaccccctaaatagatctgcatgcatattgttaattagaattcaatatttgcttttggttattttcttcttcagaggaaaatttacatactatgaaacccacaaagcttatgcgtcatgtttacattttgacaaacatatattactttggtgcaaaagtaattgctgtttttgacattaaaagtaatggcaaaaaccgcaattacttttgtgccaactgaatacaactgtgcaacccaaacccccatcaagatagaaaccatcattatgacctcagaaagtttcttcatgaccttcctagaggccaccaatattctgatttttcccatcatagacttgtttcaagtttcattggttctagaattttatatgaatgaaatcgtatggtatatatatttttgtttgatttctttcactcagcataagattttctttttctttcttttcttttcttttttttcttttcttttttttttttttttttttttttgagacagagtctcactctgtcacctaggctggagaacagtgatgcagtcttggctcactggacctctgcttcctgagttcgagcgattcttgtgtctcagccttctgagtagttggaattacaggtgcacaccaccatgcctggctaatttattgtatttttactagatctatggttttgccatgttggccaggctggtctcgaactcctgacctcaagtgatctgcccactttggcctcccaaagtgctgggattacaggtgtgagccatcacacctggccagcataagattttttagattcattcatgctcatacatcagcattcatttctctttgttgctaggtaatattctgtcacctggtcacttgtatagaccatatttattatctactctcctattgatggatgtctgagttggttccagcttttgattacaatgaataaaattgctataaaaacgttcatgcacaattctgtgtatagacctgtttttctttcgcttgggtagactcctagcagtaaaagggtatgtcatggggtagactcatattgagtgttatcagaagtgttcacttatttttctgaattggtcgatcctcttccggataacgcgtgagagcagtgacggctttgcatcctcacaaacatttgctgttactgatctttttaattttagcgattctggtgagtgtgtagtggcatcccattgtggatttaatttgcgttaccctaactacccatatgtatgcttattgaccattctgttctgttctgttccttaaaggaacattttgttcgtttattggctttgtttgtttttggcttggctaaagtcaaacttgcatcctccatctgacctgagatgagagtcagctcaaatagggatacctggagactgctcacgcgtgcatggttcgggggtcaacatcggcagagttttgggcagaattcatacacagaagttggggcttcctgtcactgagtctcttctatctggattttcctcccttaatttccaacagctactgttgtcatgaactctgttctctgttctgtaaacaagcagtccccaaccttttggcaccagggactggtttcatggaaggcaatttttccacatattggggacggggatgatggtttgggggtgaaagtgttccagctcacataatcaggcgtttgttagattctcataaggaacgtgcgacctagatccctcgcatgtgaggatcacaattgggtttgtaggtttgtactttgtactcctataagagtctaatgccactgctgatctcacaagaggtggagctcaggcagtaatgctcacttgtcagaggcacatctcctgctgtccggccaggttcctaacaggccacagaccagtaccggtccatggccgaggagttggggacccctgctataagccaccaagactatgggttttcagtcagaatgtagtttcccatctggcactggttggtcctcttatcaggctgaaagccagaaaaatgggaaatttacccagtgtcaaattcttccaagtgtttagcctccagttttttgtttgtttgtttgttttggttttttggttttttttgagacagagtcttgctgttgtcagcccgggctggagtgcaatggcgagatcttggctcactgcaacctccgcctcccaggttccagcaattctcctgcctcagcctcccaagtagctgggattacacgtgtgcaccaccacagcaagctaatttttgtatatttagtagagacggggtttcaccatgttggccaggctggtcttgaactcctgacctcaggtgatctgcctacctcagcctacgaaagtgctgggattacaggtgtgagccattgtgcccggcccaggtttttcatgcattgaagttcacactccacattccccaggtagttgtttattatatgtggccaaaagtttatagcagttttctacaggagaattggtcaaacaggggctactcagctataccagaagtagtgtcttctgcactataaatttgaatggctttagaatattccattgtatgaacgaacacaccttcttttattaaccttgccttctatggatggttattcatattcttcttattgttctctgttatgataactttgcctctgacacaaaatcaacctcactgtgatgcatactggatgtggaactgaagcaagggacaatttatctgagctcaagcttgctcatctgtaaaatgggataattataataacagaaaatatgtgctttaatgagacttaaatggaaataatatttccaccaaatgcaagtagtaatttagtgaaacaatgtgtgcaaagtacctagcactctctggcatgtaattaactcaaattaggtgctacttggttctctttgtagttgtcattgttaccattatccttgctgcctacactcataaatgtataaataaaagattggagaacaaatggcatgtacgcaaatgtgtttcttcctttttataaataaacataccatgaggattttttatgtcagtcaagttgtttttgagaacatgattttaatgactgcataatatttatttggatgatccatggtgttggaaaataataagttacatatctaccttatataaatttctctggggaaacaagtcattaaaaacaagcttatttctaatttcagcctaatgctgatagacaatgtcaactggataaagttgagtcgcacatttcagtagctagaatgctttttaaaagtactttcacgtttggactaataaaaatgacatatctgtctcatcccttttcaaggaagctgaagtgcctcatcaaatttattttattaggatcccgacagcaatcttgtggcctgggtgaaggtcaaggaggttttgccttttgcagaagggagtaacaagtgatgtgatgataaagtgttctttctctctcggttcatccatggtgggaaagagcccttcagctcattcttcagttggaggtggttcagggccccatgttgctcaaattggtgatgacagccagctgtttggtcccaattcgctgagactaggaattcaaacccaggaaaattgagacacctgtgtatgaaaagcataaagagaaaatttggttgccctcatgctcactcttatgccaagtatttattcaagaattaaatgaataagaatagggatttcaactacgttctatcctcctcctcctcctgcatctgcctgaccttcttgggagccagatgttccactgaacactttgcatgcactgtgactatctaatgcaatccttgggacagatctgtgaaatagagtctgttattagtcccgttttaaagatgaggacactaagattcagatggtttaagtaacctgtccagtgtccacagctcctgtattagctgagagtcttgtgccattatatcagaaaagtctgcttgtgtcttacagtcttgatcagaaacaagtatatccctcagaacatagaggcggcaatggggggtgactttgttctaacccacaaggaagattattacatgaatagtatgggaatcttggcagaaaattagtgggttattttttagtccttattagtaaggactccaggcaagatagagttttgttttgtttttgtgtttttttttttttttttttttttttttgagacagagttttgctgttgttgcccaggcgggagtgcaatggtgcaatcttggctcaccgcaacctctgcctcccaggttcaaacgattcccctgcctcagcctcccgagtaactgggactacaggcatgcgccaccaggcccggctaattttttatttttagtacagacggggtttctccatgttggtcaggctggtctcgaactcccgacgtcaggtgatctgcccacctcagcctcccaaaatgctgggattataagcatgagccaccgcacctggcaagatagagtcttttaactttgaaaagttaggattcaaatcagtctagccattgaatcgtatttattgagcacctgctgtgtatcaacctcagtagaagacccaagagatatactggtgaatgggatagacatggtctatatttcagaggcctactagtatacagttgaagacgggcattgaacacaggatcacagctatgctaataggggtgttactgcagggccatccaacctagaacaaggatcatattaccagcgtttagagaatagggtatacacatgcttttaaatgcacagagtgtaccacttcagagaatactgatttctccttagtttgggctgctataacaataccagtgactgggtagtatagaaaacaaacatttatttctcccagttctggagaccagaagttacagatcaggtaccagcagggtagggtttttggggagacctgtcctcttggttcacagacagctgccttttcattgtaaactcacacagtaaagagagagagagagagagaaagagagagagagaaagagctcgcaaggatcatctccttagaatggtactaattccatcatcgggttccaccctcatgacctcatctaaacctaattacctttttttttttgagacagagtttggctcttgttgtccaggctggagtacagtggtgtgatctcggctcaccataacctccgcctcccaggttcaagcaatcctcctgcctcaggctcccaaattgctgggattacaggcatgcgccaccacgcccagctaattttctatttttagtagagacggggtttcttcatgttggtcaggctggtctcgaactcccaacctcaggtgatctgcccgcctcggcctcccaaagtgctgggattacaggcctgagccactgtgcccggccacctaattacttcttaatggcccaatctccaaatgttatcacattggggtttagggcttcaacatagtaatttggaggaggacacagaagttcagctcgtaacattccactctgccctctccccacacatttatgtctttctcacatgcaaaatgtattcattgcatctcaacagcccaaaaagtcttaactcgttccagcatcaattgtcaaacaagctagtacaggagttgaacattttccagattcagaaagatctccctgcccttaatcccagcattttggaaggctgaggcaggtggatcacttgaggtcaggagtttgagaccagcctggccaacatggtgaaaccctgtatctactaaaaataaaaataaaaaaaaaatagccaggtgtggtggtgggtacctgtaatccaaactatttggaaggctgaggcaggagaataggaggattgactgaacccgggaggcagaggttgcagtgagccaagaccatcgtgccactgcattccagcctgggcaacaagacaagactgtctcaacaacaacagaaaagaaataaaaacaccagaaagatctcactaaactggagcaatggactaaagcctcaaagaggaaatttcatttataaggttaggctgtagaagtaagtacagaatcaagagatttggcataagaaaaacctacgtggaaaagatcagaaaaagtccctcaagcacagagtcaatattaattagcaaagcattcggtgctgctgttttaacagcaacagtgaattcgcacgtttgtttttcaggccatgcaaagggaaaaatgatttatgtctattcccagacagtgtgttttaaacggtgtcttccctttcaagagacttttctagtaagaattttttttaatagggaaataagtaataactttgagagcaatttaacttgatcatgaatcagaatgattcagaaccacaaaagaagctgatattctttcatgttctctaaatatcttcactaaatgtaaagtaattggacatttataagaattcagactctcccataacaaaagtaataccaatcatgggttggtataggatgcacagttttaaatacagcatcttacttgattctcaaaatactcttgggagaagagcccaactggtgtttttatgtgtagtcactgtgtgtccacctgtttcagtaaagcattaggacaatttacataactctataccgtacagtataaacaaggctgtgatgaaatttgaaaggaagacaataaggataggagagctataaagaaggcaaaacaagtgaacacaattccaatctgtgtagtcctgcacatttgctggaggtggaacaaaatccttgcccccatgttatgcatatggaaattgagatttggagagattactgacatgcccagtatcacagagctagtgagtaacagagcccaaaacacatcagccccaccgaaattctgttgttttctctagtactctatgctgccttccaataacatgaaatatggaatttgtattggaaaagatgccaactcgcagagaaactcgatagaactatagttggaagtgtcttttcaatatgagcctctagctataaatggatgaaatttccactccctcaaagcttagaactttcttactcttagcagctcactagttgtttaacatacctaatattaaccatctggtcagggagctaaatacaatgaagggcatccagctattatcccacccatttgcctatcccaagttatgttttattaggttgagttgtcaattttaaataatcaagaaagatagctccaggtaagtctcactatctcgttaataaccctttaccaattgcagctgtttcgagaccagacctttgcaatgagtttagaaagctgctgtggacctatcataatttttactacactttgtggccacatgaactggcagaagaggctgtcctaaaatcctaatgtggcaaaaaccaattttcagaagtcaatttggatgttataggtagcgctcttcacacccaataaattgcttatctttggctttgaactgatgggcacgtacacaaaagattggagccaactgattgcattattagctgaggaaaaagtgtgtgactgtggcgaatttagcaaggggtagtctggagaaggatctgtgacctgggaaaagtttgttttgacgtggaaggtcaggagtttttgtttgtctcttgtgtccctttttacgttcatgtctgtccagaagtattcatcttctctttgtggtttaaatgccctgggcagctgaattactgtgtgacctcctattgtcagagcatctttgtggaggagaacccatcacctgtctctcgaaaacagttgtcctttgaactttcaagattatggggaaaaaatgtacttattttctcaatcatggagagcatgtcctttagagatacctttggctgcagatatgtgacacagctgatttaaaatagcttaagtacccaggtgcagtggctcatgcctgtaatcccaacacatccggaggctgaggtgggtggatcacctgaggttaggagtttgagaccggcctggccaacatggtgaaaccccgcctctactaaaaatataaaaattagccaggtgtggtggcagcacctgtaatcccagctactcaggaggctgaggcaggagaatcccttgaacccaggaggcagaggttgcagtgagccgagatcgcaccattgcactccagcctgggcaataagcacaaaacttcatctcaaaaaataaaataggttgagtaagtagaggtgtttttcttgcctaacgagaagtctcagtgtaggtgatgctgggtttggttcaactattcaacagtgctatgagaaattcaggctattcctctacttcatctcagcatccttaattgtctggctttaatcttcatagttttccccttatattggtctgttttcatgctgttgatagagacatagctgagactgggaagaaaaagaggtttaattggacttacagttccacatggctggggaggccctagaatcatgacagggggcaaaaggcacttctttcttggtggcggcaagggaacatgagaaagaagcaaaagcagaaacccctgataaacccatcagatgtcttgagatttattcactatcatgagaatagcacaggaaagaccagcccccaggattcaattacctcccctaggtccctcccacaacacgtgggaattctgggagatacagttcaagttgagatttgggtggggacacagtcaaaccatatcactcctcatggtgtgcaagatggctgatacatgtctagctatcatgtcagcaagactgggagaatgtggaaagggtgagccagccagccatgcttgtcctctttggaataagaaagtcttatcaaaaaccactagaagtctactgtttgtctctcataggccaggactgtgttatgacacagctatgcttagctgcaaaggaggctgacacagcaagcatttggctgttttatttgtgccttaaacaaaatacaagctctacagcaagaagaaggagagaaataaatgttagggagatgagcaaccatgtcactatgggttgtatagtcaaatacatatatttgggaaacgttattttcttgctgacagaacttctcagaggtctcaatatgctaagacacattgaagctcttgatggggaatagtcattatatttggcattttgccagagtaaacaaagaacccttaatttattctttagaatacctattaattcagaagtgttctgaatggcgtcatgaaatactatgttagtgccagctcacatcctttgctgagagagttaaacgtatttgtctcaaatcagcacagccttctacagctaaggcaggtgtactggctgctccaattgagaacaaacaaggcaccagggcctttgcatgtaccccatgatgaaaagatggtggcctaagtgcaaaatggttaatgaaataccaaactcagataccaggccactggtgtcttccagttcactacatgtttaaggcaaaaataagagagcggttttctcagacagagtcttgagactacaaaacagtcaagacatttccccaagcaaactcagaaaaatattaagcctagacaatgtagagcgttagtagttagggaatgcagtatttcaattccagatctaccatttataagctgtgtgtttttgggtaaggtactctgagacttagtgttctaatctgtaaaaggggataattccttccactggagttctaattaagactcattagggtgacgatggttgtaaagtgcttattgcagtacagtggagctgtttctgtcccagatcctttatcaaggattgagccaagcggaatccttgtctttgttagtccaaattggattccccattcctcaaggtcttgtatagcttaacttataactttcaaagcaagatatcctgacattgctgttttgaccttgacatttaaaccatgctttgaaattaagttttgtgtctttaccttgccagtagtatttgctccaagaagtaagtgcacaccaccagtctcaaattcagttcataatattgctgctaagaatgatgcacacaaaataaaacaagcaatggcaaaaactgggcacagtaaaatttgctggagataggaaattggctaaaagatcaaatattgctggcatcatgaaaaaccacaaaaaaatcctatgaagaattagacttggcagaaagaacgagagcaaaataaaattataatggccaaaactacatagaagaggttttattattgactagaaatcaatgcaaatataaaaaaagacttcctgtcaaaaatacacaaccgcaaaactggctttggcggactaaggctaccaaagaaaatccacaagtcagcagttgccattggtaaaatttaacttggcaaaaaacaatcaatgaaccaaatagttgacataaaatgtacacacagcacaattaatcctgatgaaaataattccagcaaagtaaaattgatttttttaattcagttgtttatgccatgtaggaaactgatcaatgacttaatttgacgtgataaagtttgctttgagaaacattggatgaacaatgttggaaaaagtctgactcattttattgctttgaaatatatataaaaagctagcaaggtccaaatgataggattaaaatatcctatactcattttaaatatacaatgcttagcaccagctggacacggtggctcacgcctgtaatcccagcactttgagaggccgaggcgggcagatcacgaggtcaggagttcgagaccagcctacccaacatgtcgaaaccctgtgtctactaaaaatacagagattagccaggtgcggtggcatgtgcctatagtcccagctactcaggaggctgatgcagcagactcacttgaacgcgggagccggaggtcacagcgagccaaaaccgtgtcattgcactccagcccgggcgacgaagcaagactccctccgtctcaaaaaaaaaaaaaaaaaaaaaaaaaagcctagcaccaaagtattagcaagttcctgttatttattaatgttctcatactttcattgaatttttaaacctaatgatgtttattttcaaacacttcagtccatttattattgaatataaaatgggtgctaattacaaatgggtcttatgtatgcccttgggttgtctagcaagatggtttcataggtagtaataagagcagcaagagaagaaaatagtgtggcctttacctttactgaacactcactttggaataggcctcatgcttgggactgcctccgtcagtgtgcagccttcagcggctacatttggaaatggtacaagtattaggttggcgcaaaaagtagttgcggttttgccactgaaagtaatggcaaatacttagaaatatttagaatatttagaaagtacctgctgttctgactatcttaattcagatgtgcactcaccttttggctcacgacaacaaaagccttcgaaattcctgcctgtttagtttgtgttgacacattgcagattcaactctgacatgttatttccttatgctgagggtgtcttgttgagtttcatgggttttgtgcttccctggtgccttattaggcttataactcacagagctatgagtttaaatgtcagggttgtcaccaaaacaatggagcaaaaagcaagttgttgacattctttggacgcaatttgcaatcccctttattttcctgtaacgtttttgtgtttccaggtgacagttgcccaccgaaccacagaaccacaaagcccagagttttagttacatactgctgctctaggatcagtagcccttaggtccaaaagccgtttctgatacagccttgggcaagctggttccttctctgagcctgggcccctgtcctataaagtaaaggtgttattacccttcataggattgttgtgagaacaaagtatttacattcttcatataatcagaacttttccaaaaacatgggatcttttacatggctcaacatgtttaaagctgtttatgttcatctgatattttaacattttgtagagtagaaaatgcttcaagcaaataaatgagctttatggtaattttttttgccagcatttagaagctggtggttaataaatactaatatgtatttagaagtttagaacagagatttttcagcaacaaccacaggctagatatagcccactacctgtttttgtcaataaagctttaatggaacataagcatggccattcattaatatatgatcaatagattttttttggtacaagggcagaattgagtagttgcaatacaaacagtgtggattacaatgcctaaaatatttactacctggttctttatagacaaaatttacagactcctgaggcagggttttatcaattcctttccatgtctatggatttagatataagcgtatattttgttaaatattacagcagactttgaggtggctatcatctccattttacagatgtagaggatcaggctcacaggtagtgaatggcagaaccaaggatgaattccagcccactaacgtcacatctctatttgatcattagcgtatagacttttggtccttcataaattttactttataaagatattttacgttgtataattgatgtcatggccatattgtttaatcatcactcaccatgcacctattgtgtggcaggcactattctatccattagggcacaatagtgaacgaaaaacttgctgccatcagagaacttgtgttctgggctttcatgcacctgccttgcaggcgtcaggaatctgaatcacactcattccctccatcacttggctcaccagtgggaccagacaggagtcctgcagtttcagcaatgaaccccagggcttggtgcctgctctggaggtggggaatggggttcacagtttagtggaagattgcctttagggagcactcttggtttctagaacctgatatagatgagggatgtaatgaattcgagtctgaatgtttatttgccatggacttctatctcacgactttgctataagggctacacgtcggaaatgggatctaagtaaacgtagagtccacaagtttcaggacttatatagatgagtgaatctcagattttcacgtgcatacagattacctgaggatcttgtaaaaaatgtagtttctgatttcaagtctctgggatagggcctaggactcagcatttataacgacatcctaagagatgctctgaggaccatactttgcatagcaagaaatgagaacagtccaggagcctctaagatccctcacatttgaggctagaagcatgtaacatgaatgggttctcaaacctaaaagtcagggcttgggcataaactaaaactgtgatcacctcgcgtagatttgaggctttgactggtcgtcaaccccacccacaaaagcctacagcttcctcctaccccaggtcccagcttctccacttctctccaactacctcccacttttcctcaatttcaggctctttcgtgcctccagcccagtctacagcatgttccctggttcagaccatcccaatcagacccctatagagatgccaagccattcgtttgtgggccgggcacggtggctcatgcctgtaatcccagcactttgggaggccgaggcgggcagatcatgaggtcaggagttggagaccagcccgaccaatatggtgagaccctgtctctactaaaaatacaaaaatgagttgggcatggtggtgcacccctgtaatcccagccacttgggaggctgaggcgggagaatcgcttgaacccaggaggcagaggttgcagtgagtcgagatcgcgtcattgcactccagactgggcgacaaagcgaaactgcatctcaaaaaaaaaaaaaaaaataagtgcttgtctctgctcaaagagaagtcagaaatggcagcaacattcctagcccaggctctgcactctcggtaatccctctgactgactctcaagtcttccccgtctgtctgctccgactgcacgagttggtgattaaactttaaaacaacaattagacccttgattttcaaagcaaacttggtttatagaccagacttcagcattcattacaatacagactaataaaaacaaatccggaaacatacgctttttaagctgtggtggtgtgaaatctgtaacagcattaaaaccattttgaaaaaaaaaaagtcatttgggaacccccagcaaaatactgtgtggatattcttttctattcctcattcaagtatattgcatatatataaacataatatatatgtttgttactgtaatttttctacttattatataacattttctatgttgctacatgatctttgtaaatattatttttaaagactgtacaatatttcatgtagttgacaagccacaatatttgtaaacataaaacatttctcccctgggaaatattttagtgatctccttcttcctttctctctcttcttctttcttccttctttccttcctttcttttctccttctcctcctctttgcttttccccctactccctttttctccatcttctgctatcagaaaaaaaaaaattccatgagcacttggtaaccatctactttatgttgaattatttcctagggtaaattctcagtcagtagtaggaggcatatttttcccattcaatgtagtttgagaagcccaatgaccaaatcatgagatgttgccattctctatgaaaatcacaaaggatgactccctaaatacattttatgtctacagagaaactgtataattctgacattaatttcagttccttacaactgccttcattccttggggagggtactgaaatgagctccagctggagactaagtcagctcaagccactaagtcatgggctggtcttgcacaaattattttctgtttctctgtttctgtaagcttacaatttatatattgtatattttataaacatacctcatcagataaggttatagtgaaaaatatatctgctagggtattcacttcataagggaaggcttttttgtctgttttgttcactacatactatatccccagcatctatagcagtgcctggcacatggtgggtgtataataactgtttgtttcatgattcattttttaaaagatctagaaaaagaaatctttactccaaagggtttgaagcagtgattcataagtattttaagaataaatgtatctttcacacctgtgtgcctataaatataatttcacaaataattctagtaagttcagagaatctagaaatttttttctgtgcataccaggcaatgctggcattaaaaatttattttgaaaatcctctaagttctaattcacttgacattatcctaccaagttaaagaaccatgaaataataagtaattcatatcactgcattcatttctcattatggactgtcaaaattgacattcttgttcccgttttatagaagcaaatcttagactcagaaaatttcaaagaacttatccaaagtgacacaattcttcaatagagagcagggactacaacctaaattttctaattcaagtccagtagggtctgccttaaatgcctcccactgtcaccgtgttgatttgtataacctttgtcttcctagcatttgattgacggctactgttagtacagatcatctgggctccttgtagtgatggacacattttcatgaggcaaggtcttagatgattaaaacaaggcagatgctaatgccatcctcaccttcatctggaactgtctaactagagttcgttaacttgtcagccctagttccttttgagcaccaggctgatataataaaatattgcaaatcaatagaagctttaaagaagcttcatctgtctttctttgttacttttttcctttcttcttcttttattactacttctttctttgccgctttaaagggaaaactgctatccctcttattggctgtacaattctgttttctctgtttattttgagttgttggaaattcaggtacatccaggttttcccaaatacacctattattaccccaaagagtaggaagccgatcttatctagattcactcaccaaatctagaatctcccaagagactccaaatttagtacattaatttttcttaagtataacattgctcagtaactatgtgggtgaagatctgaaagttctgcagcactgtttcatttataaaaataaaggtaacggtacttttgcgcaagatttgtgtggaatctaaaaacttccccaagttagtaaggaaggcactgtgatagtatctactaatgaaaatgtgagcacagagatggttataaaataccttatttttctcttcttcattattattgctcatttcatttgattagcaatttctagactcactcaacctccatctataaaagaaaccattagtctttgcctatgtctgctaaagcgaacttcttgttctgtctcatcttcattccctactcagtttctgtcttctccagcccttcttacattattgaaataattgactctatcaggtggatttctccagttgaacacatttggatttgtcctgtggaaacaccataagtacttttttttttttttttttttttttttttttttttttttgaggtggagtcttcgtcttttgccccggctggagtgccgtgagtggcacagtctaggctgactgcaacctccacctcccgggttcaagcgattctcctgcctcagcctactgagtagctgggattataggcacccaccaccatgcctggctaattttttgtatttttagtagagatgggatttcaccgtgttggccagcctggtctcgaactcctgacctcaggtgatccacctacctcggcctcccaaagtgctgggattacaggcatgaaccactgctcccagcccaccataagtactttaatatgctaatttatttcaaacaatatgggaatcagttcaaagcacatagtctcttccatgcacatcttcatgccggaatttgctaggcgcttgtacctccactcccttcttctcagtcctttgtccaaggaattcttccctcaaagagttctcagtcggaaagcatgtataagacaagaaaataaatggataccaaaatcaacaagtgaagtaaattcccagaaagcacttgcaatagtatatgataagaagtgggaactccgtaaaagaggcagaaaggaaatacctgaaaaggttaagcaagcgagtaatagcctggagagaagagttacagaaatgtttcatagaaaaggtgatctttgaggtgagcttttatgaataggcaaaatttgggtaaagaggtagacccatttttaagagcagggtgacatgaaaatctcaggatatattactcagcaattaatcctcattgttgtaacaaatagttacaaaattctcgttgcatggctctggcttaactgcaaagcaaagtagaaaatggagaagctcccaggcaaggccaacaacgcctggtctgtgctgcacgtgaagatatctgagcacttgtgacccctgctttgccctctttgtcattgcaatggggttactgggaaagcctctcccatggtggttgacaagagggaaactttgggaaatgttctcaggagtaacccacattattttcacgcctgaaagatgcaaggttggatagagagagaagttgggctgtggtacgcttacaacagagatctcaactgaccctgcagagagctttaagatgaggagaacccttctgtgttgtccttactcaggacaaggagctgaggtcttatgcctccacattgactagtcattgaatgtaggctcatttcaggaagggagtataatcttgggagaggtgctgtcttcagcagaaggcaaggcctcttagtttatagctgtcagcctccaacttcccagtggctgaaagaatgaatgcttcagttccaaataaagggatctgagcagcaaatcccatcgtcctgtattttcattgaagtagcatttcataaccagtaacaactgtcttcccctgaaagtgtggtttaaatttaaagttggtgacttccttctgacttgtcaaggcgtgggcatacgcaattttttcctctatggttatagcttccaaactgttagctatatagatacctactttttaagataagtgagacctcaatcacaattaactctgtaagttattgaaaaccggtttgatgatgatcatcatcatcctgtgtacaccttgtgtgagcttgaggtcctattgtaggattaatcatcagagcagtatctgcagtctgcagtgcatttcttcttctttatttgtttagaaaaatcccactcttcctcccaaaattaactttattgtcaacttgataagaagatttctgaacagaaataaaataaccctgatttgtggtgtttgccaattactgtggtataaatactcacactgtggctgatgccaagctacaaacatgacatcatggaattggaagaaatagtaaaaatcatttataccttctccaaaacactcactgttcccaaaactttcacctcaataattctgtccactggtatatcaacatggtactggtgtagtaatgatccattccaggtacggacaaaaaaagataaataaaacaacaaaaaacttactaaatgccatatggttttatcatcttgtgctggcaatttgtaaacatcatcagtgataaagtacttctcccaaatgggatgaatcatacctatcctcaccctgcttttggacactggtatatcctctcaaaggcattaataactatgttataatgcaaatatcacgttatctttctatgatttttctaacccaatagactgtgagttcttcaagcttatgtatttgggtacagaacacctcgccaaaatccttggcatatggtagatgctcaacacaggtgcactaacttgttagttgaagtgaccggtacaacctagttaactgaatcagaaccatgaattcagaggatagtagtaaaaaatcaagttcatgaagtttttaatgagcagtatgttttgcctaagactctatgattctcactgtggaatgaaccacatagactccagaatgtgtcttttcttaaaggcaatagaggcatgcagtgaataaaatgcactgagagaagcccataaaacaatattcgtaagtacagagaaaggcaatattaatgccaatttcaggggatctgttcaagttcaccggaaggcagagtttttagcaattttttaaaggttgaacatgtctttaggaggtagcaacaagacaaaggtccaggaagagggtgtgatgcagtggggaagcatgcagtcaccttgtgccgaacttaacaggtcaagaactccgtatgtgaataatggtggaaatatgtggagttacaggtacaactctgtaagggcattagcctgtaccagctatcattgcgtaccaggctatgtgtggactttgtccttgtgaatctggtaaaagttaatcatcaggtctcaggagttcagcaaccgaccatcatgagctatatagtattagtctgcagctctacctgagagcagcccagaaaccaaataggaatatatcagacattatcccagagagaaggctcagtcaaggatctgcagctgggacctgcatatcttaattcccctgttcctgggaaagttatccaatagctactgaaatacaagatggaaggtatcctctctgtaccatagctaaaggattgctcacaaaaatgaaagtgcaattacagaaaaattatccttgggctatgaccacatctcctgagtattttattgccaccacgactcatgatttcaattctcaggactgagtatctctgctgaacgcaaatttaaattcttaatatgagaagctgcgctttccagtcgtgtgtcaatgcaaagtgagcggatttgggtttaactcccttggactgagtgcaattatatgttgggaggggactaacaaggtagcccatgtaacaatactgtcgtaattatgtgcaatattttcatttttacttctgatcaaccgcaagagtagattgaatgctattgttcagtttgcacttaaaaatgatgatttttttatacctggagtttaacatctgagtttttgtttaaaggaaaaattgtccttgcctttgaaagttagggtcatgttaaaatatttactaattctcataaaatattttttttctgagcacggttgaaaataaaaatatcttggtcctgtcctttgaataatgtcaagattgagtgtacctctggagaaatattgatagagactcaaagcaataccactctcccttgtcacttttctctgtgtactgtggacaagttgctcaacctcattcaaactcagtttttctcaacaaaatttgatatcaccataaaggaggagactcggttgcctttgtttttattattaaaaggaagcattgagtctaactgatatgaaacatttctgtatatgcctaagaacttatgaagctcataggataagaattcttggcaatccaaataatctcacattgtctctaatctgttataatgctgctcttgcctcataacttttgttctttgtattccttaaaaagacctaagagagctcaagattatggggtgctgccaaatataacactagtcttctatttttatttttaaataaaactttgtaattggtaaagtcacagaatcagtgtgcatatgatcaaagtctataaaataatgaaccatgcataattgcagcagagttaccaaggaaggctgtaaggatgatctcactggtgcagccaataccccagtaatcaatatggatgcctgggtgacaactccttccttcctaactttcacagcttgcctgactgggatagccaaggaaggcatctgtgaagaggcagcatctttagagtttatgtgggaagtgcactctaggtaagacagatgctatatacaaaagcaggaaaatgtaaaatttgttcgtaaagagcaactagttgcatttgatctaaagtagatgattccagtacaaaaaggaaattacagaagttttctcagctccaattttagagagcctttaatatcatgctaagagggtagagtagaccacattccacaaagaagaaacagtattttatttgttcattccttcttacaaaaaatatccacctagtacctactctgtactagcttaaaggtaacttttgaaaaaaaaaattttataatgcctagtcaagaagcatatctggatggaatgaaggagaatgagacttcagggcaggaaagaaggcaagttaggatactattgggatggtccagataagagagagcaccgtctgaagggtctggcttataacaaagaggaaataatctttgagaccaaacagaaaagtgtagcctcaagaaatattctttgtcatcctagtggttgctttagaatttgtagtatacatctttaacttatcacagttcgtgttaaataatattatagcatttcatatatggtataagaaccttacagtaaaacactttcattttctcctttcccagcctttgcactactgctcctctggtttttagttgctcataggttgtaaactctacattacattgctattattttttactttaaacaatcaattttccttctaaacatagaaaaaggcatatttttccacatatacaccactttctgtgctcttcattcctttgtgtagattcatatatccatccaacattatttttggtttggatgaaggactattgaacatttcttacaatgaggttctgctggtgatgaattccttcgccttttgtatgtgcatctgaaaaagtcttacttttgctttcaataatgggagatatcttcactggatacagaattctgagttgacaaattttatttttctttgagcatttcaacggttcactccattatcttctgacttgcattgttgctaacaagacatctgctgtcattcttctctttttcctctgtgtgccatgtgtcttcttccctctagctgctctcaagaatttatttttattagtggttttgagcaatttgattatgataagaaacatttttgagtggagaatcaagggaaggttgaaacagataagacgtcaatgctgggaaaaaaggttaattgtgagactggttgttccttatttgagcctgataataacaatctcttcaggtacaggacaaatgtcatgacagaatgcactttaaaagaaaaataatagctaacacttgaagattgctatatatacctatgtgtgtgggtgtgtatgtatacatacacatatacatatatatgcacatacacacccacacacacatacataaagatagtgttcatacatataagatctaacttctaagatatataagatcctattctaacatatttaatatgttgcatatattagaatatatatttgaacagtatctcatacaaagtatgtttacacaaagtaggtgctctttaaatgttaactattacataaatgtacacacacacattttacactaaaaacaattctatgatgtaggtagtatgataatcttcattttacacattttttttaagatggagtttcactcttgtcacccaggctggagtgcaacggtgcaatctcagctcattgcagcctccgcctcctgggttcaagtgattctcctgcctcagcctccagagtagctgggattacaggcacctggcaccatgcctggctaatttttgcatttttagtagagacagggttttgccatgttggccaggctggtctcgaagtcctaacctcatgtgatctacctaactcagcctcccaaagtgctgggattataggtgtgagccaccgtgccgggcctctacatattacttctaatccttaacataacagcccatgattccactctttcaatctcgtttcttttaactttgaaccattctttgccaattactttacctacctgtgtctcagtttcttcatttgcatcatgaagctaataataaaaccaaaaggctgttttgagtattaaatgagataattcatttgaaaagtgctcagcatagcgccagacgcgggagagcactcagtaagagtgaggaggtggtactgttatcgctgctgttttatgctttcttctgcctgcgagttcccacttggttcattcaaagcacccacactgtcctacaaagccaagttagcatgcagcctactgccctgatcatgcagtcacaatctctgtttctgctaacagtcagtaaacacaatttagcatctcgatgggtttcattgctccacataggctcatttagacttttcaactagattaactcatcactcattcaattcgtgtgctgtctgaggacacaccaggtgccaaggactgttctggtttactagggttagaaaggtaaataagaaagataaaaattaaatccctgcctcatggatcttatgtatgggggtgggggagacaaacaaaaataatataaataagtaaaatatgtggtatgatagatgaaaacaagggacatagatacaaataaagcacagaagggaaataggaagtgttggggataccatatattttggataccgaggtcaaatttcactgtgtgggcaggattatctcacccatttcagaagagaggaaactgatgctcagagaagggtggtgaattttttcatttcatgcagcattggtttagagacaagatagaaatcaagattctccaacttacagtccaagacatatttctgtagcgggcagaagctgaactctatttgtgctcctaggtggaaaacaatggtcctgtagtcctcatcaccatttcccatgtctgaaactgtctttgtctacctcttttcagttcttctcaacttcataacctattcttgctgtatctaaaaagcattaatgatccactggcataagaattttgggttagctcaagccaggtaggatagacttgaccatatgttcgtgcaagttacaaacagccatccccttagggtatacacttgcagcacccatgggtgtgtggttgcagaacacagggtaaatttcagccctcagccacttcctgcagggacttttgtacagcgtacaacctttaccaccataaatggaggctttttgtatttcacacatcatttaactagtgaaagttgcataatagatactcagtgaatcatggatgattgaattctttctcatttttcatttcctatatgattcagatcctttatatttcagttcatggtaaaggacaaaaattatttgtcaaatattgattgagcacctactatatgccagacactggtctaggcacaggggtacagctgtggaaaactgacaaaaatccctgcatttatggggcttacatttataatatatatttatatatcatttgtctcttcttaatagaaaagtatatagaggtatgtatatatacatacatgcacatatactatatactataagtatatatacttatgtatacatatacatatacagatatatactttatgtgtattatatatagtgtattgtatacatgtttatatactatatatgtgtagtatatatagaacaccatatatatgcttatatactctatgtctattatatatagtaatgtatatatttagtatgttagattgtgatattgccaaaaaaaaaaagagtaaaataaagcacaggaggggaaatgaagtttgaaggatgttttagaaatactgggtagaggctgggcgtggtggctaatgcctctaagcccagcactttgggagaccgaggtgggtggaatcacatgaggtcaggagttcgagaccagcctggctaacatggccaaaccccatctctactaaaaatacaaaaattagctgggtgtcgttttgcatgcatgtcatcccagctactgaggaggctgaggaaggataatcaattgaacctgggaggcagaggttgcagtaagccgagatcgtgcccctgcactccagcctgggagagagagtgagatttcatctcaataaggaaatagtgggtagagtggccaggacagggctcatggagtaggtgacttgtgaggaaaggtctgaggaaagtgaaagaactgctgtggaagacagaaccaaggccccaggattgttcacattctactccttggaacctgtgaatgtgttaccttatatggccaaatagactttgcaaatgtgattcaagttaaggattttggattatgttgatgggtccaatgttatcaccagggtccttatgagagggaggtaatgtgtcagagccagaaagggatttgaagatgctacgctcctggctttgaagatgaaggaagggtccatgagccaaggaatgcaggcagcctttaacagttggagaaggcaaggataccttctggtgtacatcttccagaaggaacacagttctgatgacaccttgattttagcacaggaaggtctgtttgggacattcgaccccagaaatgtaagataataaatgtgtgttgttttaagtcgctgagtttgttatgacttgttatagcagccattggaaactaatacagcaattctgtggctatctggcggaagagatacccaggcagggagaccagcaaatctgcaggctctgaagtgggggtgggtctggtgtgctccaggatgccagtgtgcctggactgagctggagtgagtcaggggagcttgcagtaacaggggcagagtgcagatgacatgagattacatgacacactgtaacccggaacaaggacactggcttcactccaggtgctaggagatcgcactggaagctacgaagcagaggagggacatcacccagttcacgtttcaacaggaccgctctggccaccctgggggagggtggtgaggaagaggatgtagaggtatagtcaggagatgtggagcagttaggaggattgtgttttgatccaggaaaagatgattttggcttggagcaaggtggtgggaattggataagggtaagagggtaagaaatagttatattgtgaatgtattttgaagatggaggtcattaaccagaaaagggtaaatgtgatacatgtaggctgaactggaagagacagtgaataaaattcctttgctaattaaactttcttttttttttttctttttctttttttttttctttttcttttttttttttttttttttttgaggtggagtcctgctctgtcacccaggttggagtgcagtggcacaatctcagctcactgcagcctctgcctccctggttcaaacaattttcctgcctcagcttccgaagtagctgggattacaggagtgtgccaccacgcccagctaatttttgtatctttagtagagatggggttccaccatgttggctaggctggtctcaaactcctgatctcaagtgatccacccacctcaacctcccaaagtactgagattacaggcgttaactgaactttttttttttttttttttttgagacagtctggctctgttgcccgggatgaagtgctgtggcgtgaactcagctctcactgcaaccagtgcctccaggttcaagcaattctcctgcctcagcctactgagtagctgggactacaggcacgtgccaccacgcccggctgatttttatatttttagtagagatggggtttcaccatgttggccaggctggtgtcgaactcctgacctcaagtgatccacccacctcggcctcccaaagtactgagattacaggcatgagccaccgtgcccggctaattaaacttttaatgtggaaagacagcacatgcaggagataagaggtagagtgggtgatggtccaggctctgagcggaatggcctgtgttcaaatgctggcttctctaacttaccagaattacgtatgtccttgagcagagtgtttaaccttcctgtgcctcactttcctcatctgtagtatgggatacatcacagaaattgtgtatcaaagggggaaaatgtttgcaagacttagtgcctaattcacagtaagtgctcaaaaaatgcacacagtaagtgctctgtcattttctagaacacattgatgtttaaaaaaattttcctacttgtaaaacagtcaaagagttcagtgtgaagtatttgcaaaaaatttgaaataaaaaattactcctttcctgtggggcaagttcacagaatagctggtatgctgacaattttctcttggtcccataatagtttttcagagtttcattataaaatagttgctgtatttgccaatgcagactttgaagaaggagactgatccttctggcttttaaagaagaatgagtattacacgaccattgaatatttataacactctcttctctttttaaagctgttgttgttttaccatcctaacatcaaaaccactgggcccagggaaacctcagatgtgggagaatatcaaatgtggaacttttccttgtttttcctggtggatctgacacaccttggaaccttcaaagaacacagtaatcaatgacgtggggagacgtgagacatcgcatacattattgtgaagaatttattaatgtaaactgcatggtgtggaatagaggttggggctgaatgaaaatgtgaggctctgtaatgcgacaaaaaacacagagcagagagaagagagaggccaatgaaagacactttgctgatttgggacttcactaaagagagccacataaaagagaaattattgtttaagtaggttaaggcaaccctagtgttttaattaaaatgtctttagcaaaaaaggaagaagaatagtacttgaggtttggggaaggcttcagtgaaagaagaaatgtaccaggcggtggcgggggtgggcgggggaaatagtgtaatttaggttaaatattgtgaataactccccaagccgaataatgttgaatttcagtcgtaggagatatttaagaattggttgaacaaagggggcaattgactttggtggttagtgtgggagacagctttctaattttagagtttgcagccataacattatgaagctaacgaacaaaaacaagccatgtagataaaaccaggagaaataaggatctgaaaaatggaccaaatcgatcgagttctggcaatgagtgcttccttttcgtaaatacaagggcagtgctctgcatcttctccctctctcattttctctgagaaaggaacgtgccattcttttttctctctctcttttggcattcctttttttaacttttaagttccggggtacacgcacaggatgtgcaggtttgttacataggtaaacgtgtgccatggcggtttgctgcacccgtcaacccatcacctagatatgaagcccagcatgcattagctattttaagaggaggatcgatttcaccctttttggaaaactcaatctggggcctgctttccccaggatcaccgtaagattctacctgaggagctgagttttcctaagaatgaaaaagcaaagagacccctggttttgtatttgatacaaagtcaaacgctgtttttctctgagtctgtcctggaataatccagtgacatccaccatcatctgcatctcccatggaaccaccacatgtgaagtcgaggctgagcgcagggtggctgcaccatccacatcaacagccagcactgccttctgccagtttatgaggcaattcggctgccagggagaggagaacagtgtcccttccaatccgatgagtaaatgcctcaggtgttaggtaaaaccccaaggtttttctcttctctggggccaccctcaggaaaggaaaactccaaaaacttctttgggaaaaagaaaaaagaggttgccatgtgatattagatggcatgaattaaatagatactacttattaaagttaaaaaaaaaataaagcctgcatttgcatggtaatgggacctggcagatgaaaccagaaattgatagaaaccacccccaaatcatcatctaacctgtactgaagaatgacgcacataatgtacaacaggcagccattgtcatgtgtgtgtatgtctgtgtgtatctgtgttatcaggcaggtagtgaagaccaggagggagaaagtagtgagtcagcgaagatggtatcccagttagagaaacgacacaatgaaggcatgaagtcatgagacagtgtggcatgtttgggcaacacagatgtggttgggaccacaaaagttgtgatcaaggaaatgtgttggaacaatgtccgccttcacaagattaaatttgtttccagtgatgattttattccactggtgggttatttgtcaatatgttacaggacttttaaaatgttcataacctttgatccagtaacacctcttttgctaatctattctaaggaattctcattacagaaaaacaagcaaaagcaaatgaaactctacctacaacgtcactttatttgcctttcatttatagtaagaaacaattggaagcacttaacatacaagcaggccaggcaccatggctcatgcctgtaatcccagcactttgggaggccaaggcaagtggatcatgaggtcaggagttcgagacgagcctggccaacgttgtgaaaccctgtctctactaaagatacaaaaaaaattagctgggcatggtggcatgtgcctgtaatcccagctacctgggaggctgaggcaggagaataactagaatccaggaagcagaggttgcggtgggccgagatcacgccattgcactccagcctgggcgacaaggcgagactccacctcaaacaaaacaaaacaaaacaatacaaaacaaaaaaacaagcatatcaagggaatgatttaatacatgttgatacatccacaagatgtattgtgccgcaactaaaattatgtttacagaatctttgacgtgggaggaaagaaaacttgggaagtatcattaggttcaaaaaccaaaatacaaaactgctcacacccttccacttcaacttaaacaaaaagtatattacaacctggaaggaagtccactaaaatgctattctgtttgtctgatacaggatggtaaataaatttacttttcttctgtgttttaatatattttttggagtttctctgatgaacctattctatgtggatgattttttttttaaaaaagtataatctggtgtggcagtatgagcccaacatatagtgcatccctcctaccgaatgctaagctaaaactctgggcagacacacactcaagtgcatgcacaccccacacacagacagacagacacacacacacatttgaaaaatgtgaagagcaaaccaaagcagttgggtaggtggattgaagagagtcaaaacttggagaggtgatttcactgagaagagtttcctacattaggttatttttttcttcttaggctttgccttgggactgggttctagtcatactgcagggggttggccaggcaggtagctaagagtcccgttgaatttccaaccttctggccagagaaaccaggaaaagggacccctatggggaaattttgaaaaagagttcgttggggttggtggtggttgtggtggtggtggtggtggtgattctctcctcagctagtataaatagtttggtacataataggtgctcaataaatacttgttgactaaatgaattaaatttttgagaaaaaaatccaccttggagattgacacactatcttccaggtagaccaatgcagccttctttccagtacaggacaagttctgtttctccactggacaccagaggaagtagtttgcatttaggagggtttcatctgaaaaatagggaaactcctatgtttacacactagagtcctcttcagtgcaatgagcattcacagtatgagaggctgaggaactgaaaacaggtgaagagacagctgaattctctttctctctgtgtattgattctggagcatttgcgtagtgagtggaattttaggtgggttttttttttttttttacaatcacataattcattcctctgactctttgtccctcctcttttcttttcttttttcttttcttttccttttgcttttcttttcttgagacggcatctcgctctgttgcccaggctggagtgcattggtgtgatctcggctcactgcaacatccgcctgctggattcaagcaattccctgcctcagcctcccgattagcaggaattacaggtgcctgccaccacagccacccagctaatttttgtatttttagtagagacggggtttcaccatcttggacaggctggtcttgactccctgacctcgtgatccacccaccttggcctcccaaagtgctgggattacagacatgagccaccgcgcccagcccctctttttctttttatctctttctcttccttcattccccgggtatgtagttaaggccatggttgtgaagtatccgcatgatgcatctccactatacaccgtgcttgtggcaatggaggaggcaaaggaccacagaggaaggacccttaggtggaaaagccaactctgtccatgccccacctgtaaatgtttgtgttgcagaactttccccttagttcagctaaaactgagttcttgtcaaacaaccaggaaagactgggctcacagccacataaaagggtgagaaacagaagttattggacaaaaaggaataataactctcagcaaagcgagaaagggtcctgcttgcaggtctcccgcctcatagattgaatcccaggttaccacagaaacaagagaggccaggctcctccccactgcaaagggcacaaacttccttaggctccaccccatcctcccagtgcacaggtgggcattatatagaaagagttggtcgggaaagggtgggcttcatccaggaccagcagtccagtttttcagccttcaggctattttaggctcgaaggcagggttttgctggggacccttggctgtctcttgtctgtatcacttaggctttgcagttagaacacatcaggccagtctctgcatttatttgccttatcacaagcctagagaatgtgtacccatccctaggagagtcctcagtaaatgactgatgggagctgggatataaatcccccagctcccttgcccttccgagtcacaggttctgccctgcctcctggaattctccagtgggaatgtacttgttaatgcttccctcatcagctcccttcccctccctgcctcacttcctcattctcctgcccacatttcctgggatgacccaccaataaagtacttgctgttaaatcctcaatcttagggtctgctcctggggagcacagactaagagtattgaggtcctggttgtcctgattctactatccagtgggctcatgtacaaaaaggaaaccagaagtcacgaggatccctcaggtggcctacagtaaagcagggaaaagatgaggatcatagcagggaatgtggtcataaagagggaagggatggattcctgggaaattttcccaggtggaatctgtaggacttggcaaccgctcgtgagtgcagtatggtgggaaccaaagaagcctttcatacgatgtgagtgtctaacccctcaactgctgagaaaagggatgcaggaaaccccatggctttggaaggagtaagtgggaagggccggattttcagttaagtttaggatatgttgagttttaggtgcctgtggatagtcatgtatcatttatggtgacagtgccacagggaaggtatgtgtcaaacccctaataaatacccactgaattgaaaataattctttttccaagtgcgggttttctaacaggggccagccagacatttatgagctcaggcagatgaggaaagcatgatacctggatcacgtgtgctcacatctggaatacatgcgcaaattaacacagctgtggaggcaggagtacatatgtgtattagaaaaacaagccccacctgtagagcgctgcaagatgcctccagctggtcacaagtagctattgaacatgaatattttatcagtgccagagcagatagagggaaactgtatccattatattctcatcaccatcacatgtggttgaacgggcttccgactaaagaatctaaacatgtttaaaacatttttcacctccagtaaaactagcaagtcttgatttgtgttgttattgctcctgctagattcgtgaaatatttcagaggcaattgcatcttggaagtgtggtttggcaaattttcatccaaagcgtatgtttttgttttattttttaactagcggttcaaacgtggggaagttgacattttagagcaaatggtagaatatgtggggttattttctgttgctgtttcatttttaggttcaacttttcaaatatagagctggattaagtctcactagtagcagaaaacaaagtctgtttaagtaaatgtgttttcaggatggcccaactgtacagaaacttgcagatctcacgttctgatcactccatcaactgctgcttctttaaaatactcaagagtcacttacgatgtttaattggcatgtctgtctttcaaaatgaaaagctacagggtagcttgtgttaaccacacaacagctggttttggtcacttggtaggtgacaatccagtgaccacaaccaaggaggatttaacaagggattttatgccttgcaatgcggaagagcactggggaaagttcccgaaggggtgcctcccagaacacaaatgaaaacagggcttttactgggctggcgagctgagtcactgtatgtagaggtgtagtgaaggcagcacatgctcagtcaccgatcatgctgctacatacttgtacatacttactgtctatacattactcactcatgtataggcagtggtgaataagctcctccctgggcctggttagtagtatggtaatacagatagataaccgaagtacatttccaactcagacatctctggatccaaccagcttttgttttgccagggtcgggcttctttctgaaatttttgaaacaaaaaaaaccaaggtgtgacagttacaaggggctacttcttcacagtgcataccccaaaaccttgggaccctggagcatacccccaaaaccctgggaccttgggttagacttggacttttcctgttttcttgttactcagcaaccaccacaatgcctggtccgtggaaaatggtcaataaatatctgttggctggataaattaatccctaaatgtatgtattaggttgttgcaaaaaaaaaaaaaaaaaaaattagccgggcgtggtgtcgggtgcctgtagtcccagctactcgggaggctgaggcaggagaatggcgtgaacccgggaggcggagcttgcagtgagccgagatgacgccactgcactccagcctgggcgacagagcgggactccgtctcaaaaaaaaaagaaaaaaatagaaatggcaaggaataaaatttgccttcaatgtgcttatggtcttgggaggagtagagtaaaaaaaatccctaatttctattgatataatatcattggatagtgccatgatagaagaatgtcccatgtgcagtgagaatctagagagaaaataagtgattacacttaaagtagagagtcagggaagacttcctgggagaggtgacatttagactaaagcataaataatattgatttgtttgccaaatggaggaagcaaagaaggatcctgagtgaaagcatgatgtgtctgaggatttgcaagtcgatcatgaggttgcagcatacatcacatgggagagagttgctgactcttcaggagagcagatcatggtatgctaggacaatcagagtctccactagagcatatgaagggcttaacataagggagtgtcataattacatttatgtttggtcagagcactcaggcattggattggagaatggagttgagatgagaagcagtgaagcacttgctgtagccatcataaaaacctggatcatatcaatagatcgtcataacttggcttcaacaagaattcataaaaccaactcctctctatttcatagtttcatcattttatggaatatcaaaaacctaaagagaaagagaaataaaaataaactatatgaacttctccctgatgaagcattcagtcttgttttcctggatctcatgcatgttaaatacatatttagatctaagccactatatcaaggaagtgaaaaactcttattccttaaatatcaatatgtgcacaaattttcttatacccacataattttagtaaaactttggagaaaaaagtttccagagttctagggctttgttccatttttggaaacagtaattttagaactctctgctttgctttacttattcattttatctcccgctgggtttccttcttgatttctatacctttgtgtctgcattaattaatttttctttcatttattcacacatgcaaccattgtgtatttggtctatgtatcagttagggcaggctaattactctagcaaaccagcagttaacaagaaaccaatcccgttggcagggaactgcactgtgtgaagacattcagagatccaggctccatctatcctaaagcaagcaaacaggctttgagagggagacagagacagagacacagaaagacagagagaaaaagagagaggaagttcttggtgattagaaatttgtgtttctgtgcggtatgtgtatacacaggtggtatttttctatttggagggcttaatgtgtttttaggtgtttgtgggttaggagttagaagaaatagccaaaaaggaggtgtaattaaccctttatctctttctcttgatgggtaatgtggttacttcctttttgttagtttccccataatattatagtaaatacctgagtgtattatgtgtgtgtattttgattatttctctgcactgtgttcctagtagttaaattacttagtcaaaaagcatgaacactttaaaggctatcaaacatagttacattgtttttcagtaaaatatctgtacctttttctttagcatcgaggtatctatttaccagaccttcgtgagcaccgtgcagtttattttttaaaaatatttctcaactttatagtcagtatatttggctattaggataatttcaggatatttgaggaggaactttaagaccggcttataaattacagcacttataaaggaggaaaacatgtggaactcatgtctggtacacatgattctaggaactggtggtgtttggatggcagaagttacaaggaacgcaaaagcagggagcgtgagccaacaccagattgacctcaggcagctgatgctatcgaaggaaaaagggaggacttccatgcaactccagaaaacaaaaccaagacacctgcggtagattctggtttaacaaaagggagaattttctaaaaattttctatagatttggttacttcacaaagcattgagcaccccaggataaaagaatccaactgagagtggcagctttactcttattagagagaagatttctctattaaagacaaaatcaaagcgaaatcaccaacatcttactcatttacttattagacacaatcgtggagcaaatactctgcaccagctactgtgctaactccgttacctggattactcaaattcttacaataactctatatttatttcataattgctttatttagtaatattttaagtgctttttagacacctgctctatgcctgtcttgtgctaggcaccagggggcgtagcagcagaccaggaaaatgtagagtctgcccttacggagctgggagccttgcatgaaagactggcactgacgacacagtggcactgaatgaacgtgtgatcagaagctgagacagggctctaggggaaaaaggcaaagtgcagccaatcctcatagcaaaagagaccgaggaagcctagaagtggtgcttgagtggagagtagaaggatgggtggggggttaaccaggcacaagaggggagggacgggaagggaagtcacaaggtgagaagccctcagacaagcacctgcaattggagggtgcgtgcagctgagaagcagagccaggaggacagtgatagcacttgaggtcagagtggtcatcgggatccaagcctgctggatcttcctggccttaggaaacccagaggcttcatcctttggcaaggggaagcctatataccctgtaggcttaatgacggggagaagaatgtttgtaaaagatctcgctggctgctgaagagagaacatctggagttaactctccaatttcagactcccctgatgaaaactgttacttctgttctccactcccttatttgggcaaagcagtttattttctacccgaagcatatctactaatagaaatgactgagatattcattacgttaggaatgtaatgtaatgattcttagatggtgattcagatgattagttattggaccttcgatgcattttttattttaattttgagattggccgtccccaacgcctctgatgtgtgactttcattactggagatgttgtttctgatgttgctggcggtccctactgaaaaggatgcatgcatgaagactcaaggcaacagtgacttgcacccatttctaacaatgacttgcacccatttctcccgtatgggggtgcttgataagcactgagtggtgtaatttacaacagcttattggcttgatgccatcctatgaatccaccaaccatcatcttctctgaccctttaaaatgacttccctcacaccccctgccatgagatgatatgaagaactaacaacagataatttctatatcaccacattttattatcagcataattctatacagtaaatctgcagtgggtgacttagttttgctgatatgtggcctctagaatattgggaaaatagatacatggaaatttagggagcttgtatcttgcctctccaaccttttaaatttgctgcagaaagttggatatttgttgggtttttcttccttaagtaggcaaacttcagccccaggaggcaatgaagcaaactttaaatgtagccccaggtacttcaaagctggctgaaccatgtgtttgattgcatacaaaatgtgaattgagtagcacagaactgtcctcctagcaactttgtagcacaatgagatcagctgcaagaacggaataaattggagattggcttctgcagttccattcatttgcaaaaatttgcagacaattaagctgtccccctgcagtataggtagctccttttagccaggggctggagatttgttctctctgggaaaatgttaaagctgtgattatctagttatacctgaataaatggatcaaaggacctctccagccaagcacagacctccttgaaaaggtagtctccagcagcaaccctggggaggtttatagcaaagtgtttttagagcagatggttctggagttacagaggccaaagagctgaatgacttgggatgagtcttttacatcttttaacttcaggaaaacagccatggtggttctgccagcaagtcgttgaatggattaagtgagataatcatacaatgtgtttagcactgtgcctggcatgtaataaatactcaataaatggcagtattttctatggcagacttggtgaatccaggactaggatcccaggcaaatcttagggttataaaggttagaaggaaccaggttatgtcatcttgagtctagaatataagcttcaaactctccaaaggaataaccctcaggtccttgaactcaaacccgaagcatcacatctttgcgtgaagcctgcaaaggctcgctattgccttggaagcaaatccagtcttcttaccttgacttacaagactgtccataattgggctgggctgactgcatgagtctcacctttcactgttctcccttaattccctgcctgcctggaagacgtatttcagcttctgcaatgctttgccttgctaaaaatatctcctcttagcaaacaagtttgcccagaagttatgaaagtaggagagggaacaaagatgatagaggtttgtggtttgtttatgaggttttcactatttctccctatcactttttctattatgcaaagccagggtccaggagggcagaaagagggaatgaggacaaattatctggacactgtttgtctgtttgaatgtcagcgtatttaggagatcctccaacaggtggccagcccgggtcaagctgcgtctggccttgtgttcaggtgtgcaggaagtaggatcattcctctcaaatctcaccacttccttcagttggctgttagggaaggcttttatgcccttggctgggtgtgacggaaaggggcagggacagacaaaacttggagtgcggtcccagctgtagaatgccagtctggcagacataacaaaagtgagcacttcttcgcttttgggacaccttccccatttggtcttgacattgagcaccatgctttggcaggtgtcagaggttggctcccgggaaatagaccacgcaaccggggaggtgttatcagcatccatacctcacggggagggaggtcagggggatggggcggggaaggaggctgatggaggagttgctgactgcaggtagctggaggcctcagccttcctgggcagcagggatacgggcagggatgtcccctgagcatggtcccacctggaagccagggggctgaccttgacacactcctgaccagtcagtggatggcgctgcagccccttctgtttagtcttcacatcagcaatgaaagagggtgaagttcatggaaatattgtggggacatatcgcatggtttctgttcatgaaatgtccagaaaagacaaacatatacagccagtggctgtggtaaagtgggaatgactgctaatgggcatgaggtttcatttaagggtgatggagatgttctaaaattatatgtggtgaggattgcacaactctgtaaatttcctaacaatcactgtgttacacacttaaaacgggtgaatttcatggtacgtaaattatacctcaataatacttttaaaatactgcaggcgagaggggctccagccagagaaattgactccaactctccctttccacaaatcaaatgctcagatttgcattgtgggaggagcctgagtgttcactgcaggacaatgtaggttcttcagggagtgcagaccactttcacatgcagcttctcatttcgttctgataacctagaggacgggcaaatcatcgtaggacgatgagcgctgagctacagtgaatgtagcttgttatcttacgacagacctgggagaaggaggaaatccaactaatttatttacttttatccctttgagtctattctccacaaagcagctatgatctgttttattgcaactggactcctcagctcaaaacccttccagggctcactcctcatgcggagtaaaagccagggccctctccatggcctacgtgcctctccagggtctgacttcccttcaccaggtccagactgtctccttcacctcacagcgctcaccttgcccacgccagcagctgccacactgaagctccgccatgcccggtaggcttctgctgctggcagtgcctcctcctcctgcccccttggcccattcttcctccatcttccactgccatctcctcggtggaccgcttcttgcctccctgtctaaaacatcagcaccctctccccctgagcacttccagccctcctccctgctgatcttttttctcttgagccatatgtgttctctttccctttctgtggtttgccccctctctctacaattgaagcttcatgagggcacttgcttcttttaggcactgcaccatccgagatgcctagaattatacctggcagagagaaagggcttggttgatacgttttgaagaaatgaatgaaagaatgaatgaatgacttagttaatatgaatctattctctcgctccttctcacgttctttttctcttcctgccttcctgtttccctgggcctccaccctcccttcccaccctcaacccctcccctgcccctcactgtttcaggggtctcccctttatttctgatatgtgttctttggggcgagtgttgtggtgcttccagacagcgtgatacttgcttcccctgagattgggaaacagggaggaaagcaaatgaggttttaacctcaaatgccctaagacaggaagatgaagaccttgcttagctgcatgaaaccggagatctttgtgtagggatgacagtcctcctctaatagaatccagcatgcgtgaggctccctgaagacacaacactgcccctgtgatggaagcaaggctggatgaggctgcagcaggcctcggatgacctaggctaaagatgctgcggatcactgtccggagactgctgtggggggaatcccacaagtcacacatggtctggtgttggtggcggccccagaacctcactctcctctgcacacctctgcgtgcctacgtctgttcctgtgactgaggggattgtgttcagcacactggaagtgcgaagacgtgtggcatatgtccgtgggtctaggcagctgatgcatgtctgttgcatgtacatctgctcgtgagtgtgtgtgtatgtgtgtctatcagatggattctggtgtgtgtgtaaacccgcatgtgcataagtgtgtgcatttgatgtcacagagaacatttgacatctgcacgcgtctagtaaatctggaaagctggaaggggctgcgtgtctacatgtgtctgtgtttcagatctggccttaggccatccacagccgaattactcactcctgatacagactgagtggctcaccctcattttctcacttcctccgtcctggtgttaataagactcatccttcatttttctaccgtttctgcagttctttagagagtgcagaccactttcacatgcagcttctcatttcattctcataacctagaggacgggcacattatcctcctttacagatgagaaaatttccttcaacccctctgtgtcctgtctcgaggggagcagtattgggcctcttctctgaggctgatgtaactgctgattcctctcacacctcctgtgggcatctcctctgctctcttgcatcttcattcattctgtgtttctttcttcaccactgtgctttctttcctctgaccccttcttcctcaaggtcagccccattccttgtctcccatttaactgaagaacttctttccatagctctccttttcttctatgccagagtcctcactgtccatgtaatcgcctagcacacaccaaaagctgctctttctaaattcagccgtcatctgttcatggtcaagcctagcagcctccgtgattttggaggagacctctgccttgtgtaacgtggctgtgcactgttcctttttggaattctcctctctgtgcttctggtttttctgctacgctgactaaactttctgtggcctttgctgaaactcatcagatggttacgttcctcccttttcccttttccctcttcccataatctgggttgtgccattgtctccatgtcttgcagctactcttgtatatgagtgattgtgacatttgtctccctcctgaatgcaattcctcatgtcccctagaaatctctgcttcacgtccagcaggctcctcaacgtcaacaggtctactctagcactggtaccccaaaatgcctttttaaaagcctttgcccacttggtaatggcaacaccagaagtcaagagatcttattacctccctcctttacgctgatcttcagttctttcccatacactgctcttctgccttttgtaactgtctcttgaattgattacattatttttgtcaccaccatttttgtgttgtccttctctgagtttctggccacggattggcaccctcacaggcttcatgcatgaaatgacagatgcaagtacaccacacgcacaaacacagagagttgtcccgaagcagggtatatggatgtcagtcaaatcatgtatgatggttcttacacggtcccagtcatacagaaacatatggcagaacacacaaactcattagcacagactcgatcaaaggtgggtacagccacaaatatagaagtagacacttggccacaaacacatacttatagatatacacataaatcacaggcaaagatagaagcagagccacaggcccagaaacgcagagccatggataaatattcactgaagtttctcctaatgtcagacaaaaacttaagcatcagaagaagcaggatgtcctgacttcagtcgttccttaagatgcccaccgtgacgggcccagagagtcgacatgcacatggtgacttctctacaatcaatacctccagcagcccccgaaccctgtcccttccaggtactgtttttcccgaatcagagcttcctgcttcttttcttgggcactttagatccacggattaacacaattgtgccacttgccatacttctgggatgcgccgtaataatcaaggaaatggatgggcagctgtggagttgatgagctggtgagctgggaggacaccagaggtaggatggggatgggattcagggagctgaccactctggacacccgtgaggacagaaatatcacccatttgtgggtatgaaaacacaagaaagcaattcatgacactctatgcaaggttcattattgatgacacggtgtgctttgtcattactttggacacatttagacatacattgtcatcatgaactgaggcctatgtttgctctaggatgaagcccattcaccagtcctttacatctgcacaaagtttacgtctttttaaagtgtttctctagaccagctctcatctgaggctcaagatatttttttaataatgaatgatattcagatattacaaatatattttacgtatttcctatttttgccacccttaacaaaccaacagaatcttcatagatgttaaatatcagttttgtgtaaatacaacgcgctctaattttctttcttttttttttttttttctgagatggagtctcaccgtgtcacccaggctggagtacagtggcgcgatctcagctcactgcaacttccatctcccaggttcaagtgattctcctgcctcatcctcccgagtagctgggattacaggcaggtgccaccacacctagctaatttttgtatttttggtagagacggggtttcaccttgttggtcagcctggtctcgaactcctgacctcgtgatcctcccgcctcggcctcccaaagtgctgggattacaggcgtgatccgctgcgcccagccaatgctgtttctttgtttagtgttgggttcgttttgggtggttggcttttttgttcgttttgttatattattcttgctttttcttctgtcttatacagaatctagttttctttgcctgcatattgagtccttttcacttcctagagactaaagtgtctcttacttagtctctttcattgagattttaatattcttctgtgatcactatagtgtatacaaaatagaatgcattgaatatgatattctatattttcctacatagcttgtcttaaatattctctctgctagctaggtaaattggagcagtttgcatgcaacctctctgaactttcttcattgattaaggagggataagatttactttggaggtctgttggaaatatttgagggggctcatgccaagtgcccagcacattggccagcatacgcttgctgtatcattattatagtagtttagagtagtgatggtgagggcattggagtgatgatgatagtggtcggaacatggtcttcacagttgccttattggtcatagcctaggagtattgcctactaacaaacccaaatgtaactttgtccctgctatggaacatttaggatgttttccatttttgccccttataaatcatgtctcactaaacgtcttccttcatacagttttattcttcttttgaatgtaacgtttggatgggttcctagcagtaaaattactgagtgaagggatatgtgcattcataaagctctcgataaatgaatattgcctgattacttttcacaagggtgctatgaatttatactcccacccaaatcaagagaatggctatttatagatgctttcagagccttagcttatcttgtttcctgtttgaactttattacataaattttcctttaaaactgtcacacacacacacacacacacacacacacacacttttatggggccttggggccaaagatggaatgaaactatcatttatcacatgattttgataggaagctgttgttaggattgagatgcttgcttctgatgatgcagaagacagttttaattagtatgtggcattaaataagatcagtttgcatattggaaatgatattctttttcaattatctttcagtcctctgatcagatcaaagaggaagtctcagcttggtgctaacacgcctttaacaccgctctggcccctttttacctgtaagatgaagagctttccataggcaacagtttctagctcaaatttaatggtgtcattaggtctccagcatgtttatttttatgttttccttcttttatgtgaagtgatactaatgttttatttaaaatgatacaaagttttcattttgaacacatttaattaaaaatatgagttacgcatagagcaaacaccctgacagtgtcactccaataactgaacttgtgacatgctacttggagagtgcattccaacagttgccccactgatcatataataacaacacgtttcccttgacaatacactgaatacaagtctccataatgcctgacatagtttgggactttgtgattgtccctttatccctattcatttgtgagtgtaaggaccttgcagtggctcatgaagagagttgctttttattttttatttttaaaattttttttgaagactcttaacaaagtataaccattttgaaaatgcctatctattaccctagataaaaattacctagtatcggaagagtatctaaaaagatattcaaggggtacaagtgcaggcttcttacatgcacacactgtgtagtgggaagtgtggccttttagtgaacccatcacccaaagagtgaacgttgtacccaacaggtgatttttcagctctcaccctcctcccaccctcccactttccgaagtccccactgtctcttattccactctgtatgttcacaagtacccattgttgagctcccaccaaaaagtgaaaatatgcggcatttttctgtttgagttatttcctttggatcatgtcttccggcttcatccatgtggctgcaaaagacatgattttattctttttttaggcttgagtagtattttatggcatgtgcgtgtgtgtgtatgagtatgtgtgtgtgtatatatgtttttgtgtgtgtacacatctttatagatatgtttatatatacgtatagatatatttacatatatgtatagatacaaatatatatatatatatcccacattttctttttttcttttttgagactgattttcactcttgttgcccaggctggagtgcaatggcgcgatctcggctcactgcaacctctgactcttgggttcaagtgattctcctgcctcagcctcatgaatagctgggattacaggcatgcaccaccatgcccggctaattttgtatttttagtagagacgaggtttctccatgttggtcaggctggtctcaaactcccaacctcaggttatccaccctcctcagcctcccaaagggctgggattacaggcgtgagccactgcatctggccccacatttttttttatcctgtcttctgttgatggacacttaggttcattccatgtctttgctattgtgaatagtgctatgataaacacacaagtgcaggtattgttttgatataacgattccttttcctttgtgtatatacctggtagtgggattgctaggttgaatggtagttctgttttcagttctttgagaaatcatcatactgtttttcatagagtttgcactaatttacactcccaccaacagtatataagcattcttttttctcttcagcctcaccaatatttgttgtttaagactttttaatcatagccattctgactggtataagatgatatcgcattgtcgtttcaatttgcatttctctgatgattagtgatattgagcatttttcatatgtctgttggcccgtcgtacgtgtccttttgaagaatgtctgttcatgttgtttgccccactttcttttgtttgtttgtttgttctgagctggagtctcgttctgtcacccaggatggagttcagtggtgtaatcttggctcactgcactgtccgcctcctgggttcaagcaattctcctgcctcagcctccctagtagctgggattacaggtacctgccaccatgcctggctaatttttgtgtttttagttgagacctggtttcaccatgttggccaggctggtctcgaactcctgacctcaggagatcggcctgccctggcctcccaaagtgctgggattataggtgtgagccaccgcacccggcctacccacttttaattgggtcatttttgttgtttgagttccttgtaaattctggataatagtcctttgttgaatacatactttacaaatatttttcccattctctaggttatctgcttagtctgttgattgcttattttgctgtgcagaagcttttaagtttaattaaatttgaattgtccatttttttttttttttggtcatgtttgcttttgaggactaggccataaatcctttgccgaggccaatatctggaagagtttttcctagggtttcttctagaatttttatagttgcaggtcttatgtttaggtctttaatccatcttgagttaatttttgtatatggtgaaagctgtgggtccaatttcactcttaggtatatgattatccaattttccatatgggtgtttaggccaacaccatttattgaatagagcgtcatttccctatcatatatttttgccgactttcttgaagatcagttggttgtaggtatgtggctttagttctggattctctgttctgttccattaatctagatttataccagtaccatcctgttttggttactatagctttgtagtataatttgaagtcaggcaatatgatgcatctaacttagttcttttcacttaggatttgttataaaaccaattctttattggctgtaaatcaaataaaattttatatctaagcaagtcctccagattcctgaccaggtgagtaatccagtagcttggcagattaagaacagcaatatgcaagcaatgagggatgagtaaatcaagactgtcattgtgaatagaatgatttggaagttgggtgttcaaatagcttaatgatagttatagtgaataacaatgtcagctttagtattattctagtaatgtacttggtaatgctaatagggtttgatggaatacagtgaacactttccaaacagctgtatgctttcccaacaaaggaactctatctcggagcagactgatacatcatttcaatgggagattttaatcaatccttttgttttcccttttaggatatatttaaatttgcaagaacttctcctgtcccaagacaaaagaggtccattgtggtatctcccattttaattccagagaatcagagacagcctttcccaagagatgttggcaaggtaagtcagacaaacagcaaatgacaaaaacatgtttttatgaaaagatgagcacagcagactgagtatgactgtcttggtgaccagctggaattagtcttcatctgtctatgataagagaccaaatggtttagtcatgaaaagaatgttggaagatcattcatatgcaaaagaggaaattggaaaaaaccaatagcagctttgaatattacgggatcaacatggtagatgatgttgaaattaagcaggaagatgtcaatggttaagaaacaaggctcattgcttttatagattatattcaggtgatcaccagatagggccccctaggatggtagtatgttgacatgtggccttcactgagatcctgtttttcaaatatttaggtctacgcgtaccactgggtcggttttccaaaaactaaaccagatcaagggaataaaatcatactaatcatatccagaatcggatatggaaaacactgtcccatgaatcagaacaatagcttttccaggaagaaatagtcactgttaaatgtgccaaaatacggatactgcctcatcagtacattctcccctctttaagagagtcaacatggagaatcaaattttgagcagtttgtactttttggttgttagaaacaagtgctcagtgccgcaaaggagaaccagcactcaggaaaagagttttctcagcaaggcaatttacttctgcggaagggtgctgcttgtacttctggccactgggagagcacaccaaacaaaagagggaaggggtttttatccctcacgtggttagtccctgcttctgtgtcctgtccccattggctggagttggattgcacaatctaagctgacctgattggctactgtttaaaattgaatatggctaattaggcaggaagggagaggctgtctgttatggtacaaggcatgtttgggcatgtcagggcacggcaaaggcgggaagggtagtttcattgggaagagctgttttggctggaggggcagtttacagaatgggtagccaggattaaagaggactctttccaaataagaaagagatgtgagtcacagattgggactaatgggagaagttgtttatagagcaggtagcttaggagaagggacaaggaagttgatctcgagaacaaagaacaagggagtcagaaattaaacgtttgaaaaggaacttactgtatcagacattggtgagcctggaattcgaaaaatggtggttggttaaatgaatgatcttaatggcagttgctgttgaactactaattcattaaatacacagtacatgtgatatgctggactccaagctttggactgggtgtgaagaagcagataataaagctaacatgctagtgggaagacagaaacaagaacattgcagagtatgacaaatgctgtgaaaatcagcaatgggatgatgtgaaaaaaagagcaaatggcaggatgaaggagtagagggaggagggaatcttcacgcagatggctgtgatggctggttggaggtactgatatttgaggggagactggaagggtgagaaaggaacagttacaggtatatctggttgaacagcatctttggcagaggtgagtctacattgcaaaggcctgaagatgggaaagaatagcatgtagtagagtcgcaacatgcctgggttgcatgagagtaagcaaggatgacagtggtaaaagtgaaatcagagaggccagcctgcccttggatgaggagttggggtttcatcgtgcatgcagcaggggaccactggaagatttccccagaagactgcatgttttgaaagatcatcctggctgccttgtagagaatgattagtggtagcagagcagtagagaggagtggaagcaaagagacccactaagaggggagtttggtggtgatctgaacaaaggtgacttggactattgaaaattgatcttggacgggcatggtggttcacgcctgtaatcccagcactgtgggacgctgaggcgggaggatcacccgaggtcaggagttcaagaccatcctggccaacgtggcgaaaccccgtctcaactaaaaatacaaaaattagccagtgtcatggcacgcctgtaatcccagctacttgggaagctgaggcaagagaaccacttgaacccaggaggtggaggttgcagtgagccgggatcatgccagtgtactccagcatgggcgacagggtgagactctgtgtcaaacaaacacacaaacaaaaaatcgatctttattgcaaattgaaagaagtgctaatccaatatcctggtaatcattatatttatcattttaaactcccactgtgccaaagatacctttctctaagcaaaaatctttttaagagtctgggacatgatacaaagggaagcagagctgctctaaagggatagccctgtccccttgggcagccctagccactgtgatgatccttttctagacaggtttcctgggagcccaagatgccagatgccaagggacctgactccccacttcttcaaaactcttcccaaacagtttctgagactcaagatgcattctcgtttttcagttttcttttagataatcctgggcttctcagctctcaccatgcatcagaatcagcagagacacttaaaatgcagatgtcagggctccaccctcagagattgattccactggggtgggggtgaggaccatgcatcaatatatgttaaaatatccgaggtgattcagatatgcagccgaggtggaggactgccggtcttaagcagtcctccaagagtggttgtggaccagctacattagcatcgcctgggagcttgctagaaatgcatattttcatgtcccaccccaaaaccactgagccaaaaactctggggttaaagccaggaatctgcgtttttacacagcttctaggtgattgtgatgcacactcaaatttacagagggctgacctgaaatgcactttctcctcctgtccaccactagtacacaatactttcagttgcaattccattaattaggttataataaggacaatcacatttcagttgcctggaaaatcccagtttacacctgtcgtccaaatctgtcatgtccagatttagacaataaattatgtagccatcctatagttttcttcaattacacacaatttcctccggggtatatttgggtgaattttctcacaagcctcttttcttgagctattcaatgggtccataagcatgcagctaattgggaacattcttctgcattgtttttttacttattacagcttcaaaaagcaatttggtttgcaagctgaggactcacttcttcttagccccttatgtgttgcccatacttgttctcaacttagattctctacaaagcaactgcttttctaagtgtggtaggctactaactagacaatgcgcaagagccttcaaaacctctagatgttttttgtagaattactgcactgctttgcaaaaactatttatttgtccctgctttttatgcctttgaaggtacgtattttcctttttgttcctgcttgtttctatttatctgtcttactctttatatctcctgtcttatcctcatcaactccaccacagctgacgagctgtgctctgcagagctgtggaagaggacgtaggtgttttcagtgagtgctggggaggcagggagaagggaaggaagaccacagaggcagagctctggcctccaaacaccaccacgctcccaaaaaatgtctaagtcaggacacctctaattttataaatattacgtattagacttcgatatagaatgccatttgaagaagagattctgcagctctaaaagtataaagacgtttgtctttggcttcccctagaagtggaccgcaagacaagaattcaaatgaaggcagttcatttcagaggtggaggaaatatttgtaataaagtaagggagagacgtggagaagggaaggcagctaggagagaagcttgtttatgaagccagctacccctgtgggtgactggattgtaatgtcaggggctaactttaacatggtgtggaacacactgtcagcgttacaccacccccaggggatggcactgggatactttgacaccagctggggtatttctactcccagcagtcactggtggagggccgcttccaggggtgtaaattccctggcatatctggtctgccctgcactctgtgcactgacgcgacagcctgctgaggtttggaggagaaccttagacaaaaaggattctgtacagcagccaccagtctgctggtctgcactgaaaagctgacacatagaggatgtggacagggcactgatcccttctgcttcatcaccaaaactaatatatctatattattttttgcatacttcatttcatcctctgcttttacctcatttcctgaactagcattctcatgtcctgggcttttgaaaccccctgtacttgcctctctctctccattaataagtagttcctgcatcccaggagggaaaacctctgaaattcaacctaattcatatcaacaagcatatattcagcatctgtttttataaggaactgtgctaggggctgggaatttaatggaggagaaaacagacagaatcattgatcttgcgggattacaaaagaggtgacaatatcagcacatagtcattatttgtccagcactgtgctaagcacttttcatctattatgttgaattcttatgataacaaccacatgaggatcattttccagcatgccaatgaaggtaatgagactcaggggtgacgtaacctgtccaaagccacacagctagttcataacagagccaagctttgttactgctttttgagatttcaaagtctgtgctcttaaccagtatcctcaggaaatactaagcccaatctgagaatactcttccgtggaatgaaatatcttcactgacaatttctctttttaaaacagcattaaaattgagtgcaattcttggcaatgcactcaaaaataaggtggacagagggttggatcaatagatcgatatctgatatgtgataaaggaagtatattaaaatgttagtggtagaatataagttggtgaacatatgggtacttgctgtacaattctttcgagttttctctgcatttggaagttttgtaataaaatgttgggaaaaattaagtttaactaaatataaaattatcataaaagacacaggagttagcatgctggcacaaaaacgccttttaaatcatttgtcttgcatttcaagagggtgaatggagacaaagtacgtaactggttcttgatttttttggtcatattttattacaacctgaattcctgtaaagaaaggagactcatatcctgaagaatgaagacatcaaaagcaaggtgctgtggcaagttagcccttggtggagggtttttcacaactggatatcctgctgtgtagaactgaatacccacagcagggttattcaggcagctccagggatgagagaaagtgtcttgactgatacataatttatctgtctgccaagtaattagttggttggtaagtagctaaactactagaatttgggatctgcttttccgtaatacgagggaatcatattacaaccctgagattccaaatcactgctactcacttagatagcaggtggggagtataagggggtgtatgacccccccccccccccccccgcccacagacacacacaggagacaacccgagagatcactgccagccctgggaaaatgagtttgcctcctaatttctggctcttttccatggtgcattctgccctagactatctgtcatagttttggaagacaaggtaaaacacccagtcgtgaacatacttgctcatacctgtgattttctttccatttttgaactctagacagcagggaggagctgacagtgagtgctctggagaggaacatgcagatcccaaagtggctttttcccctcccccttcaaagtatgactatttcaaaatttgggccataaataatttctcagttttaccaactttcactgataactaattgattgcatctttaaagatttttgagttcttgggcccgattgattgagagcaggggactttaaatctgtaagccagcagggaggtctttgggagatgtattttattctgttttatattaagtttgaaagacaagtcatttatgaaatgcttattagagattctgctttcatcacaaacccttttcatcaaaaccaatgaaagtacttttttacagaaaatcctgttttaaagaccctataaattggtagaatgggcatttagaaggccatctttaacccaggatagaagaaatatgtaactgggccaagtgctgtttgtaaagggaatcaacattgatcattagactaaatcatgaaaaccactcaaccaggactccgctttgattgtgtcatgaacgtaagtcagacatgacggtaatttacatcagctttgccatgttcctcagtgttctgtgcatctgattcttagaggtctcactgcatccagatactctgtacctgagatttatgcccacctatgcgaataggtgccaaggagtctgatagtcttggaatttaatttgttttattctatttaatagccatttgcctcactttgaagacccacgaagaccaagctatatccttagaggctgaaccagaaagctggtactgaagccccagcacctctccatcacccctctcctgaaatgcagactcagggttacttgctgttgcctgattgattttatgatcaggcacttactgggttgtctagggtaacccagtaattgctgtcatccctctacctcttttaaaatctattgttttgtgccctttatctatgtctaactatatacacttttctcagaaatttacatctgcttaatttctaccccccacccaccccccaacacccccccctttttttttttttgagacagagtctttctctgtcaccaggctggagtgcattggtgcaatctctgctcactgcaacgtccgcctcccagcttcaagcaattctcctgctcagcctccctaactgggactacaggtggatgccaccacgcccagctaatttttgtatttttttagtagagacagggtttcaccatgttggccagactcatctggatccatctgcctcggcctcccaaagggtggggattacaagcatgagcacctggccttaatttcccccttttaaggcaactagcagttttattcaataactgaaacttaccataggctagagtataggagaaaaattggaatacagagtatctaagatgcctaaaggctcagtgctcaaaaattcttcttgagatgaacatcacagtttatttctacattcagcagccatagctacacataagcctttcctatttccaagtctttgaactgtcagttcttcctgggatacaccctctgtatccttattccttaggagcagcccacattcacactctaaggctgcactgtcccatggaacattgacattattgcaggaagttctgcctctacacagcccaatatggtacccactaaccacatgtggtcaatgcagttataaagtctttactaattttaattggggctcaaaaagtaacacttcattccattattgggacaacttggcagttgaatgtacctttttcctgatacattttaatctatttacagataaaatattttttactgaaaacgcaatgtccacactgagatgttttgtaagcgtaaaatacacattggatttcaaaagcttatcacacgaacacaaaaagaatggaaaatgtctccttaataatctttgtattgatttcatttggaaacaaatcccttgtatttcttttcactttttttttaacgtggctgccagaaaagtattaaattattaatatggctcacgtatttttatcagatggtgctaatgtaaataaggcctatttttgatacagtctctcctcagtggaattatgtttttgagacagagtcttgctctgtcacccacactggaatgcagtggcgtgatctgtgctcactgcaacctctgcctccggggttcaagagattctcatgcctcagcctccctaatagctgagattacaggtatgcaccaccatgcctggccaacttttgtatttttggtagagatgggggttcaccatattggtcaggctggtctcaaactcctggcctcaagtgatccacctgcctcggctgcccaaagtgctgggattacaggtgtgacccactgagcccggcccatggaattttacttgatctcttttatacattgtttatacatctttgatggcacttaacacattttgagagacaatgtccttccctgccttcccactaactgtaattcatcagatgcggtggcccaggacagggcctaacacagagtagcgactcaaatattctctgaattgaattctagccatatgtatggctgattaacatagacattcactgcttactgattaattaaagtgatcatagcctgctttgttgttagaatggaattaatagaccattatatgatcagtctggatatttccagcaaattttaattttctaaattggtaatgaggccaccagataaattgcttggcagtcaactattatgtcaggtcatataagcattcttagtagatttgttttttttctttgagacagagtctcgctctgtcgcccgggctggagtgcagtggcacaatcttggctcactgcaacctctgcctcccaggttcaagcagttctgcctcagcttcccaagtaactgggattacaggcgcccgccaccatgcccagttaatttttgtatttttaggagagatgagctttcaccatgttagccaggctgctctggaactcctgacctcaggtgatccacctgcctcggcctcccaaagtgctgggattacaggcatgagatgctgtgcccagccagtagatcttgatagatttgatgttgatggattttatgtggggatggggtggggggagagagagagagagagagagagagagagagagagagagagagagagagtgagttacatgactgtatttctgaatttgcctatgtatatgatggtgttttaattccaattaaatgaaaacactcataacttttatcttttttcacaactgaacacagtcaattctaacttatttttgctaagtctaataaaagctatgttcaccattcgcaagtgttgccctcctgcaaattttaattaatgacaaaacataatcgggtggttttggctttttgccaaatacatatatatgcaaaacttccctccatgatctacatcccgcaaataaaggcatctgagcccaaggaggaagcaatatttttaaccctgagtttatcaccctttcggttctccattttaaaggttcctagaactttattgttattatgaacatctggcctcagactgaatttatatttaattatttgtgaacattcaaggaccaggcatttcagcttgaattagcatccagactcagggttgttgaagaattttcaaattggactagaatgttcactacctaatgaatgtctggatctaagccaaacatggctaaccctactgtcctgcttagtttttacaacagccctataaagtaggcaatcctacactcatttctcagatgagaaagtggaaattaagagagattaagtaacttgcccagggtaaccctcttaaagaacggcaatgctgagacccaaaaccaagactcttcaatgccacatcagtgatctgtccaccacaacgtgtgtgaatgcttaaagcttccatgggtctttgctgtttgcatagcacactcacacaaatggtcatttgactctcataagtaccctcagaaatcaatattatgtccccattgtacagtggaggctctgaactgagcatgaccaaggtgcagaagcatcttgcaaaacagtctatttgtggtacaaactgagttgcctttctgtgtcacctgcaattgtaccagggctctggatggattttaaaatagcacatggcatgagttaagccactatggaaaacagtgtggagattcctgaaagaactaaaactagaactaccatttgatccagcaatcccactactgggtatctacccagaggaaaagaagtcattatatgaaaaagatacttgcacacacacgtttatagcagcacaactcacaattgcaaaatcatgtaaccaaatgcccatcaatccacaagtggataaagaaactgtgacatatgtatatatgatggaatactactcagccatccaaaggaatgaattaatggcatttgcagcaacctggatgagattggagactattattctaagtgaagtaactcaggaatggaaaaccaaacatcatatgtccccactgacatgtgggagctaagctatgaggacgcaaaagcataggcatgatacaacggactttggggactgggaggaaaggatgggagaggggagagggataaaagactgtaaacaggatgccgtgtattctgatcgggtgatgggtgcaccaaaatctcacatatcaccactaaagaacttattcatgtaaccaaacaccacctgtaccccaacaacctatagaaattaaaaaaaaaaaaaaagaaatagactttgtctgggcacggtggctcatgcctgtaatcccagcactttgggaggccgaggcaggcggatcatgaggtcaggagatcgagaccatcctggctaacatggtgaaaccctgtctctactaaaaaatacaacaaaaattagccgggcgtagtggtgtgcgcctgtagtcccagctactcgggaggctgaggcaggagaatggcgtgaacccaggaggcagagtttgtagtgagccgagatcgctccactgcactccagcctgggcgacagagcgggactctgtctccaaaaaaaaaaaaaaaaaaaaagaaatagacttcactagaggaaggagaaacatacaagccaggggtgagccaaggatgagaagcatagctcaccatccccctcattccacagggaggtctgccaggggagaaactgggctctcatagctgttccttctctgccggacagcttcagtacaatcttgttagtggacagacgatcaaacaccagggatgttccgcagcctgaatgcagacagcttcagtacaatcttgttagtgggtagatgatcaaacaccagggatgttccgcagcctgaatgcaggttcccagattcgtaggagtggtctgagattccaaagttcaaagtcagatgctttgggtagggatgtgctggaaaactggctctcggaggctggaagccttgagttggagtgtttgcagctactttggcataaattctcccacagcggccagtttcaagctagcagcttacaaaatctctgaatgtttaacaatggacttccatgaaggagtagggttgacttcagcacggcactggccttgggactcagggaccgtgacactggaaggggtcagggggcacatgggtcccaggggagctacgcttgagtgaagccctccattgtggagaagtggcttccacacccacctgttcaccccgggttgcagctggtctcatgcccagtttagcagtgaggatcattttttgacaactctgcctgttgcaggtgttaagtaacttgtccaacttcatgcagcaagtgcaacataaaagcaaagctccaccactcttctccttggcacagaaaaatccaagtcactctcctaaggctggaaaattctgcagcaattgtcccagttctacctggaaaatgaggaagggagtgataaaattctctgtgaagtgaggagaaatgaggttaacctcgccaacatttatttgatgtgcgtgtttgtgcgctgagtcagggccggaggtcgtgtcttcgtttaacaaatagaccacatgttgacaagcaaaaaacggctttctttgtctggcaagaaaagccactgcctcgcttcagacaacgcttttttttgttggtgtctccgctgacaaccctgttcaaagagagccacaaggaatgaaagtgaaagcagaaaaagccaacttcggtgtaattaagagatatcactgcccgtttttctcagtgatgaggccgcagctgactcagtcgataagggccgtgaaggagtggggcccagggcgcagtggggatggactggccttttcacggtccaattactggtccaattactagtccaagttttgaagaggattgaagtagaactggatggagatgggaaagagaccaataaagtgttttttgttttttaggttttttttttaagaggggaggaatgaatgaagaacttcttttattttcttttccggcttggagctagctctggttcccaaatagggtcctgggggaaagacgtgatgtgagtctgggtggctgggaacagtccctcctgggtatctgcgcttggcccacttctgcaaccagtaatggaggagacagaagaacgcttgaatgtgggtttaattgttcccatctgtgagtgttgcattaaagatgttgctgtcttctgttgcatcgggtggtttgggacaagtgatgaagaaagagagtcagttgatgcctcttgagcaggcatacactctccctaggctgaaaattgagctgcattaattcagaaatatttactgagcaactactatgtgtcaagcactgcactggctactgcttatggattcccccgagaagaatgcccgtcctaggagagggggcagacctgtaaacaggcagacaagcgctgtgatggggtgctgtgggatcttggaaaaatcgagaaggcagaagaagtaattccgaagaggactcctgaaggacgcctaagagcaggcaacgcgaagctgagatgggaagaaagcgctctccaggcagtgggaagaacatgatccagtatctacgggcgagagggacggtggtctgtccagagaggtgagaataattcaaagtggctgtgatgcaaggaggaaattgtcacaaataaacttggagaaatcatcaaaggctggaagaggaaaaattgtaaaaactactgtatggaatttggacctttttctacggatgactaagtgttatacattggggaatcacacgatcagatttgcatttcaggaagtttagtcctgttacgctgggtaacacctgaaggctgagaaaaccaggagcaggggtgacaaagagggaggctgtgacagaaatccaggagggtgacgaagggctcccgggcaggggagaggcagaaggactggaaagagggcacagtgaagggccatggtgggggataccaggcaacactggcaagcaagtggacagtgatgagtgaggaggtagaggaaggtcccctcttagctgggacattatgcctctataggacgctgaacaaagtaacctgcggaggtgttactttgtgggaatgtagactgtgaaactgaaggaactgttttatccacctccccgtagtttgctctgtgctgaggctgctgtactgctcctctttgaaataaaagagaactcttcccagaggtgacagatccacctgcgtgctgtatgttgcatggaggtgggcgaacaggttatgtggagggttgttcttggaaagacggattcattttgcaccagtgacaggcttgagggaacaccagcgtgtcacacgtctcttcccagtgtccctgactcatccatgcctagggattttactttagtccttccttgctgtgaatttgaaaacttttattttatttttttctactagctaagaaatgtgtaacagctgtgttcactgttggccttctagcctcaaatttattttaaatacatttcttcttagtgatctcttctttgaatgctgatgttggctatgcattagtttacacaattcacaggctctgtgttgctcaatttttagttcatttatttgacaacttgaaattcatcacaagtggtgcttttattttgttatttgcatctggaaatcattcctaacatgccatgaaatacatctgttttttccttttgcaaatcacttttttttcttattataagagtaatatgtgtttattgtagaaattttagagaaaaatacacattgaaaaataataatataaaaatatccggccaggcgcagtggttcatgcctgtaatcccagcactttgggaggccgaccgggtggatcacctgaggtcgggagtttgagaccaccctgaccaacatggagaaaccccatctctactaaaaatacaaaattagttaggcatggtggtgcatgcctgtaagcccagctactctggaggctgaggcaggagaattgcttgaacccaggaggcagaagttgtggtgagccaagatcataccattacactccagcctgggcaacaagagcaaaactccatctataaataaataaatatccctgagtcccaccattggggataaccgctgtagacatccgagggttttacctctctatttttaaagtgcgtatacattcataaagacacagcatcaggctgtaccaccagaggtttagatcccataggtctggggtgacacctaacagttaacattccaacaagcctcctggcactgctgacaagcccagctccatggccggcccacactttgaggagctccacttctaatcatacctattcctacacatgaccatcttgtgctcatgcattttccacttgccaatgtctcagaaaccttcttcatgtccttcatcaacacgtggtatggcagaccattgctatggccaacactgagtttcagggcttctaatgtgggatctactgcctctgcagggacccacagataggtctgttcactttctcatctgatgtatcttttttcttttttttgagatggagtcgtgctcttcttgcccaggctggagtgcagtggtgtgatcttggctcactacaacctcgctgtctcaggttcaagtgattttcctgcctcagcccccagggtagctgggattacaggcgcctgccaccatgccctggctaatttttgtacttttagtagagaaggggttttgccatgttggccaggcttgtctcgaactcctgacctcaggtgatccacccgcctgggcctccaaaagtgctgggattacaggtgcgagccgctgcacccggccgatctgatgtatcttaaggcatagagcatgacataaaatgactgaagagcacctcacgatttttgtttcttacccttgtttctccctcctgggaacggactgacccaaggtttaaggcaccaagaatgcccagcaatgtatttttttcccagataaaggaagatctgccacatgaaaaatgaccagttatcttggtctattgatgcacaattgctaaacagacaattttcacatccattctcatttgaagttcccaatgaaccagagtcactgaagtatccactatttcccttcctgttgcagaggaatccaccttgaagctatgaatacttttttgttgtatttatatttatcaacacttatatcttctccctctcctgattcagtgagatcagagaatattaaagccggaggggctctggaggtggcctgctccaaatacctcacttgatagataagacacaaaatgatttttctgggatcacaagatgggaacagtccttaataaatctctactccctcactctggtgcccttttgcctacacccagtattctgagccttcattgtcctaggaatggctgccctgagcctggggatgtcccagggtttttaggagcctcagcataagcttgacataattgatgtcagcatgttcacaatctctataggatcatttctactgagactaatcttattctttatattttcatttctcttcgcagtgttcttagaggttgattttttgtttgtttgtttgtttttactttaagttctgggatacatgtgcagaatgtgcaggtttgttacataggtatacatgtgccatggtggcttgctgcacctatcaacccatcatctacgttttaagccccgtgtgcattaggtatttgtcctaatgctctctctccttttgtccccaacccccaacaggccccagtgtgtgatgttcccctccctgtgtccatgtgttctcattgttcagctcccacttacaagtgagaatatgcggcatttggttttctgttctgtcttagtttgctgagaatgatggcttccagctttatccatgtccctgcaaaggacatgaattcattcttttttatggctgcatagtattccatgtgcatatgtgctttcactttaggagctcaactagcaactcccccatgcactccctcctccagtgtcagagcacactgcaggacccacccagtctttgaataggaaagcactggctgaaaagccccagaaagtggggatgtaccagtacaagtttcccacctgtgtatcccactgttttgtttggggagaacaacggatataaccgaaacgggctatctggtgagcataagttctacattaagttgtccctgtgcctgaaccatttttgtttgtttgtttttgtttttttttttttttttttgaaatggagtctcatcctatcacccagctaaagtgcagtggtgtaatctcagctcaccacagcctccgccttctgggttccagccattctcctgtctcagcctcctgagtggctggaactacaggtgtgtgcccccacacctggctaagttttttattttttagcagaggtggggttttgccatgttggccaggctggtctcgaatttctgtcctcaggacccacctgggcctcccaaagtgcttagatgacaggtgtgagccacagtgcctggttgccttgggccattcttcatccagctgcctcctactcatcccttgggtctgaggttgaacgttacctcctcggggaagctttcctcaattccccaaactgaatcaggtccttcctcatgtgtagccgttcgcctagtccttctccagagcactgatcacaccagtgattaattaagtatttgttcaattgattatgcagcaaaccccaagatagcagaatctcagtttttcttatttacccttttatcttcagcatctaggatatgtctggtggactaggctctcaataaatattttttgactgaatgaatggtcaaaaaaggccaactccagtggtctctctacaaggtgataaaagagtaaaggggccgggcgcagtggcttatacctggaatcccagccctttgggaggccgaggcgggcagatcacctgaggttgggagttcaaagaccagcctgacccacatgaagaaaccccgtatgtactgaaaatacaaaattagctgggtgtgatggcacatgcctgtcatcccagctactcaggaaggctgaggcaggaaaatcgcttgaacccgggaggcggaggttgccataagccaagatcgtgccgttgcgctccagcctgggcaacaagagtgaaactccacctcaaaaaataaaaaagagttaagggcaggctgtcttggacacatctctacccctatcttacatgcagaacgaatggtattaattttgtgatgaataaaaaatattttttctttggatatattttaaacttggatatagttcacatattataaaattgagtatatttgatccaatatgtcaagtaccattaaatggataaaatgataaatttggtagaagaaaaaatatttaggaaagtctcagaaatttaaatgtaataaatgaatatgtattcatatacatactataaaactcattatgtaacatattacataaagcacattttgtgttgaggagtgagttccctgtatttagcttcatggaaaaaatagtttcttgtagataaatattacaggtgactgaactaaaaatattttgacaatgtgaactacttggatagcaatattttgagttgttttatacactagttccttatcttaaacagaagttaacatactcatttatcaatggagaggtggcatttatcattaggaccatcaaaacaattgtgttaaaatctcagggacaagaatgagtgcagggattgtaagctcctctgctgggtgcttcgttctgctcttctatacaacctgctctgcatcctcttgagtgctttttaaacttccctcgtctcctccttcgtttccaggctttctcacccactactcctctttgccgttcctctgcctgactctattaagataaactaatccttggaatttgctgctttgaagttgatgtcggctgggaaactcatacacaggcgtgtcccagtcctgtggtctagaatcaacatagtgagacgagacagaaggctggtggttgctgctctgctggttaccagctgtttaaccctcggataggtcacactgaaaacccctgggccctgtttgttcttgtatgagataaggctagtaacactcacattccacgtttggggaaggataaaatgaaatcgcctgattggtcatacttgacccacagctagtgcttggtcaacgtgccccttccttctttctctccctacctggagagcctacagatgtggtaagtgattctgaaggtttctcccatgaggaagtgacacaggcttgtacttatttggatagtcaaggcaccttttgttcctgcggttgacactcttccaaatagttgaagttacgtgtaagtgaacaccacctaaccaatatgctactgtatttataaaggatgctaacttgaattagctttgcccaagcagaatattttaaaaaataaaaataaataagaagcagtagtccattctacctgtctgccaatttctatgttctagttaaggacatgggaacacatgatcagcaatacatgatcagatataatcaccacgagacaaggtgtgttaacaactttacgttcagggcctggaacataatagatgcactgtattttttgactaaataaatagctattcctggaggtgtgatgattatactatgcccagatcctgccaaaggcaaaaaggcaaaaagttatattcagaccagctatctctctatttttttccctgctcagggctaaatttttccgaaaaaatcacataagagtccaactgtcagaatgagttcatcacctgggctggggatcccagattctgtgagcagaagacttcatccacccaggtgtctatttcaagaacagtctcctcttttgcaaaagcgttcatggaaatggccttctctcctaacagacagcagctacagagcctcctttccctgggctgcagagggtaggttaatggagactgaggagccctctggagaacagcaaaaggaacacgatttcacccttcttagcatcctggggcttgtgatacagatggcccatgttgcaaatggagacgccgtggctatgttgccacttgcccttgcagacacaagtacggggacattatattcaattttgggtctccatccatatgctgctcctccaatttatttgtctacatgaagggatatgaagcccaaagccagaggacatccaattcggctttaattacagtgatgagctgtttgtcagggtgccatgagctgcaacgccaccttggtcgctgacaaactcggagcaggggtgacaccaactcccctgttggctgctgatcattgaggcttgggcagcagcagcacttagttcaatatttgttgtttgaaacccaacagttatgactctgccaagcttaatgaaagggagaaaataattatcagagagcttatgcaattttgaagaccaggggcttttaaacaaagttaccatgccagaagtgttcttggcatgtcatgaggactgttgccgttattagcgatgacaatgcagtcattatttttacactggcttaattgttcagcagacaccaaggaccgtgtcaacacagttctgcaaatggaaacaaacacgccatcattcagggtcccactttgatattctgcctttgcacttgtttcattttttctttgaagaacattctatagatcgaaggaattattccagacctctgattcatgctaggcttattctcttcctcattcagtctctcaatcaatcaatacttactgagtacttgtcattgcaagacctgaggaatagaggggctagcagaccagcctgggttctgcccttattggaatctttcaccttctactgcagaaggtcccacctttaggtagaatgatcagagatctctctgaggatgtcacatttaaactgtgactctaaggatgaaaagaagccagatttgtaactaatgaaaggatgttccagccggatgctggaactttgggaggccgaggcgggtggattacctgaggtcgggagttcgggaccaacctggccaacttggtgaaaccccatctctgctaaaaacacaaaaaattagccagacatggtggcagcacctgtaattccagctactcagaaggctggggcaggagaatcgcttgaacctgggaggcagaagttacagtgagccaagattgtgccactgcactccagcctgggcgacagagcaagactctgtctcaaaaaaaaaaaaaaaaagaaaagaaaaggaaggagggaaggaaggcaggaagaaaggaaagaagaatggacatttcaggtggagggatagcaactgcagaggccctggtagttgaagacattatgtctagataactccatcaccatggcttatgccatgtaggggtttgtctgtctcacatagcaagaaacctaaaagtaggcaaaagtttaccagtgcagccatgtcaggaccagcatctctgcaatttgtttggtcttcccttatggttacaagctgcctgcagcagctcaggccatcctatctaaggctggggcaggagtaacaggaaggttttaagctaactatatctgtcattttttgtttgttctatttcaagaaagcaagatattttccagaaactttgagcagttatatgtgtatgtcacgttaaccagaatggtattcaacaggcatccctaactgcagcagcagctggagaagtaagatttagttgcaaataccaataattcaagcacaattggagtttggttatcaaaggacaaaataggccatagatatttcaaaaaaaatggtatgttcaaagtattattttaaaaaggccagggatggggccaagcatggtggctcacgcctgtaattccagcagtttggaaggccaaggcagacagattccttgaggtcaggagttcgaagttagcctagtcaacatggtgaaaccctgtctctactaaaaatacaaaaattagcctggtgtggtggcacacacttgtaatctcagctacccagcaggctgaggcaggaaaattgcttgaactcaagaggtggaggctacagtgagatgagatcacgccgctgtactctggcctgggcaacagagtgagactccatcttaaaaaaaaagcccatggaggctgcactccaaaggtggagcgatagcatagtgtaacatgatttttgagatgtgtgaagaggtcaaatccacagaaactgagggccgtgatcagacatcaccaactgtagtcaaccacatgttaaagttgaattgttccgtcttctgttttccacatccaccttcttccgtccaccctttcctgaaggtccgtgtgaggcctgaccttgctttgattcttgcagtcctcttctaactgtgcccctttgcctccacttcctgcctgcacccttgcatctcctatctgtgacttttaaagaaagtaaatctcaacattcctcagggctccctatgacgtaaattccaagcttctctgtgtgacctcaagtcatttctgatctggtgccttatcctgcagccacagcccctgccacttcctcctttcacgactatcttatcacagctgtcctgttatttgtgattctcccaacatccctcaggaacatttgccttccttgaagtcctttttcttcgggtcctttccagagtcagagtgggcttttcttgacatccttatgggaaagggacaactcattcctttgcctttccaccccacttgcgttccacccctaggttgctacacattcccctagagggcttttgtttgtccacctgagtatcttcttcccactggtctctggggtcacagggggcaaagacctcacctcactcatcttggtctctggctctgagcacagcaccctgacaccatcataagctgtaactacaaattcaatggaattagtatgaaggtaaggagccagcaggttctggtggctcactgaggcattactgttcttgtttttgagatggagtctcactctgttgcccaggctggagtacagtggtacgatgtttgcttaatgcaacctcagcctcctaggtacaagcaattgattctcctgcctcagcctcctgagtagctgggattacaggcgtgcgccaccacgcctggctaatttttgtatttttagtaggcacggggtttcaccattttggccaggctgatcctgaactcctgacctcaagtgatccacccgcctcagcttcccaaagtgctgggattacagatgtgagccactgtgcccagtttgaggcattgctgtttaaggggccagagagaccacaataggcacagaggctgagacaacatgggtggtaccatgtagacaacatgtagacaacatgggtaccatgtagacaacatgtagacaacatgggtggtgccatgtaggctcatccctccatgatttgctggaagaactaagacggcagtaggagaagtggataaaataatgtctgtggagtcagactgcaagggttcaaatcccagccctgccattcaccagccagatgaccttggtcaatgtacgtaatgcctctgtgcctcattttatgcacctgcacagtggaggtaataatagtgcctgcctcataggattttccagaggattgaataagataatctttgagagtattccagtacatggtaaactctcgcaccatattaactattgcagtatggtgttattattattatgaatatctaatacagttaatatctttgtacgtaggagttttagcaggcaggtgtgaatggcacttttgaagatgcagagacagatttatccttatactcctaatatttatcctcaaagacactatttaactcattcaaaaatatttactcttttttaaagaccgctttcagctcctttttatacaaaaaaaaggaattctatcctcattctagcaatagtagcctaaagaaaatcttattacactcattatcttaaattaaggtaattgaaaaccactgtttaagagtagaccccaaatgtatcataaaattaattcaattataaataacaagaattgactgtacttgaatgtgcatgaagtatagaatcatagtggaacatttaagaaatatgtccttatcttgttactatggctacatgttactccaagatacagtagttctatggtaaggttggaattacattatttcctctctatattgaaatattcagcaactaatttcctgtagcttcatagtaaatcatgctaatgacctcagaggtggaaaccaaggtggtgagactttctccctgctctaaggttattccattaaacaaagcagagaatacacatttatactcatttgatcaggaagcataaggaagcttataatgagaaagacatggcaatgacatctcatgaggcgatgttaactttaaactcaagtatttaatattatttattcattgcgtccatgataggatcacaacagtgagaaaactagagattcatatgggcaggaactgagaggggatatggtacaattgaattcaattccacaagtaattcatggaaacttatcatgtgctaggtacgtattaggtaggatacccccataccctattctttgtctactgaaattattataatatttttgtgtatatcactaaacattcaaaacagtgggaataatgaagaaaggaagttacactggtttctaaaagccctatcatcagtagcaatttctcaaaagctcttcatgacatcctagagacatcaaagcattggaagcactggggtgctggggctggctcacggcatcttgcaccagcggtacatatctcttccaaactctgtattcagcgatgtcttgttggtagttgaagtccaccatgatggtaatatttacaccacagaaacaaacaaatattacaagtcaggtctttttttcttcttcccagagaattggctattaaacagttagcagcatgccactgattacaagcagcgatgtgagattgtatcttcttatttcaaagactgctctttccactttatgtgtttgtttccctttcccaaacctcttccacattcacctgtaagactgatttttgcctctctagatgaaggtgagataagagaggtttgtaagcttgtctctgtttacttcaccctgagtcaagccaccaacttctcttgctggactttgtctgtaactttcaaattagtccctttgtgttgatgcttgctcccctccaatccaatctccatccaccaatgagagtgatcttctaaaattgtaagtcacttaagcaaacagaagaaaagtaataataatgacatccctaattctctctctctctgtctcatgtctatgtctatgcctatgcctatatctgtgtctatatctccctatccctacccacttttctctcccttgctatcattatctctgtccccaatatatgcttctgcacatctcacattctggctttttcttatgctgctccccataagacccttcacttctctattgacatcattttcaccttcaactccacactcagatactgactcatacatatgattgattctcacctgcctgtgtcttgttgatccaggtctcagcttagaaattacttcctccaggaagctgtctccaagtcctgttcagatatctgtccttatagagcgttttttatctcacttactatactttttgttgtcttacctatttactatatgcttatatagtaagcaactcttaggaattagacaaaagttcccatttctgtaagacagatttccaaaacaggacagatgcttgatgaggaatgcttgagctggatttcaaccttttcttcccaagtattttgtgtggtgaacaacctgcatgactggcccttccccttaaccatttccattatagcatacattctgtcattgtagcacttagatgtgtatagcaatctttattatctgcctctgtccctgaagattatataccccatcttttttttacattcccagtgcattgtgatcatatattattcatctttatgtgaaacatggtgacaagcatatagtaggtgtgtacattttgcttgaagtaaagtgaaatcaatcttgttcccataccactcaaccttactacctttattcacccagatactaatcaggtactgcttcattccagatgcttagaaagatgagcaaggcacggaatatccctgtaggaaactcgaaggcccatcagagagacagacacataattgaacagtggtgacacaatatgctccatgacaaacatgtgtgagactaactgcattagaattccctggcatgctttaatgaagatttccagactgtacctcacacctaatgaattaacatatttgtgctgcttcttctgtcttctctgtgcccctcttcccatcgtttccaaccaactcagccagtcactgctccctccagcagggaatatgcccctgtgaaatgtacctatgggaggatagccatcattggctagacctggaaactagttattctaacccagttaataacaaacccagaacaactgaacccctaaaaggcggtggatttggacaagaagttctagagagtatttgctaagaggtgttgatatgttgcaaagaatcaatcacttatttttcaaggatagctttaaaaaaaaataaaagcccacctacttagtctattagaaataaagtcagtaggccaggcacagtggttcacgcctgtaatcccagcactttctgaggcagaggcgagcagatcacctgaggtcaggagttcacggccagcctgaccaacatggtgaaactgtctctcctaaaaatacaaatttagctgggtgtggtggcacatgtctgtaatcccagctactcaggaggctgaggcaggagaatcacttgaacctggaaggtggaggttgcagtgagccaagatcgcgccattgcgctccagcctgggcaacaaaaaaaaaagaaaaggaaaagaaaaaaaagaaagtaaatcactaagtagccttttgcaagacaaacaaaaaaaaaaagaatatttaggatttagtctataaccattgacttttggaaatcctgtccttcctaaggaaaattagaggaaaaaaaagagctgaagtctctgttgcatgagaaataccatttgtgattaaactgctgtgaaatacatactcaaaactgtgggaaattcttgccacatctttctaaaattgctgtttgatgtcttacatgccaaaatgactgtgaactagtgctctcttgaaaaccacctaaatgatccacgacaaggaagtcattaattaaataataaggtggatgtggactactatgcaatcattaaaaatctattctcaaataatttttaaacatatagaaaaatgcataaaaatactattaagggaaaatataggttataaaacaatattatagcattgttctagttttactaaaaaatcgtgtgtattcaccaaaatgttgacagtagggtttaaaatggactggtacttaaaggtgattcctttacatttttttctacttgaaatatttctatatttatttgacttcttcataatggccatgttttatttttagggctgccattcaattggtcatccaatctgggacaggtttcagagtaaaagaggaaaccttagcaataatatgggactataggcaaaagcaggactgttttggacaaacacgctatgtggttgttacgggctgaattgcatcccccaaaacccatgtgttgaagtcctaacctctggtctctcagaatgtggctttccttggaaatagggttgtggcagatataattagttaagatggggttatactgaatgatatagattgggtctttaatccaatatgactggtgtccttagaaaaaggaaaaatacggacatagacacgcccacaaagaaagaacactgtgtgagcaggaaagcagagattgggatgatgcatctacaaggcacggaatgccaagaacagacagtaaccaccaaaagccgtaaccgcttagtgggttcaccttacctgctgcctacccagagccaacttctcaagacaggggaattgcaatagagaaaaagtaattcatgcagagccagctgtgtgggagactggagttttattattactccaatcaattcccctgagcatttggggatcagagtttttaaagacaatttggtgggaggggaggggcagtgagttggggagtgctgattggttgggtcggagatgaaatcatggggtgtcatgttcttcttgcactgagtcagttcctgagttgggggtcataagatcagatgggccagtgtctctatctgggtggtgccagttgatccatcaaatgcagagtctgcacaacacctcaaacaatgaccttaggagcagtttagggagggtcagtatcttacagcctccagctgcatgactcctaaaccataatttctaatcttgtggctaatgttagtagtctaatccccaggcaagaaagaggtttgtttcgggaaagggctgttatcacctttgttttaaactataaactaagctcctcccaaagttagttcagcctatgcccaggaatgaacagggacagtttggaggttcgaggcaagatggagtcacttaagttggactgttttcactgtctcagtcataattttgcaaaggcggtttcaatcctataagaccaacatacaacagattctcccttagagactcagaaggaaccaaccctggcattaccttgatctcagacttctaacttccaaaaccatgagacaggaaatgtctgtttaagccactcactttgtggcatttcggttttttgtggtaggcctaggaaactaatacaatggtcattgtagttattttatatttagaaattaagagcaattctggaggtgagagatgggcaggagtagggaagaatgaagttcagtgcaacaaaagaagcttgttcactcaactaagactgtaaacaatgctgtttttcaaaaatacgtattccttctttctgcctggcccctctttagagagccatgtcctgttgatatcaagcttgaccatgtgacttgcttcagcctgtggcgtgtgagtcacagtcacatgttccattgagaaatgggagctttaaagaccatgctacggttctgccacctttgtcgtttgccatgacacgagcttatcctaagggagagctgcttctttagcctgaaacagagttgaaactgatctgcaatgaacctgtcacatgagataaaaatgtatcttttggccaagtgcagtggctcacatctgtaatcccagcactttgggaggctgaggctgggggttcacaaggtcaggagatccagaccatccaggccaacatggtgaaaccctgtctctactaaaaatacaaaaaaataaaataaaattagcaaggtgtggtggcatacacctgtggtcccagctactgtggaggctgaggcaggagaattgcttgaaaccaggaggcagaggttgcagtgagccaagatcgcaccactgcactccaacctggcgacagagagactccatctcaaaaaaaaaaaaaaaaattgtatcttttactagtgttattcaccaagattaggaggccgtagtgttactgcagcagaatgtagcctaagctgactgataaaacattgactaagcaactctcaggtaccatgccaggatgaaaaaattaattagacacagaccctgccagtgaagaactaacattatactgtgtaccattggcctttaaaagataaagatttttggccccaggtgtgttctatattttctgtaagacctgcaagtaaatgttaaatgatgttatttcaaccggtttttctgtagcaaaaatctttaaaagctctcatattcaaagtggttcttgcaatcttgaactacatgtacagatataaaatctgccaattaaaattttatggtttagggaaaaaatcccctctgaaaaataaacctaggtcaattatttcattatttaattctcatttggaaaataagatgttcagacattgagttatattagaaggaagaaaaccacttctgtgggaacagtcaaatttatttcatttactattagagaatgttaatttcaagaagcaatctttgaaagcaaccaaatttggcaaagacaagtagtcttccctgagaaatattggacagcaacagattatataaggaaaggacagaggggagagacatctcaagtgtaggtctggatggaggtagaagagtcatgttctagagtcagcattgtaaagcaaaaattgcatggtgtcaaaattatccttgaaagtcccttaaatggcccttaaattgtctggacctgtgcctttagaggttgaaaggccaagaattaatgtcttttgtttctctggggcagtgaaggccaaggtctaatttgaaaggggcaaaggacgatggggaaaataaaggatctctgcctttcttggtccatcttttggtctcctgtcctctctctaggtgactcttcctccagctctcctcctgctctttcccctcaacagtgcatatagctaaagtcaaacaagttaaatgtgcatgttaggcaactctagtccttacaacttaaaaactttaaaatggatgcattgggggcctattgtgtaccctgtcctaggctagatatggaagagatataaagcagggatgggggtgagatgaggagaggaaacaacagacctcacaggagccaggaagactgaactgcaaacagatgatataaatacagtgtagtcaagtcaaggcagtagctcaggtaaacacacaatgccacaaacaggagttctcaaaccttggctgcattttagaatcacttgagcttccaaaagcttcaatgcccaagacacaccccagatgcaccccaattgccagtgaccctggaatctttggggaggacctggtcatcagcatgtctttgagctccccgggtgagtccacatgcagccaaggttgagactgggggctacagctgtgtagaagagcatctggtgtgggtctgaaggctgggcaggaattagctggtagcagtgtgcattccaggctaggggaaccccagtactaaagcttcttcagcacaaagaggcttggtttgtgctttgaacatagcgtggttataaattaaagaataaccaaactccttgagttgaatcagtacacaccataatgcatcagctcacattgacatggcaacctcttttcatctctctttgttaagggccactggttctttaaaagcatgcgtattaatggattctatctgatgatgattcactccatagttccatcatgtatgcatctctaaccagtataagcaaagcattttcctttcaagagtctaatcctagcattgtgccatatccatggccctctaagatacacaccccatctacaaaggcgacatgtactcttaaggtacaaagcatttcctttaggggagtgattgcctgtgtgtccaagctgatgaagggtgctcttttaagttggagaaaattgattttgttgtggttgttgcacaaaggtttatgttttcaaagcctccagataaaaggcaccatgggcagctaacaagcccctaataggactacatcaagttttactcacctgctgccagggcttgacttctgcgtcttgacgacatgaaaccaggctttgacagcattcatttttgctgaaggaccctcccccagcctccttccataaatcctatgctcctttattccgtattcattcagcacagatgtttttatggccataatatatttatactaattcagaggcttgccatcagtagataggctcatctctctgatccggaaggcggcagaggcactccttctgacattgcagatgaaaataaggtctgcttttttcccacagtgctcttcaaaggagcaattttctaaaattcgaacaagggtgtcatagttaataagatggaattctccttttctttttcttattatattttccaaatcaagggcagtagattccagaactccaatgacgtcaggccactgtactttcaaaatgctgttctcagtcaggtttcttattatctgatcctggttcagtagattgtctcagaattgactttttagattaattttgattcttagttaaattactttttaatagctaattaccacacagtctatctgattaacggtattgtgattcagatcaagcggtgagatgactacaggtaacagacccttgctatcatttgggtgttctcacaaggaacaggagccaggtagtgaaccatgtgcctaccctttgggcagggaatgggtggctctaagagatgacagatgctgtcatccggaatcagttctcatcttggtcaattggatgagtcagagagattttggaaacatcttcaggctaacccaatttacattatagttatattttaattgccttttaaagtctaaatgcagttgattgtgaaaactgtgtcacatcatttaagggaactagagctttctttttatggaaacgcaaaaggacctagcaggaaaataccacattgcctaagcagtaaagaaatatgtccggccgggcgcggtggttcacacctgtcatcccagcgctttgggaggccgaggcgggcagatcacaaagttaggagatttagaacatccgggctaacagggtgaaaccccgtctctactagaaatataaaaaaaaaaaaaaaaaaaaaaaaattatctgggcatggtggtgcttgcctgtagtcccagcaactcgggaggcagaggcaggagagtagcttgaacctgggaggcagaggttgcagtgagccaagatcatgccactgcattccagcctgggtgacagagtgagactctgtctcaaaaaaaaagaaagaaaaaagaaaacagaaagaaatgtgtcctcaaagcttcctcagattgttctagaaaagagcactagcagcccccaaccaatgcatgccgtgaactcattccaggtatcatgcacctttgattgtttcactttccttgggtcaaacctttagaaagtgggttccctgtctcaggcactgagctaggtaaattcaggggataagatcaggaagagtcccttcctgaatccaggtactcccactccccccggacaacaaggtcagaggcaatccctcgccttcacctctcatcttatttttaaataaaagtttctctttctttatgttcttcgctttctccttcaacaagattgtttcctgctccctccccacccctgctgcctctctgaatgttgtttctcctcactgcactgtgctgtgcagtgaatccatatttcttttccttttttccttttcacacttgaccacgtctttattcaataactctgccccttcacagcacagggcccggtggaggctgcccttccagggagcccaggctcacgtgtacttgccagggctggctgtccctgtccagcaggtcacagacctctcctggtctgacactgaggagtgaccagtgctgactcagagcagcccatctacgggcgcactgttcagaaagtcgtggaggtagatatactgctccagcgttggggtcataaggccacaggccggggactgctgcagagccacgttaaacagatccacggtacactcagtccctgcctggtgctgcagctgctccatggccaggaaggtgcccagctgggtcgcacccttgctcgagtcactgagcagtgtgcctggcttctggctcttgccctgagagcagcactggcccatggtagccaggaagggcggcggggtggtccttggtacctggagccatcaaatgctgggctctctttgggcttcttcgcagcagccttctttctttactttactcacttcctaaataacactgttctcaggaccttcattactgcatatatattaataattcacaaatctgaatttcatcctttgcctctcatttggtttccaaatttattttcactcacaattcctacatagtcagacaccttcaacttcacgtttccattttgattctttgtcttgccttccatgtcttgtagcttatctatttttttctgtctcggtaaaagttcccatttgcccacagtagaggattgaaaataatctggcttttaaaaataccctgggggaaacaaaaaaaaagaccattcatcagtctgctgattctatatctctgagtaacactgtgaattcctgtgactctagttgagttaaatttattcctagcttttaaaaataaagccaatgaaagaccagagagattattacaaagcctgcattcttgtgaagttgctgaatccacagttttattttagtcaaatcacatttccatattgcaaaaatattttctaaacaattaatgggtatcatatggggtcagtcttgtggcgtttattcttttgtaacactgagctaaagtctctatgggaaagataaataggttgttggagaattaaactggtcaagaagtgaacattgatgcctaaacctctcctctgaaattttgagcacatgttaacataggcacataaaaaagagccttagcagaaagaagaaacgatatttccattgttgggtcacagtggtcactaaaggggatataactttaatttctcatttgaacgtacatggcatccatttaaccaactcatttacagcatagccgcctgtcaagcatataaaactgtaccacattgagctggatcggtttttaaattctaatataatgcacctgggcacggtgggtcatgtctgtaatcctagcactttgggagactgaggctagtggatcacttgaggccaggagttcaagaccagcctggccaacatggcgaaaacccgtatctactaaaaatacaaaaaattagccgggcatggtggtgcatacctgtaatctcagctactcaggaggctgaggcacgagaattgcttgaacccaggaggcagaggttgcagtgagccgatatcacaccactgcattccagcccgggtgacagagcaagactctgtctcaaaaaataaagagaaaaaaaaaattgttacataatgcaccctcgcacatgctgttggatgtaccatgattcaaactatgaattctgtaggaaagctacattttaaacatgtttgggtgaaaatgatgtgtcaatgtaggttcaatgactgtatcaaatgtaccactctggtgggggtcattggtaatgagggaggctacatgtggaggcaggaggtatatgagaaatctctgtagctgactttcaattttattataaacctgaaactgctcttaaaaaaaccgtaaaaaaataagtttgatgaacttggttttcaagcaggtagcaattaagactgtggttgtcatagagacagacctatggcaatggagatgaagggtgggagcttggctttatcagaatggcaattctgcatttttgtgaatgtcagcaaatgaatttgacccatgacgtatggacgtagatcaaagggcacatttagcatactgtcaatgtggtgctcgtgtggccttccaaaaggccagttccacagtgataaccaccactaataatcctacaaacctctccagctgctttcagtgacatgacttctgatctggagggaaagaaaagaggggtgatattttataaatatcaattttcaaaaatctctgatctgttggtattaactgatgagctcagagatgctcggaaacctcctgcctgcacaacaactgtaaccatggcaacctgcatttttaaaggatgttaaagatgtttttaaacatcaggtgagaaaaacagtttccacacaagtgtttgtctgggatgttatgtctaattcctccagtacacatttttccgttactgggacttgatacaatgctggaagctttcctgttagggcagaaattgggcaacccaagacagtcacagatcttgagatcgctgccattgctatgaaaatgaggcattcttattgcatctagactgagcatcagcatgcctggtgttcttatacgtcatacatgaaagagattggcaacccttcctgaaagctttgaatttttgatatcatttgttccacgtgattttctaaggctatattggaccactatacattctagaacaaattaattaaagcctccagtttccagggagatatactaatatctcaataaagtgctggatttgagtaaaagacagagaatcatgtctgtaatcctagcactttgggaggctaagttcaatgtagtattcagaatttgaatattgagcttctatattaaagaaatcatcaaataaataaataagggtctatcagttttctgaagattcagatttttgttgtttttaaatgagtaattctaattgtattttaaatgagtatagggagggtccattttaaggagtcagaatgtaatcaaagatgcctattactattatattttcagatagaaacagataaagttcaagcagtgcaaatactaaataagcaaattaagcattatgtcttttttttatggtctgccactcatccacaaccaccagcatttgtcttgacaaaccaccaacatttccctcccccgccttgactgtgcatggatttgcatatttatagagttaaagaatcacccaccatggttctctttcttatccacattcttgtcttacccatccgtctctgtcactctcctgatatacctcttccctactaattacattaatcaacaacaaacaacaactctaaaagattccccgagatgagagtttcagaagcctgagacgctatgtcaaacaacccaccgtagttattcagggacactgcaactcaaaatgaggtagccatcgatccagagaacaaatgatcattattcatgtaactctcttctttgcttaagaatccatctttttctatcagtgccaaattctctcactactttcctggttctaattcagaagtaagtaaagtcagctagtccctttgtttgggggttaggcccattttataaagaattaaaggaaaataggttaaacatgaactgcttctcagacgtggcatttacatgcctggtgcttccttagctcatcatataaccaagtactggaatctgttttacagataataagaaacattcacgtgttccatcttttacatatgtgaggaccaggcactgactagaaaattttcatcaccattgtcctcatcatcaccatcattagcatcttgtcgtcatcattgtcacgatgacaaagatgctttcatgatgatgaaagcatcatcatgctttatttacgtgatatcattgaatccttccaacaagataccagaccattttattgtagacattttacagatatttacactgaagttcagagttgttgagtggtttacccaagaatacgtagcaagtaaatgatagagctgaaaattcaatctgtctttctctagtgctaagccttagtttccctaccaagttttaaaggttgaacaaagcaaggtgttgaaagagcaccctgagtctgacagtcagaggggaatcagggcaggaagtatctactgaagaggtcctcaaatttcaggttgcctaaacagttactgaatgagcttgtcaaaatgcataaagaaggccctacaccactaccactaccaccaccctctgacacacatacacacagattgtgattcaataggcctgagattagtccaaaatctgtatttgtggcaaactccccaggtgatttcaacagagacagtctgtaggccacccttggagaaatggtgttatagctggattggggactgttgagatgcctaaatccccaacttgtagagctagcttgggctgctcccaagtctagcacactcattgatatggtttggctgtgtccccacgtaaatctcatcttgaattgtaacccccacaattcccatgtgtcgtaggaggaacctggtgggaggtgattgaatcattgaggcaggtctttcccatgctgttcttgtgatagtgaataagcctcacaagatctgatggttatataaaaatgagaatttccctgcacaagttctcttctcttatctgccaccatgtgagacatgccattcaccttccaccatgattgtgaggcttccccagccacatggaactgtaagtccaataaacctttatttttgtaaattgcccaatctcgagtatgtctttatcagtagtgcaaaaaatggactaatacactcacctatgtagggaaacctctttgttccctacataggttctctgcattggttcagagtccatctcttccactgggatgtccatcttgtggtcaaaacctgcaccccaggtaacataaaataaaaataacaatggctataattgtgaaccgcccgctaacctcctcttgtagtgctccaggccagacgctcatcaccttgttttgttgtctttgccatcagcattatagtagagccattggcactcacccatgtccagccccgttcctcctgggcacacagaaatttccgactctgttttctattgcctttgcagtcagatggaaccatatgactagtgctagccaaagtgtgtcatctccactctctttctttccttggtaccatggatgtgtttgatatggtgccagctgcaaagtagtggaggcttcttcagtgtgggttcttgagctgtcatatagcataaagccgccacccaccattctgaattcacagcatgagcaagagataaacaaacctttgttgagttaaggctctgggattttgttttattttgttcagtttttaatttctgtaccatatcctaacccatcctaaccaataaaacctcgtcgctgtcaacatcatcatcatcatcgcaataataaaatgtattaattatgaacataaaaccttaccgtgtgctgaacattagactaagcattttgcaaacattatctaatttaataatcacaccaacactataaaaaagacatagttgttatctgtgtcttacccagctggtaactgatcgggaaaaaaatgaaaacccagcagcctgactccaaagcccgtgtgcttatccaaacactacagcgtaggttgcttagtgccagcttcagtggttagttctttacatgcttatcataggtaatcctctgtcaacctgtagaagtaggcatgattaacttaattttccattgtgaacactgaaggttggacagattcaatgtctggtctgaggccacacatcacacaccacacactacataccacacatcacacaccacacatcacataccacacaccacacaccacacatggtggagttaggtcacaatccacgtccctctgactcttgaaggaagcatcatttattgaaaaactagagtgtctaagcaggtgattttgattccttcaagtctgtttcagaaatgtctaggggccccacagatctcctgaggtcaggggttcaaaaccagcctggccaacatggtgaaaccccatctctactaaaaatacagaaattagccaggcatggtgggggcgcctgcaatcccagctactcaggaggctgaggcaagagaatcgcttgaacttgggaggcggaggttgcagtgagccgagattgtgccattgcactctaggctgggtgacaagagcgagactctgtctcaaaaaaagaaaaaaaaaatcatcgttttactgatgatatttacaataacagcttctgccagtaatagagactaccaataaccaatgctatttattaaatactaacagtgtgtatatatatatatgcatgctggctagtgtcacgccctcacaaagtggacattattatcttacagataaaaacactaatgcttggagagtttcattgtttgccacagggtgcccaggtaaaaccatggcagaactggagacaatccaggcagcctggctccaaaaccttgcagttggccagcacactctctgcccagagcccagcccacgctctgatcacagaaagtgtgtgggagatgagtagaagcaggagaaaaaaaaaaaaaaagtaaaatgtaggctaaggggttgtcctgtaagaatttaggaatccctaagaaggagaactagaggatcaagggaaaaaggccaagtccagtaagtccctccaaacgtcaagtggggacatctcagtagagtatacccctacaactgatctgccaagatgttccacaatacaaaaaggattctgttggcaaaaacaatgcccacccctgcctgtcttgaagattcaaaatgcacagtagatgatagatgatggatattctaagatttgttgtagcaagaggctggttgtgtgcttaactcttcctttctaatttgcttttgaccacagcaccctttttattatgcaaaacctattaacatctactgaaaggcactcagcatttgagggaggggactagcaggctgcagaggagggtgctaagttctgtgctgaggaaggtggttggttgtggaagatgtagtggtcacaaatgagaagagtggacagtgggtacagggtagggatgatgagacctggaattgatgacctcagcagagaaggggaggaaggataagaagcaaataacagtgacatatgtgtaagttaaaaagatggaggtagagctagtttccaagatggcttaaaaatacacatgggtgccggtttgacctcaaaatagaaattagagacctagaattcaggagagaaggcagaactagcaaatggagactctaggtcaccttacctctccttttcttggaggaatggtggaaagagaagaacaactgaaaggcttcagcacaatcgctctgtaggacccaggagagagaagagtagcctggaatcaacagtggtgggagaggctggagggcctcaggaaattcaaggcaaaagagtagttagctctaatgaccattctttaaaagtagaaaaaatgaaagtggagatgtgcattgtttgtggaaagatagaaccttcctcagtcagaaagcattttgccattagcagcaggcagtgatgctgacaatttgcagttggtggccaggttttaaacagtagtttgggcaagaaagggtatccagcaaatcaatttgcaatagctgatccctgtcattaagggagtcaattcttgatactgtaagtgaataaccaagtgctgctctggtacaattgaggtatgaaataccagacctgactattttatgtaaatctctaacatggtgtttaagcaggacagagcagcggggaggaaggggcttaagcagaaatgggctttgaggacctctcggcccagacaggaagagtaattgggctaagatgagagaggggcaaaactcagcacatctccaaagccatccaaggttgcggacaattaacctcttgattcctccctcctttccttccaagatcagatttttatcgtctcagaaacatatgaacttcaagaaaatgtgaggaacacagactttctgagccagcttccattgacatgccatttgattaatttatgtggttgggacagcagttcagagggaatatagattgtgctcttacctgccccatttccatatttaatatattcaggcatggttatgatagagcatctcatgtttacactaactttgtgtcttttgaagttcacttttaactttgtgttgataaaatactattttctaattcagatttttcaaaaaatgcccgttgggcatcaagtagcttttacagaatgaggtgttcttagcattattatgaagcaaggacaagtgtattaccgccattcacggagacatttttgcagtgttgcaaatctcccaaatgtttcaaaaaattacagcagttgcctgttgcacctcacaattagctgcctaagattctaggagagaagcagttggattttatatgtgaaaatgcctctatttgctgcatttttactttttgagaagttgcaagttacatgaaaataaacatactatataagaaaacacggcagatttctcctggtgttttaataattccacgaaggtttatgaatattggcaaacgtatttgcagtggtacttccctgctatttactttgtagactttgagtcttagattcttgtctgtaagtgaaatgtagtattaaaaaaaaaaaaaaggccgggcacagtggctcacgcctgtaatcccagaactttgggaggctgaggcaggtggatcacttgaggtcaggagtttgagaccagcctggccaacatggtgaaatcccgtctctactaaaaatacaaaaattagctgggcatgctggtgcatacctgtaatcccagttactcactaggctgaggcaggagaatctcttgaacctgggaagcggcagaagttgcagtgagctgagatcacaccattgcactccagcctgagggacagagtgagaccctttcccaaaaaaaaaaaaaaaaaaaaaagcattacaagttggagtagcctgggctcccgtgttggctttattactgagctgtgtgcaggtggatgttttgctaaatctttctatgttccacgttatcaagaccctttctctcttttcccaaagctctcgtatcaattccatttaagccaaatctcattatttcattgcttttttttttaattatcctatttttaaaattattctccctccttctggtttccattttcaaatagttcaactggatagacataatagcaaaggcatagaatcaacctaggtgcccagcagtggtggactggattgaaaaaaaacgtggtacatatgtatcatggaataccatgcagccataaaaaaataaaatcacaagctttgcagcaacatggatgcagccaggggctattatcctaagcgaattaatgcaggaacagaaaaccaaataccacatgttctcacttataagtgggacctaaacagtgaatactcacggacataaagatggcaacaatagacagtggggactactagagtggggagggaaagaggggtatgagggttgaaaaactactagatgctgtgctagctaggtgacaggaccaatgatactcaaacctcagcgccacacaatatacctaggtaacaaacctgcacttgtacccgctgaatctaaaacgaaagttgaaattataaaataaataaataaatgtggtgcttatttttaaaataaatgaacaaaaaaaccccaaagagcttagctaggtgttaagtaccatccaatggacggtgccatccattatataatatagatatttacacacacactcaaacacgcatacatgtatgtatgtgtatatatatacacacacatatatttacgactgtagccttctttccagcagaagcagtttgccaaatgcctctgcccttccttagcccaaatgctaatagtagctatttcatgaatagatacagaatgacagagtcaactttacctaacttctccaaaatgccgactccagtattccattttcaaattaacttattctgattataaaagtaatgttcagtattgttagtaaaataaattttaaaaaaaacgaacttgtaatttccccactcagagatagcttctgataacatattggtgcttttacttctatttttttctatccatatgagtataattaaatacatattcacatctatatctatactcattcatatatattcatatgtaagattaaactatatgttcaaattgtattctgctttttaaaatcacactttattttctgggaatgttctcttcataaagttcttccaaaccatgatatttaatgtccacataagaaaacatctcatggactctcaatttattgaaacttttccctagttttggttattctgtttcccaccagtcattaattactttaaacaattctgtgaggaccattcaggtacacagacgtgggtccacagttatctattttcttagcctcagtgcttggaagttgaaatttgtattgaataactaaattcctttgacaattaaaacataattatcaaacttttttgcaaagaaataacactatggtatatgacatctatggcatatgacagtccctgcttaccttatgcttgccggcattcagtgcttaggtttccttttttttttgagacggcatctcactttgtcgccaggctggagtgcagtggcgggatcttggctcactgcaacctccacctcctgggttcaagcgattctcctgtctcaccctcctgagtagctgggactacaggcgcctgccaccacacccagctattttttgtatttttagtagagacaggatttcaccatattggccaggattgtcttgatgtcttgacctcataatctgcctgcctcggcttcccgaagtgctgggagtaaggtgtgagccaccacacccggccaagctttcttaaatgggccactttgattgatgaaaatgataaggtactgtggcctttttttttgccatttaaaaaacagtggtaaggttttttttttgtttctccatgtcttgggaagcagctgcctgttcaagccctctttccttttcctatttgggtgttaatggcttccctattgattcataaaggcccactacttattgtggatattaatctcttgcctgtcatatgtttgttgcctttcttttatgccagctagttatttgaattaattggatttgatgttttgaaatactgaatttttaaatctttagacagatacaataccattttttccttatgcgtattctcttgtttatacaattaacaatcttggcctgttccaaaatcaaagtcacatgaatacatatatttttctaagtttttatggcttcatattcacatctgattcttcagtccctctagatcttactttcgatgtatggtttaatgtgaagtcccatttcaagtttttacccttcaaattaattttccttccaaatgttattttattttattttaaatacccattctttttctggttttgtcacatagctttcatgtgatgttaagctctaatacatacaacaatttactttgggaccatctcatatattaaattttgcaaaaatgccatactgttccaacactcatagttttataatgtgtcttaacacatgacaataaacccttctaaaatacacacaggtttcagaactgccttaattattttttgctttgatttttcctctagaaaaaaaatgtgatcattttctcagactcccaccctacttgttttctcaaagctactgtcacactctggatgtacaaggtcaggggtggtgagagatcagggtgtttaggagtgtttgcttgactgatggagacacagggttcccaaactggaagatgacaacataggagaagcttccagttttccagtcaaagatactatgtttcatgaggcaaagcgtgagaaactcaccaatacaatttcccccaattccactctatcagcctttgagattttccggacagctatctgtcagtcttagtacttaaaattgttggaagtttgaacacaattcttcaaagatattttagtgaggaacaagagattttgctttggaagatcctgaacagatttccttacaaaaagtatttctaagcacccatccctataatatatctaaatgttaaatgcttattgatggagtaaaatggaaagtccaagagtcgtaacattatctggtaacagtgtggatgagaggtatgggagatgtaggcatgtgcatgtttcctgatttgaccaaacttttcaacatgagtgacccttctaactagttttccaaaaatagagagaagagatccagcatcaatgaaaatgacaaaattgacaaagttttgccttggccctcttccatcgtcgctatcctcttctcctctactcaacctccccatcagtctttttacccgcccgcctccttttttttgagggaagctgtattaggccattctcacatggctataaagaaatacctgagactgggtaatttataaagagaagaggtttaattcgctcgtggttctgcaggctgtgcaggaagcatggtggcttctgcctctggggaggccttaggaaacttatagtcatggtggaaggcaaaggggaagcaggcacttcttcctggcagaacatggcagaaaaggggcatggcggaaacagggcaagagaatggggtggggaagtactacacacttttaaaggaccagatcttgtgagaactctatcatgagaacagcaccaaagggatggtcctaaaccattcatggaggatgcacccccatgatccagtcacctgccaccaggccccacctccaacatgggggattacagttgaacatgagatttgggtgaggacacagatccaaaccatatcaaaagcttttctaattaggttactcattctatgaaaatagactgcccataaataatctttgtttttcagatgaagatttggcaagttctgtgcctagcacgatggctgacatgagataagtgcacaggaaattttgaaatatctgtgtctctatcttcatttccttgtttgtgtctccaatttcctatatgccatcaggggatttagtgacactgcaaatagcatgctctttggcaggcacgcctctcccatttccccagaacctcttcgtctttctgaggcatggagtcccaagctgtatgttttcaggtagtattgtaggaagattaacagtttcctgacatctttcttgcaaaggcatgaatacctccaccggtgcagatcaacataagaaatttaatgtttaccttgccattttataatgctatcaactttctcaaaatctgtccctctgcactctgttatttaagatttattgtcatcctgcatggtgagatagctggtggacattagccccattctcaggggtagctgctatggttgaaacatgctctaccaaaattcgtatgttgaagtcataatccccagtaattcagagtgtgaccttacttggacataggatctttacagaggtaatcatgttaaactgaggtcatttgagtagaccctagtataatatgactgatgcctataaaaagagaaatttggagatagactcacactcagagagaactccacatgaaaataaaggcagatggccgggtacggtggctcatgcctgtaatcccagcactttgggaggccgaggcaggcagatcacttgaggtcaggcattcaagaccagcctgggctatagtgaaaccccgtctctactaaaaatatgaaaaatttagccaggcgtagtggtgcatgcttgtaattccagctactcatgaggctgatacgcaagaattgcttgaaccccagaggcggaggttgcagtgagctgagatcacgccattgcacttcagcctaggtgacagagagactctgtctcaaaaaagaaaaaaaaagctaaaaacacaaaataacagcagaaatcaggatgatacatctataagcccaaaaatgccaaaaaatgcaaaacaaacaaacaacaagaaaaatccatgagaagctaggagacaggcttggaacagattcctcctcacagacctcagaagcaccttgatctcagattttcagcctccatcactgtgagacaatcaatttctgttgcttaagccacccaatctacagtactttgtcataacagccctaacaaacaacatagtagataaaaacaaaaaacaaacaataaaaaaagaaaacaaagaaggctaaatagcttccttctgaatgtggatcgtttcatcagaggatttgatctactgaaccttctactgcactaaaaattctcatttcatcaagtataatgaactgaagtcaaagggatttatttgatgctgaaccaagccaacactctccccaccccaccttagtctaccgttaacgtgtccgaaattgcatgcgttgttttgcttggatgttactagcccttgctgggaaaggtacttggcactaatgtgactatttaaactaatattcacaaagcagttaccctgtgccaggcttatatggattcatgtaattctcacattaattctgtgagactggtgccatgactatgccacttacatatgtccagccagaatctctagttataacttgttcctggtcatacactctgctggttgtgaatccagcgtttgaactcaggcagtctgaccctgggggtgacatttaaactactttattgctgggttctatgttctcaaaagtttagaaggtatttgttaaagagaattggaatatttgctatggaacttgtcagagcttttaaatatgctattatcttagggaatctctgagagtgtggtaaagtaagcagcatttctagcacatagttaaccgtgggtctctttttattaaggcaagatctcttgggactggtgtttcttgaatagacttgccagacaaaatacaagaccccattatgaaatttcagataaacaatgactagtgttttagaataagcacatcccaactattgcactggacatattaatactaaagaatttgtgtttgtttatctgaaattctaattttactagggcgttctgtatttttatttgcaaaatttggcaaactatatgaaagatgcttcgaaaactatagagaacacagccaaagatccctgcctctcccaatcttctgggcctctttctttaggaaacaaacataaacctgcccaaactgaggttgtaccctttttacctgccctgttaccttcctagcatccatcttgctgtccttcattctgccaccctggggttcctatcaaactctgcttcctgtctcttatgacttagaacatgccatcccagacccagggaacagaacaggcatatccctggttatttcaaagccagtatcacaccagcatgtagagatatgaccagacaataacaatcctcctccagttatcactcgagggaaaggagagggacttatggggaacagatgcagataaaacccaaatctgatgccttgaggctggtcagtatgaagtctgtcctgtggtatccctctgcaacatttccatttcaggggagttgagggcttatcaagcttaggaagcaatgtgtactgaaaaggatgaggtcagttcggggtctgtcaaatcaattgaacatatcttgaaccctgaattctatcatcaatctcactttacaatccatcccttccaattaatgctgcatataataacaccactcaatgatgttcatacatcccatcttcttacttggcactatcttttttttctttttaagagattaatttgtctttccaatatattcaagttatcttgaccaatgtttcagaattacttagagctttatggattgcagcaagaccgaagcaaatgaccactcataattcagaatatttctgagccagaataaagtttacacttcatgaccataaagaggaccctttatgcttgtatgtagaagctcaattcaggttccaaacctgcactgtccagttaggtagccactagccacctgtggttacttaaatttacccttaagctaattaaaataaagttaaaactttagtttacgagccatatgtattagtctgttttcacacttctataaagacatacctgagattaggtaatatataaagaaaaaaggtttccttgactcacatttctacatggttggggaggccttaggaaacttaacaatcatggcagaatgtgaaggagaaacaaggcacatcttatcacagtaaagcaggagagagagagaaaaagagccaaggagaactgccaaacacttttaaaccatcagatgttgtgtgaactcactcactatcatgagaacagcttgggggaactgcccccatgatccagtcctctccaaccaggtccctcccctgacacatggggattaaaatttgaggtgagatttgggtggggacacagagccaaaccatatcaccatgctagccacatttcaaatcatcagctacgtatcgctggtggctattatatgcagtacatacatactgcacagtgtagatatgaaacgtttccatcatcatagaaagctctcttggacagccctattctagatgctttattctcaaacatgccacaggataacacataagatattggcatggataccattctatttggtttgggacagaagaaataaggaaaaatgtttctgaaacagggagtccattttagattattttatatgaagttatcaatagtttattaatatattgattaaaagatgacaagttctcaacccccacgatagcccactggtgaagacagaaccatgcagacactattaattcggctctgtttctttttctaatgagccagtgtggagactggggaagaggaagggattgtttggaaagatcagagcatccaggagaaactgtatggggatgggggcaccactgactgaatcagagcctccagtttgctttgggtgaccacagagggactgaacaaacccctgtgttgtcagtccttagttttgagaatagccttgaccagcacacttgttcactgaggaaggatacgaaaatgcagataagttaaaacaaacaaacaaacaccgtcattcttactctggcagccagatgagtcaccaacacattaaattctttatagatctctataccttcctttatgtaaatgtgtataatatgctcacaaaaataagatcataatatacatactgttttttcaacctgcttttttttttttttttttttttttgagacggagtttcactcttattgcccaggctagagtgtaatggcgcgatctcggctcaccgcaacctccgcttcccaggttcaagcgattctcctgcctcagcctcccaagtagctgggattacaggcatgtgccacaatgcctggctaatttttgtttttgtttttgtttttgtttttttttcagtagagacggggtttctccatgtaggtcaggctggtcttgaaatctctacctcaggtcatccacttgcctcggtctcccagagtgctgggattacaggcgtgagctaccattcccggcctcaacctactttttaaattaatatgcttcaacacatttccaagccaaaatgacttgtaaaacgttgtacttaaagattgtggctacgcttggtggctcacgcctgtaatcccagcactttgggaggctgaggcaggcagaccacgaggtcaggagttcgagaccagcctgggcaacatggtgaaaccctgtctcttctaaaaatacaaaaattagcctggcgtggtggcaggtgcctgtaatcccagctactcaggaggctgaggcaggagaattgcttgaacctgggaggcgggggttgcaatgagcccagattgcatcactgcactccagcctgggtgacagagcaagaatccagctagagaaaaaaaaaaaaaaaaaaaaaagtccttgtgcattaatctgttctataggtgtttttagtggaacatttagtgggggtccagttcatccccaattataaatataattccactgagcatcctcaactttgtgcacattcctaataatctgcaaggaatacatttatggaaggagaattactgtcttaaaagggggttggggtgggtatatattattaaagtttgcgataaaagtctttagttgcttgatgaaatggaggcagaagtttaatccctaaggacccttctaattccaaagttgtctgagtgccggattgtagctctgttgagcctgggtcttaagtctgagcgagcccttagttaccttcctctcccatcagcctgagccagagttagcctgaggtcccaaactatgagcaggagaatgtcaccctaggaatggcaactagaaagtttttaccccggatgccatgatgaggcactgccatccactggagcttgctgtgattatggaaatgttctctatctgcacatccagtatgataagcactgaccacatctggctgctgaggacttgagatgtggctggtgtgaccgaataactgggattttaaatcttatttaattttaatagccacatgtggctagtggctaacattttagacagctgttctaagagcatacctctgagactcaaatactcagatctttgccacattgttttatcttaaatatgacaattgataacattgctcatgctcagctgcttgcttcaaatgacatttatttccctcgctagttcttcaaaggtagggactaatcaccaaatctccaatgatagtctgatgccatccccaggtctgctacagcacaaaggggaccctcaatgaataagcatgtcaacatcaatcactttcctcaaagtttaactcagctatgatagatcatggcatatccgcaagccaagctactcatccaaaatatggagatcttgtaagttggagattgtgatgataatagtacctgtcccttagtattgttgtgaggattaaatataagaagagcacttaatattagtgcctagtgcagggtgagtctccagtgaatggggaccattactcttgcctccaacattgtagcaaggtcccctccacatagggataagcctgtcaagacccacgcctgttactcaaaatctcttttagggttatttaaatacgtggtcaagtattgcattaggagaaatggcttaagaacaagagaatgtcaaaccaaattgagttccccttattgtgtgctctcatgaagcacttaccacaatgataattatttgcagtagtattacctaatacctgcttttcccaccatgctataaacacaccagagcaagactgtttatcttgttcacggatgtattcccagtgctaaacatatagtaggtgtttaataaatcctgaatgatagattgaggatgagtgggtagtagatgggcaggaataaaggagctacgggaaaccctagcatagaaaaaaatagtaccagaacccctgaaatctagtcctgtttaggttcacagctaactatcggtccactgaaaagccctggttttggcttctctgttttataaagtgaaaaaggttgatccagattagggtttttcagcctcagaactatagacatttggggcagataattatgttgtgggaggccgtcctgtgcttataaaaggatgtttaatgcacctgtggctgtacccattagctaccagcagccctcctccgccagctgcgacaactaaaaatgtctccagaaaaatgttccaagcagggaaaactcccccgccgcaccccagttgagaaccactgatttagatcctgtctgaagtcccctctggcactgatagtctaagattcttcttgggaccataatttctgaacatgtgaattttctgacatttcatagatggttatagaattataagaatatttccagctactcacgcaaataactcagacctgattatcaatttaatatttggatcagtgggccattaaaatgctgatttgaaattcaattttccatttttaaaaatgatcactttgtgaattctgttagctggttgattttatttaaatggagtgtgtaatttttcccgctctgtgttcatgaataacgctttatagttgaatgtcagaatgcctgctaatgaccctaacaatcatagcttatttctagagaatccatacagtcattgaggctttgttttttttcatcttccactcgtttccttggaataagacctttaattaatgctcattaagatgcacaaatagcctggccttgaatcctcccagtgtttggttcactctcccctaacttattaaagttgcttctggaagttacatagagacgtgcagttaattcctggaacagtgtgtttgtgcttctcattatgcaaaaaatatacaccttggtcaaaaaggaggtatatttttacacaactatttgttcataggacatgtatgcattaagcctcaacaaatgcgccaccctattggcaattatggaattcgagtctcacatcagagcaaatgtggtggtggcctagtaggactttcaatccccttccttggaaaactgccttagtaaggagttcagggattccaggaaatacaggaaagcctttgggatgtgtagtcccattcatatgaaatccacatttcccagaagaccacagaacttttgtgttccatgcagtgtccctagcactacaagctattatctccttaaatctctcaaccctatcaggcacatgctaacaggaccatgattttactatcaacaaaagggaggatgggcgcggtggctcacgcctggaatcccagcactttgggaggccgaggtgggtggatcacctgagatcaggagatggagaccatcctggctaacacagtgaaaccccgtctctactaaaaaaaaaaaaaaaaaaaaattagccgggcgtggtggcgggcacctgtagtcccagctactcgggaggctgaggcaggggaatggagtgaacccgggaggtggagcttgcagtgagccgagatcacgccacggcactccagcctgggctacagagcgagactctctctcagaaaaaaaaaaagaaaagggagcctccctagagaggtgttaagtaacctgcctgaagtcacagaaccagagtttgaattcgtctccccagatttctggaattgcagtcttttccagtgctacattgcccctagatttaggataaaatacaaatgacttatattttccacttaaaagaagcattccttagcatcaaactaaagttagttcaacatatattcctatcaaaataggttaagtttttttttttttaatttataagtgcttatgaacaggaaacgatgggagaatagcttactttcaatgactgctttgagcgtctaattttaatccatatattttctgtaggccactgtttgtagcttttagagtagatttccctctcttaaaagtaaactttgttttacttagaaaacacagagaccttggagcatagtgattgttgtgtttttaaatttcattggtttaattgtcgtttaaaagtaaggttttttttgttgttgttggtttgtttgtttgttttttttattaggaaaacattctcttcatcacatagccctaaatcaatcaacatattttaagagaactgaaatggttttggggtaactttatttttgctattgtagtctttggaggaaataaatgcaaatgaaaaaatcagttaagatcagacgatggatgtattttttttttcacatcctttcctttataaggttaggaacaaacaaacttcctaggaactatcctaatatggattatcataatctatgtttttacaaaaatagtgccaaggaatggaaccaatttaaatggcttagagcatgagacttttaacgtaggactcaccttttggtggtagctaactgaaatgacatcagatctgtaaagaagtgtcccatcatttaagatttcttcagttacaacctaaaagaagccatatgtttgaagtgtgtgctttgtacattttatgtgaaaacatggtcccagcagtccatattatcttggaactatgcagactcccgaagccatgcctccttttcacagacgtaattattagactatgcatgccaattttaattctagaaaaacggtcactctaggtaatgttctttaagacaaacaaacaaaggctgcttaatccatgatgctgtagtcatttgttggcttgtttattttaatccccaatttacaacaaaatgtgttttttttttcttacagagaacccacaatcctattaacagcgaacttctcttgaatgaaggcattacagcagatttaaatccatgcattacaattttagcaatttaatgaacatcctatttggcgacattattgctttaaaggaataaatcacaaacattttacttcccactagcactcggtatttcaaatccattttctctacagaatgatgtgtttaaataaattgtcctgttgactgaattttgatcacattattgggtatttgggatagaaatgtgtagacagagagtcagaagtcatcacatctactgaaggctttgcagccaagaaatgaggcctcaggcaagtcatttagtattaggggacttaatttcttctcagtccaaggcaggtgtttaattgcaacgtgtcccaacttgactaggggagtttgttcacagaatcaagcgaattcccatcctcaccctcacatttggatttgataagtctgcagaggggtccactggacctccttgctaacaagctgtgggtggctctagcctaggtgcccaggtgccccataaaggaaccactatgtggttaataccagaagtcccgtcaagttggaagcttctctaaccacatcttgggctgtagtacttgacaattggcttttcttcaataaagcaaaaataccctcagttatgtcatcattaaaatgtacatgagctagaatcttatgcctgcctggttctgtgagttcaaaataagagaaactcaggaaggttgagttgagccgcatgctgaaaagagggggagaagaggggatgacttggagccaggaaggcttgtgggacagagcttcttaacctggggtgttcacccttggtccctggatggacttgagggagtctctgaatgcctgaaatcacaggcaaagtgagtgtgtgtgtgcatgtgtgtgtgtatgtgtgtgtatttttctggagagggaaggaccacagtttgcatagatttcccatggagatgttgattgcaggttggtcagaaccatccttctaactaggtggtgatttggagcacaggcgtcgggcacagagaccctgacttagagcccatctcttctattaattagctgcacacagaagctggattcccctccaagcgtgctctacctgtggcaaagtgctattgtgggactacttgggaacataggaaaagtgtgcattgtctggtactcagtaattgctcaataaataccagctacatcctaacaaatattttatggaggtccttaaactgagcaagagcaattttacctgatgcattttgaaaggaagtgatgattaactaatccttcctgcctcctgctagtcacgccttacatcaccatattgtctctttctcctcatctggatctttcgctaaagactgacaaagaaagcttcctctgatggctctggtctccagctaaggccataaactgtgtattgttgaggctgcaggagaaggtggaagagtcataatgccaggttcagaccccttggtcttctgtctgccatgggtttgctgtgctctgctagggaaaataattcatcttttgaacccctctgggacatttctgtgagttttgttggatggtcatgtgtgttcactttatgatctccacgtgaaaggtgaagttcataactgccaccagtctctaagctttgtcctttaaagtctgcggacacttgaagccctctgttagtcatgccatgctgtgatcaaaaggattgtgtttaagaatgtatagtctaaatgcttattgtgatcactaacatttgtatagttctttggggtttaccaagtactttacttgtattttctcatttaatcttcacttaggactaaaaaagttagtaacactaatgggaatgagcgaaaaccaaattcagacagtattaaatacacaaaattataaagtaaaatgagactgatttcccacgtcatgaggaaaaatgtctctttactttgtgattctttttatcacatacttaaaggcatttgcatttttccttttctgaattttctgcttttagtttttcctcttgtattagatgttcagtgtaactcaccaattgtggcagttttctgtttgattcacagtaaaaaagaataaaaaataaaaattaaaaaaaaactgtgacctgcattgtccacctgattaaaattagtttggatttttcagataaggttccttctttttattattataaacagactttatcttaagagtcggaagaaacatttaagggaactattcgtcttatttgtatttcaacctgataaaaggaaaagggatatagcaaaaatttttagtcgtttgagtgggaagtgctttatttgagataaacacaaaaggttttaagtatcgttgatattagtcaaacataatagcttttggctattgtctgaagagctcttgtctgttgacttgcagacctgtgacctctagataaagtttcaaaatgcagaaaatatttatcttcttgctatgaccttccacgcacacgacgtgaagccatggatttgtttcctagggaactagtgagtgaggaagatctataattaaatctgtgagttatatgctacacatgggaattgggtacgcaccaagtcctttagaaaaatcccataatatcaccatagcctcaactggtggaattaaactcaatttttcttcacacatttttagaaagcatcattcagaatcttaatatgggaaagttcttgtgtttctttccaaagtcagggtgtgtttagtttggcttccatttcgctctggatccagtgtccctccctgatgggacggcacctgccattgctactcaggtgagtgctttatatggaagtcttggaaaagcgagtggtagtctagtctcagacatcagcacgtcagagctggaagggatccaaggcagtgtttggcaaaagttttttgatgttcaaaatgtgtccttcaaataaaatctaatttaaaaattcactgagtgaagcagacattaggtgaattggttttgactagaagtaagggagaaagaaccttttcatcaccaccccaatcccaaaattccagagcaagaagtctctaaggcacccccgtttctcaacttgaacattaacatctaagccatagcactgattgtagagggggcagactgaggctcaagagatgttgccattggtcagccatctcatagcctctagaggttaaacacacacacacacacacacacacacacacacacacatacacacacacacaactagtaaaaaaaaaaaaagtcagaacaatgaatagctgtttccaaatctggcttgaatatattttgtagtaaatttccccatctagaggctcatgagggccaagatttctctacggtgcttttatttttcaccttttgaaaccaataatcagcctcttacattaactctaaaaagtaaaactctgtcgactctttgctttcaatgggattgtcctccccgtatcattcctcaaccaacagagggactctatgagagggaagcagaacctcaggactaccagagaagagatatttcacagataccaaggcttgacgtagatgtgaggccaggggcagggtgcggtggctcacacctgtaatcccagcactttgggaggctgaggtgggtggatcaactgaggtcaggatttcaagaccagcctggccaacatggtgaaacctctcctctactaaaaatacaaaaattacctgggcatggtggtgcacgcctgtagtcccagctactcaggaggctaaggcaggagaatcgtctgaacccaggaggcagacgttgcagtgagctgagatcatgccattgcactccagcctgagcaacagagcgagactccatctcaaaaaagcaaagatgtgagtccagggtgggtgttgatgaggacggtaataatacctgatgctttcgtagcagtccctgctccagactatatatacattagctcatttagtgtttgtgatgtctaagccgtgtgtgtgtgtgtgtgtgtgtgtgcgtgtgtgtgtgtagtagcagcttattttttttctatttctctttgattttttaaatacacacttataagtgtacatgtgtggtgtgtgggtatatatacactttcctctatctttctgatatacctatctatatatttatgatcttcccaccaacctggtaaggccgatactactactatccctattttatatataaagaaactgaggcacagaatcctaagggtcctacagctggtcgtggcagcactgagatttgtatccaagcagcctggcttccaagtctgtgctctttgctggtctacattcataccccatcttttatttttctttttgaagtatacgctatggggctttgagcaaaacttctgatgtgaaaaagaaataagaataataactccaaagatttttgctatgaggataaagcacctgacctactgcaccttgtaatttctggcaactaataatttctcagtaagtttctgtgttgctgtaaaaattgtcaaccatgtacacaaacagatctttaaaaaaaattgagacaaattaaagtgaaagacttcaaaatcagtttgtcacatttgatgctaaacgctatattttctctgagaattttaaattgtgcaggtaatttctcaccacggtaagtcatgatttttcatacttgaacagtatcacttcatctaaggaattttccccagtgcagtacactcccacccatgcctctgaaaacgtctaatctgtttctcctacttacctgttggtccaattcatttctggaaatgttctgcaggttatcataacgagaacaggagtgatctatggaataaacaggcactgttgtttgaattaattaccaggaacagaatcataagtggtgacaacttacaacagctcattccacattctcctgccactgatggatagatttatgcatttgaaacattttttactgattgcctgcccatctcctgttcacatactccctgagaacctctatgtcttatccatggagtatgtccgaaaaccaattatcatcccctttttgtttctgtattgtctaatggaagaaaagaaattataccttagaggagatattttcctgataaacagcatttagtcatttagtcattaaattagctcttttaaaattgtattatttttaaaggcatctttttattttattttattttattttattttattttattttattttattttattttattttattttattttatttgagacagaatctcactatgtcaccaggctggagtgcagtggcgtgatctcggatcactgcagccaacctccgcctcctgggttcaagcaattctcccgactcagcctcctgagtagctgggactacgggcacataccaccatgccaagctaatttttgtacttttagtagagatggggtttcaccatattggccaggagggtctcaatctcttgaccttttgatccacccgcctcggcctcccaaagtgctgggattacaggcctgagccacagcgcccggcctaatggcatcttagtcattcgacttttcgagacagccttatcagtagcctctgatgcttgaggttctcttgtgttgcttttcgttgtcatagtatttttgttgttattgttttgtttttctttctttttgttatttgctttatgtttgtatttgtcgtacgttgtgtttaatctaccccttctctgcccaagactgtagtatgtcgtcagggttgagaaccactgggttaaggagttacaaaaagttaaatttctcagggctaatgttgaattcttgcatcggatgagctcattgtaacttaggaaaatcaaaagcttgacttgaaagaatgagacaagtcaagctcttgtgagacaagccaactctttctcatgtggaggaagagttctgatggggagaaggagctgaagaagtggtgcccccattgaagcaggcagctgggatcccctgtgaaggtggtgaagggcagatgggagacggagatattttaatgaaaattgtaacctattttatgaataaaatttattttttattactgtaattttttttttgagacggagtctcgctctgtcacccaggctggagtgcagtggtgtgatctcagctcactgcaacctgcacctcccgagttcaagtgatcctcccacctcagcctcctgagtagctgggactacagttgcctgccaccacacacaactaatttttatgtttttagtagaaatggggtttcaccatgttggcctggctggtcttgaactcctggcctcaggtgatccacccacctcggcttcccagagtctggaattacaggcgtaagccaccacgcctggccccaaacaaaatttaatttaatccttacaacagtcactcaaaggaagaaggatatttgcattattagagcaccttcatgagcttgacatttttatgttgctctttgaatcctctcaaatgccagctgatttaggtttcatttttcccgtcatcagtgataaaaccatgacttgaggcaaaggtgactattcagaaccagggtttctgattctactgcctttttctactgcttggatacagcctggcctgaagcctcagggactttaggatgtagattggcaggggaaatcccaggcaggggtgttttttgatgggagaagctgtttgcaacccgcagctctggagtgactcagagagagaaatgactaatttctccattcagcaaaaatgcattgagctccagctacatgatgaggactgctgtaaattccgtggacacagcagtgaacagaacagaccaagccctgtcctacagtccacctgctagtaagggaacctgacaaatcaaaagttaataaaatacatggtgtgtcagttgctatgataggtcctgataggggctatggaggtcaatggctagagatgagagtaggttgcagttttcaacagggaggccctcagtgagaactgatgaactgggatgagtgcagggatgcatctatctgggggctgagcatcctcgataaaaggaactatgagtgcaaaagctgggggcagtagtgtgtccagaatattctagaaactgtaggaaggctggtatggctgaagcagagggagcaagggaatgttagataggagaaaagctgtgaccagatcacagaaggtcttggagcccaccatgaggactttggcctttattctaattgagtgggaaagccactggtgggctttggtgaagacagatgtgatctggcttatgtctttattgaatggctctggctgacggatggagaatagaatagagtgtggatggggcaagggtaggaacagctgcaatcactcaggctctagaagcaatgggggcttggcccagagcaatggtggtggaaggggagaggcgtggttatggccgtattctggatataatttgaaaagatttgtcgggggaagtgaggattttagctctgttttattgagtgtggttgcctgcaaaccaggctctgcgcctctctgaactgtcatgcattctttttgagtcctcttggtggttttgtaaagaagccagcctcgctgcccatctcccagaggggggaaactgaagctcagagacattcagggatttgcttaaagccccatgccaggcgttggccatggtcctggctcccaaacctgtcctttttctactgtaacaggctgcctcccctccaaagtctgcaggaaatttaagcctcctggaatttcttattgtatcagcatgaatattattaagtttcctataaactcaaattttgtgtatttaaaaagactatgaatctttctttttagaaattgaggtggttaggattaatgaccaaccataaaattttataagcaattattacggtttactgtaccttcttcagctgcttgtcgccttgccttcttttctttctcctgtagtcggggtgagttttcacatcactgacaaagatattgggctgggaagaggcacgcttggagtgagacccttcaggaagcctctgtttttaactttagctgtgacactgggatctcagtcatggaagttcactgacatctactcatcctgcattagtaatatgggcatggtgcattttctgtatttattagctatgtttaacagaatctttagaaaggaactcgatgccctgtttcaacaaagtacattgattttttgctttgtgatagataaggcaaaagcggtcactttgttcggtgtgtgctctcatcctaatttagggcccctttctgcctagaactctgtagatttccgccgtctgtgtttttccatcatcccagaccctcagctgcaagctcaggcctccagcccctcatgcacaactgctcctttagatcaggattactttgcccccagtctccctgggacttgctgcagatttatttcaaagttgtaaatcctctgtggattacctcctcatgctattctcaacctctggttctttctttttctgattgcccccaatattaacaaagtggagcaaaaataactacagttgctggaaagtggtactgtgttagtcagaacacagaggttgtatgtgacagatacacgttcacatggctaaggctaaagggtattcattgactcccatagtcaggaaatccaaaggtgcatctggctttaggacagctggatccaggcctcacacagttgcactttgtactctccctttgcgtggtagcctgatcttctcctgccacagacacttggtcaaagaagctggtcacaagctgcatccttctagcactgtgaatattaaaggcaagaggaatcttccctctgagcctggtgtggtttggctgtgtccccacctaattctaaccttgaattgtagttcccataatccccacacgtcacgggagggacccaatgggaggtaattgaatcatgggggcggcttttctcatactgttctcatgatagtgagtaagtctcatgagatctgatggttttataagtgggagttcccctgcacaagctctcttgcctgcccccatgtaagacgtgactttgctcctcattcaccttccggcatgattgtgaggcctcccccaccatgtggaactgtgagtcaattaaacctctttcctttataaagtactaagtcttgggtatgtctttattagcagcgtgagaacagactaatacacacatctaacaagaataccccaaggagaatactgtttggtataacattgggcaaatgcccattgctgtagccatctctgaggccaaataaatgggttccgcttggctagaagtacatctcattatgagtggaagtgggggaatgtcatggcaccatgattgtggtacagctgattgtcatggggcaagtgggagggttgatgtaagaaggggttggaaagcctgctgggtaaacaaatctatagctactgtccttcaccatagttctaccaaagtcaaattgcatttatagcactggagtttcacttaaagggaatgcagcactggggacagaccctagtattttttccaattgtcctttattttcagttgccaccatgtcttgagcgcctgccctatgcccccatactgttctaggtacatatgatggcaaaatgatgaataacacattgactctgccctcacaaatgctgttcattaggatgggtcttcctaaattatagagactgatcaatttacatgccaccctttgatgctaactaagacaatggagaaatagccccaagtgctaatactctgtctcttgaattgagttatttttccaaggcagtaaaatgtgaagattgcaattagttaaccattatgaagacaaatcttcaaatatttttctcactgtggtgacatttaaaatgcttcctgctcaaccaaacagccaattgatttctttcccatcttcttataatggctaattgctaagcaattgattgaatcctcttttgttactatgtaattactaagctggccaaaacgactctcccgaccatttctcagttggctcattttggtcacctataggacaggtttggggtgggaatgttcttatttggttaaactttttgcaaataatcaatcaaattgctttatgtagtgattccgagcaaaggtccaactggcagaaaggcttacatattacttggatagtttcttaacctaaactttggtgaagtttttgttgttgttattgttgttgttttgtctttgatatggaaagaataagaacctgcctcctgaaattttgggaagggtcatacgagataatacattttcagtgtttagcaccactgggacagaataagcctgtaacaaatcacaagtgttaatagtttgtctaggccacctctactgcatgcttatgggaacatggtcaacattgttaacttttgtgcctcagtttcccaatctgtaaagggaggataatagagccactcatcatcaaataaattagagtttatttgatgattgtattagtcggggttctttagaaggacagaactaataggaaatatatatatatatatatatatatatatatgcacatatatatatatacacacacacacacacacacacacacatatatatatatatatatatatatatacacacacacatatatatgaaggggagtttattaaatagtatcaactcacatgatcacaaggtcccacaataggccatctgcaagctgaggagcaagggagccagtccaagttccaaagctgaagaacttggagtttgatgttcgagggcaggaagcatccagcatgggcgaaagatgtaggctgggaggctaaaccagtctaggcttttcacgtttttctgcctgctttatattctagccatgctggcaactgattagatgatgcccacccagattaagggtgggtctgcctttcccagcccactgacacaaatgttcatctcctttggcatgatcctcacagacacacccaggatcaatactttgcatccttcagtccaatcaagttgaggctcagtattaaccaactcaatgataaaaagagagagcaaaagcatgtagaattgatatgacggttaaaggggatagttaaggcacctgaaggaccaagcccaccagcaatctgcacggatactcggtcactattttgttatttataccacctggcacagttcctgccttctaattcacactcaagcctcaagcaagagccgttcctttgcctccattcctcccagagattccccttcccatgctgaagccttggaaattattgtgaatgcaataatggtggccgcttctgtaaacactgtacttgaccttcatgcccacagtattcagcaggtaactacgtagtgtctgttgtgtgtcagggactgtgctgtggattcacttctgcagagagcagagggtagatgcagaataaagggtcttctcctgccttgagccgttcagagttgtggcctttggaagacttgctcagaatgatccagtgcttttttgacatttctggatatgatcactagctgcaatcttgcatttggtgctttttgtgattcccagctctccctccacatgctctgagaaaagtgatatccccagagctgtatccaaagaagaaatgtaaatccagaggctataaactaataggatctgagtttccgtggttgactgtatgaaagtagatttggcttctctgtgttgctgactttaacagggagcttaaaatgtgagatggagcaggtgtttgcgtgctgtatcaccaagccgttcccatggctgtgaattccgggaagttgagggactatacagacactttatcttgtggtgacctgatgcatgcaccaggccactgttgcccaacaactgccccctaagtgtgggtggaacggccattgcaatcgactcggggcgaacagtgcatctaaaagatgaaggtctgattttctttgcagagtttaaatggtgcatgtgtctttaccccaaaaaccacagaaacaatttctcttaaagagaaagagaggaactatgtacttgggctttgtatttggagattttggcaaagatggaggctgcccatcatgggtgacggtagaatctggtgtcagatggcacactcggagttgtctgactcacttggagagtacaagggcatctgcacctacaggcattgctgtgaatgacagaatcatcaacatccagggaaatgctatacttgaaaaaaaaaaaagatcagggtattagccgtggcagctatgtggcttctagatactgagccatcctagatgctagctctttacctgcatgatatcatgcaaatcttggaagcaagcctccaggtggattttattcctattttacagtggagggagctgagggctagagaggtttagtaatgtgttctctgacacatagattaaaaagtggctgagcaagaacttgaatcgcaagccctgcatgccagttgcgagccccaaaccctacctcctggggagaagacacacattgtatttctcttctcttcatgggggttacagactccgttatttcagagcagaacctaggttctctataggatggggaggtataaggactcctttctatgcagtggaagcctgtgtggtctccctgagaccttttcccacaatctctgaatcccattcatttgtgcaagagtcaagttcaaaagcagagagcttgagagctcctgtcttcatcacattgttgacttatcgttacatctgctcttctaacttaaatcactggctccttttctttcttcctctgcatcttcaccaaggagtggtagaaaaagaattcaccttggcatagacaagcctagatttgattaacagctcttaaaaaaatcattccacctatttagtgttctgcttccttctctgtgaatagggctaacgatgcctatttagattatgaaaattaatataaaaacagaatagaagtccctagtaagttgcctgtcccaaagcagacacttaactaatgtcaagtctccctaaacgttgccctcatccccacaatacgaggagggaagagtccgatgttttcattagaaaagctgccacccacacacaggatgcttttctctacttctgagtgtttatagtttcagtgattctgtgccttacaattttcaaggacagctcgttccaacctttgcgaatatgaagaatggtttttctaaattatataatagtgtgacctacagatagccttgggctttcctttcttctggctgcagcctttgctaggtacacatagggacatgcaccctgacaatccacgggggccccctctggcctgggtcctcagaatgagaacctcagcttttaggactcacaatgcaaggatgatcacgcttgctgttagcagcgcagatccagcgtaattttaaaagcaaaatgactgactacatagaaagaaaaaccacattgttttcctgtctccccatggaatgctgcctccattagagaaaaaggagaaaacccgattaggaaggatagaaacataaatggaactgtgtcaggccttccaagctgtcactgattattctaccaggcagatatttctcacctcccattcagggccatctcctgtaacagccatttctatagccgaaacaataagggataaattaggctggtcaatttgtcctttccctttcttgggtaaaaagaaaacgacttaactaaatcttttttctttaggatgaaaagagattttaaaaaacattctagtagcaaataactgtcctaaagtaggtaaaatgggaattgattttacttacctgacttcctagttgggtagttgggagcattacctgagacgggtctgtggcaacactttgtgacggccaggcctgggtggctattacggtcatcatcatttcaggaggcaaggtggcttcattatgcttcattcctacaatctcctttttgttcattgatgtgcattctcctgctttgacatacaaacccataacaccatgaaattttaaagcgaatggtaatattttttcatataggtaaaaaaagtatgagaatattccaatagaaataaccataaaacattctttctctttgtttgagtaacccctttcctgggtgtctatcctaaggaataatgtaaaatgtggagaattatttttttcagaggaagatgttctttgtagctttatttacatcattcacagtgtttataattaaaacagttgagagtccattatgattgaagtggttgttaaatgatggtatatctgtcttaaatattgcatagctaaacaaaaggagctggtaatgatagaagaaaatgctcatgatataatatgtgtattatagtctgttcttgcactgctataaagaaatacctgagatgaggtaatttataaagtaaagaggttgaattgactcatggttccacaggctgtccaggaagcagagtaagcagcttctgcttctgggatggcctcagggagctagcttccaagcatggcagaaggcaaagtgggagcaggtgtcttacagggcaggagcaggaccaagagagagatgggggaggtgctatacagtttcaaacaaccagatctcctgagaactctatcacgagaatagcactaggagggtggtgctaaaccactaatgaggaaaccccccgccgtgatcccatcacctcccaccaagccccctcctccaacattggggattacaattcgacatgagatttgggcaggcacacagatccaaaccatagcaatatgtaaagaatcaccctagcaacagtcatcaagatagcatgatacagcaggggagagatacatggatcagtggaagggaatagacaacccagagatacagccacacaaacgtgtccaactgcttcttagtaaagatgagaaaggaagtcagtggaggaaggatagatccttcagcaaatgatgctggagccattggacatctgaaggcaagaaatgaacctcaacctaaacctcactcttcatacaaaatttaactcaaagtggtccaggcccagtagctcacaactgtaatcccagcactttgggaggccgaggcaggcggatcacctgaggtcacaagttcgcaatcagcctggccaacatggtgaaaccgcgtctctactaaaaatacaaaaattagccaggcttggtggtgggcacctgtagtgccagctactcgggaggctgaagcaggagaatcacttgaacccgggaggcggaggttgcagtgagcctagaacacgccattgcgctccagcctgggcaacagagtgagattccatctcaaaaaagaaaaaaaaacaaaaacagaaaatgttaactcaaagtggatcacagatataaatgtaaaacactatgaaactttaagaaaaaagtaggaaaaaatcttagggatctaaggctaggcagagttcttatacttgtcacaaacaggtgtgaaccctaaaatgaaattttgataaattagactttatcaaaatttgaaacttttgctatgtgaaaaatcctgttaagagaatggaaagacaagctatagactaggagaaaatacttacaaaccacatatctgaaaaaggattagtatctaggatatagaaagaactctctaaactcaacagcagaaaaccccaatcaaccaaattaggaaattgacaaaagacataaacagacatttcagcaaaggggatatgaggatagcaaataagctcatgaacaaatgttccaactcattagccatgagggaaatgcaaattaaaaccacaacagactaccggtacacacctattagaacagttaatttatttttaaaaagcagtaacatcaaatgctggcaaagatgtgcagaaaccatcactcagacattgctggtagaaatgtagagtggtacagccagtcaagaaacgagtttggcagttttgtataaaactagacacgcacttaccatggaacccagcaattgcactcctaggcgtttatcccagaaataaaaacttatgttcacacaaaacctgtacacaaatgttcatagcagcttgattcatatttgccagaaactgaaaacaacccagatgtccttcaacatgtgaatggttaaacaaactgtggtttattcatatcatgaaatatggctcagcaataaaatgaatgaattattgatacacagcaacttggaagaatctccagggaattatgctgaatgaaaatgctaatcccagaggttgcatactatatgattccatttatatgatattttctttgaaaatgttatgtttatttttaatgtttgtgggtgtatcataggtatatatatatatatatatgcatggggtacattagatacagacatccattgtgtaataatcacatcatggaaagccgggtatccatcccctccagcatttatcctttgtggtgcaaataatgcaattatgtgattttagttatttttaaatgtacaattgaattattattgactatggtcacctgttcaccccgttatgctctcaaatactgggttttattcattctttctaattttttgtatccattaaacaccccttcgtctcccctccccaccctcaattaaatgaaaaattatggaaatggagaacagatcagtggctgccagaatgtgtatctgtgagggaagaggcagtctctgcaagagaggaagatgtggttgtgaaatgacaacacgaaggatcccagtggggatggaatggccttgtatctcaatggtggtgatggatacgcaagccaatacgtagataaaactgcaaaaaactaaatacacacacacacactctcacacactcacacactcatatgctcacacactctgacacattcacacacacacacacacacacacaaagtataagtaaaatggcaaatctgaataagatctgtggattgcataaatgtcaatattttaattgtgacattgtaccacagtttaacattagggaaactgggtaaaagagtattttttgcaaatgcatgtgcatctataattattgaaaaagtaataaaagtcaattaaaatatgtttatgcagttgtatgcatttaaaagactagaaaggatttatcgacattttagtatagttaactatccagtaggacattgagcatcttgctttctaccttttactttactttctctgccaggattttcctagtgagcatgtgttagttttgtaaagaggaaaaaaagcaaacctggttttaaaaaaaaaatcccattgccaagtacaacaatttacagcactctttttagtatattctgaaatagtctcctcatgatttctttctcttctgtactccaaatgtaacactaaatcacacacatgtacacacacacacacacacacacacacacacaatcatgaccagctcaagaataaatatgtggggactaagcatccaaagctcgacaccaacaatttgcagctgaagacataatgaacttttgttagtggatggaccagctgggaagactgtaaagttggatgtcttgttgtgctttctatttattattcagatctccagtccagtgtacagacagaaggtgcatcttgatggatagttcaaaagggtaaagacttagacaaaataatgagaaagggactatttggcgacatatttcatcctctccatcccactctgtggcttcctccctttgatgcacacataatttcaggaacccagagtgcaggattggtagaaacggaataaatatatagtctgttgtatgggaacaggctcagaagcctataaaagattcaactcctgctttcccttaggagaggtacccaaccagtattaatattttagaaatactggaaggtagaagaggagccattattcatcactggcaactctgtggtactaaaattaaataatggggttttttttaaagacagaattgtgaaagttgtgaaactataaaaaatattcctctcttggggatgttgcattttttgcttttatcttttcttcttctcttgagaacattttgatttactactgtgataagcttataacaactagggaacttgggagaaaagacgaggcaggctgggaggaggggtgttatggcagcttacaaatgggcccgggtacatttgcctggcttcaagtcagaaggtgctggagctgggcttggattcatttccattgtgtggcacacatatctcatgcatgggccagggacgtgccttgtgacagttagcacccacggtgccatgtgggcttgggatgtgagcatgcttgtctgctcagcaggaacttttcataaaaggtctagtcatccttttcctgaagcctggaaataatcagccctgctccttgaggagatgtctaagctgttaggactttgttatccaggagttggcatctgaccagcatctggagttttggattgatctggatgatttcagagtgttctgtacctgttcctccccctgaactagctgtgtaacccattggacaaatgacttcacctctctgggtctccttaactgcatttgtgaagttaaaaaaagcaatagaaaccaccaggtaaaatgcacacgtagctttagcacagtacgtggcctgcacaaggcctcagtgaatgcagttattacctaggatgccacttgaaaaacattttaaacccttttaatgataaaattactctccgtgactgttacatgttgtgtttcaatgcatactcatgagtgtcgttaacatttattgagtgcctactatgtgcctgccacggtacaatgtgctttagggatgcagttccattctgtcctcccgaggacctcaggaatgcaggtctattattcccaatcaacagaagggagaactgaggcttagaggggtgaaaagatttgcccaaggttaaaaccaagggcacattagagccagcgtacaaactgacccagaaatcattttctaaaccactgcaccacgggggcaggaatggtggctattgctcgggacctagagaaatgaaggcacagggaatgaagacgaatccttgctccacccatggggagacagtggctgggccagatttaagcagagatccctggacagcgcctcattccttacctgattcacacggtgctgatacgcttgttcagggctgcctcaagcttcagactcagagtcagaagggacctcagagtctatgtggtgctgatggtctttgtaacgccttaacaggatgagggtgtgagcctgggcgctgggtggcagccttgtccatcaccagatgagcttagcaccgtcggccaagttttcaaccccaggaagcctgcctccttttgagctgaaatctgtccattccatagcttgcatcgattggcttttctgaaagttaagactaaaccagtctccttttctgctggtctttagatgatacccaaaactgtacctcgtgttccatgtctctaagcattcaaccacttactgggttgggctgtgctcatcttacacagaacagatctcctcacttttctctcaaatgttttcctccttagtcccctgtctacacgtagcctctatccatccctgtatccttgtgggttagaattcaccacacaacatgatctcattaggagtcatcacctacaaagcaggtattgggcaattgtgtttacccagggtcgttttggggaatattagtaaccgaaacttgagaggaacttaaatctacatataccacccaccaaagacttgcatggatggtgcagtttccgaaaaactttgccaaagcatttattgactcacagctactatgatcttctcttgttgagcttcccttagggaaaacaacaacaacaacatattttaggtagccagagcttcagaggaagagagatattcatccaagttgatctcattgtatccatgagcctgttaattttcagggagcaagattctctagtcttaaaaatgtgtgtgtgtgtgtgtgtgtgtgtgtgtgtgtgtgtgtgtgtgtgtgtgttattgggatcttttaactaggagaatcactcagaatgactctgttggaggataccagaatatctcttggaactcaagcccaagaagcagaactggtccttaccagaagttggcaagccattttgaaaccagggtagctgtgcctgttcattgatttatgcattcattttccttttttcctgaccatatggtctctcatttcagcttgtcttagcatagcttctttatttattaaaaaatatttgagtttctactatggaccatgcactgttcacagcagagaacaaaatgaaaattcctgctagcacagtttatatttaaatggtaaatagagacaacagatataaatatgtcaggaagtatgtcaggtactgagggttcggtgaagaaaaataagacaaggatgatgctggaaggaaaggcactactttctttcaataaggtggccagggaagtcctctgcaaagagatgagtataaattgagatttctgtagcaacaatgtaatgagccacaggagacccatgtggtaaggtcctggcgaattcaagccattaccagacaccactgggaaagggggctgggatacttcagtgtcagagcataatttgggaccaaggctgaggaataagattgagtaacgttggctgggcacggtggctcacgcctgtaatcccagcactttgggaggctgaggcgggcaggtcacgaggtcaggagatcgagaccatcccggctaacatggtgaaaccccgtctctaataaaaaaaaattaaaaaaaaaaaaaacacaaaaaattagccgggcgtggtagcgggtgcctgtagtcccagctacttgggaggctgagacaagaatggcgtgaacccggaaggcagagcttccagtgagctgagatcacgcaactgcactccagcctaggcaacagagcgagactctgtctcaaaaataaataaaaaagattgagtaatgtcagagaagattatttaccagctgtagggtggtgtcaccatgtttgagcctgcatgggattcatttacacaagcattaagaactctatttcagttttccctgtaggctgttttctttgccaaggtctctgctaatggccccatagtgtcccctgaaaatggcggactcgactttcaagctggtaagacttcaaaggtcctcagtctctccctgtcccaatcccaggcttccgaaagaaatgatcttgccaggctcagctttggataggacgctctgggtcacaaagggcagcccgggactgacatagtgctaggcccaagcatggcgcttttggggaaaacggctgcaaaataggatgaggggatgtggacaaactcagcaaaagttgatgctgaagacagaggcagggatatggctataaagagccttgctttcctgaggggacttgaatttttcctgaaatcaatggggtggggggccctggaaagattttaatcagggcatgatccaattggaagagacagtagcggcttcacagagtgagaaacctcaaagctgtctacacatccttccaatgaaggcacatgcaaggcagaacagaatgtcaggatttcggatgaaaatcatggaaattttatttatttttgatactatttacatttccaggcatcagtcttcatgttaaaatttgtcctgaatgataagaataataagagtaagtgttaaaactctcagggaaagggcagtcaacgtgaatttccagccagaaagtcttcagttgttcatgttgattactagcaaatgggaatagtgccaggttcataatgctgattttattacattactttctctgaactctggtttaaataagtgcgtaaatatttggtacagggagataaacattgagtacacatggacataaagacaggaaaaatagacactgaagactccagaagtggggagggatggggtagggcaagggctgaaaaacttccttttggggccaggtacagtggctcacgcctgtaatcccagtactttgggaggccaaggtgggaagatcacctgaggtcacaagttcgagaccagcctgaccaccatggagaaacccatctctactgaaaatacaaaattagccaggcatagtggtgcacgcctgtaatcttagctacttgggaggctgaggcaggagaattgcttgaacctggcaggtggaggttgtggtgagctgaggtcgcaccattgcactccagcctgggcaacaagagcaaaaccccgtctcaaaaaacaaacaaacaaaaacaccaaacaaacaaatttccttttgtgtactatgttcactatctgtgtgatgggataattagaagccaagacctcagagtcatgcaatatacccttgtaacaaacccacacatgtaccgccaaatctaaaataacatagtaaaataagatttaaaaataaggccaggtgtggtggctcacgcctgtaatcccagcactttcggaggccaaggcgggcggatcatgaggttaggagatcaagaccatcctggctaacatggtgaaaccccgtctctactaaaaatacaaaaaaattagccggctgtcgtggtgggtgcctgtagtcccagctacttgggaggctgaggcaggagaatggtgtgaacccgggaggcgccactgcattccagcctgggtgacagagtgagactccatctcaaaaaaaaaaaaaaaaaaaagatttaaaaataaaaaataaagcaaaatctatacactaataaaaaaatttggtttaacctttccctgggaacagtaatggtctgaaatgatggaaagaagaattgaacaactccagggaagtgaagtttggcaagttagcaagagagtaagcatgtatagttcaacagcatccgagggcatgattaatttattgtccttttagatggcagaatgcacacaaaacccttcaaattacaccattattatgacaaagctcagggggtgtgagaagttaaagatgttcctgccaagagtttgatgtacagaggaaacgggcaacccactggatacacataaatctggaaatcgagactttgaagtccctcgtcctggctctgccactgacatgggcctgagatgaatgttcctgggccatgaatggccatgtcacacggagttccgattgggagctcttccatcagtgtcgggctcaatgccttgttgggtctactgggttgagtgctcctacccaactcaggacacgcttatctgttgcccctatgaagtatgggtcaagaccatgggctctgggggatttggttccaatccaaaatctttatctagcagactttggcaaggtttgtgggactcagtttcctcctctgtaaaacagattattaccaatacctacctcatagaattgttgtgcctgtaaaatgctaagaatagcatgtgccggagtcagtgttcagtaaatggtagcagctgtcattgtcatcatcaccatcattttaaactgttgagcatatttatgtacctaagcatttcctatgtctcaggtcattcactcaccatgagcctttccattattttccattgtgcagaagacaggagtgaggctcagagaggccacacagctttctataagtccacgttgtccgtgagccctgaactgggatgcagatgcgtttttatgtgtctctaaaccctgctctgctaaatactgtgtgtgttaatcaggataggttaggctttggtgacaagaaaccccaaatttcagttgatcaaaaaaacaaaagcttgattaagctccatgccctcagaaggttaggtgggaactgtgttcctcgttgtcattgtcctttctttgggacccaggtccatgaagtcactacaatttggaacattgctggtcaccatgaggaaggaaaagggaatgtatctaggcacactagagttcctaatgctttcgcccacaattaactgaagtgacacatatcactttcacttacacttcactagctaacgcaagtcccatggccacatccaggtccaaatggccaaggaagaacactgctgtgtgcccagaaggataggagcccacaggggctgaggcagccaccatgattactttctgataccataaatctgatctgtgaatagaagagatgggaggtacaggagatccagggttttcaccagagattccaggagccaccttgacttaaagcagaacaaccaaaggcaaagccaaggagagtgttttcaaagggctcagtgatcaggagagtgaaacacacagcatgcattaagaaatcagaaattcagaaagagacacttacaaatacctagttattcactgggacaataagggatgtaaaattatggtactgattggcaatttggggggtttgggcccagcaaataaaatgcaatgattgaatgacccaaagatgactcctcctcctccaatctgctgaggcatctttcagcgcatctcccatgttatgtaaaatgaggttcatagagtttattgagcagtggtcccttgaaggccatgagtactctggaagtcagaaatgatcaataagtattttgaatgcaagaaaagaagttgaggggagatcatatgttacaagaaatggtgcccaagaggaaaaccttttttttttttttttttttgagacaaagtcttgctctgttgccaggctggagtgcagtgacgtgatcttggctcactgcaacctccacctcctgatttcaagcgattcccctgcctcagcctcccaagtagctggggctacaagtgtgcaccaccacacccagttaattttttatattttactagagacggggtttcattatgttggccaggatggtctctatctcctgaccttgtgatccacccgtctcggcatcccaaagtgttaggattataggtgtgagccacggtgcccggccaaaggaaaacatcttattcaaaatcatgagagagaaactgaccatgaggctgagcgaatgtcagtgtaggttgggatatattattaacaggcatagactgagctcttacagtgagaacagccttgtgctggttacatatttcattacggggtggcctggtgtgctttgggaaggacaggcatgaaagggtgactcatacatggcctatgggtcctatgaggaaatttacctcaaccaggggaggaggactttcggcagcttttcccttctctctctgtctgcttcttaatatcacaaccatcttctcaaaaacaaacacaagtactgattgcctacgaagccctctggccgtgatttctctgacaatctcagaattcacctaagacttccctctgcaccatctcatgctatcttcatcttcatctcatgaaggttcatattgcagcttctcatgcacatctcatgtccccaggccaaggggctgggcatgagatccactgcacacctcctccagtgtcacccatgacgtgctgcaatggcagatccctgaggagctgtgccctggatctcatgcccagctccaagatcagcatgccaggcattctcacatgcacccgacagttttgtccttttaggaaaatgtcgagatacattcattcactagatgacaaatgtttgaggaatcactgtgtgccagaaactgggtttggctctgtgggataccagcgaatacaatcagacgtggccactgctcctaggaccacagagtctaatcagagagatggctcttaaaccacaagagttacataacatttcaacagttgtgttgtgtgggtgagctagaaaatttcaaaattatatactggaggaatttgacttggggggacccattattttctccaatcaagagaccaaggacactgaccagagtatttttctttacagagcctcctagtgcctacaattcacaaaagggccttgaccttctctgtgcattcaaaccacagtaggttaaacaaacaaacacattaagggaggactggataaaatcacctgtactcagactaaaatacttcggaatgtgacagatctggaaagcaacataaaagcaaggacatagaggatctgaatagtttaatcagttaatactagaaaagatagataaatatggaactatgtggcctacaaagagaaaatactattttttttaattgtggtaaaatgtacatggcagtggcattaagtacatccacattattgtgcaaccatcatccccatccatctccagaacgttttcatcttcctcaccttaaactctatacccattaaatgctaactccccattcactgcctctggaatcctctgttgcactttctgtctctattaatgttacaactccaggtgcctcttgtaagtggaatcagacaatatctgttcttctgtaactggcttatttcatttagcataatgtcctcaaagttcatttgtgttgcaataggtatcagcatctccttccttttaaagtctaaatagtatttctttatatttacacacatgtagacacatacaatctttacatatgtacacatataggtacacatacacttttttaaatccattcatctgttgatggacacctgagttgttcccacattttggctattgtgagaaatcctacagaatgcttattctttccgtgtgtctatgggtcacttagtaaagatgatattgcacctggccaataataagttttaaaataacattcaaaggtagaactgttattagccacattagtatataattatttggaaaaaaataaaacccctgcaaatacttagaaattaacaaatactctccttaaaaaaaaaaaaaaaagactgaagcctagtgaaaataaccagaaaaaagggcacactctcagaaaataatgcaaaaaacccaacaatgaacattgacttccttagagctcagtttaagttagacttaagcataatcttaagagtctgctatataagaaggaaaccagactggcaaaatgaccactaaaagatgaaggatctggatggtagattcagatcccctcattgtgtgttgctggagttttatttttcttcccaagtgctccatcttgcctgtaaccttagcgccttccctgggatgatgggagctccatttgaccttggtgatgaacacagacagccctaggtggcgtgagcactgctgattgataaggtgggtgtggagcttctgtccttctcagtggattgcgagaactttggctccatgtttcttcaccagggtatggggactcttggccatgagctttccttagttccctggctaatttatgacctagaggttgaacatggttgagcagcataagggtgagagaaaagcatggtactccagctacccagactgctgaatggctgtgtcttcaatttcaaaggcatggcaaggactaacccacagctgagaattaattaatgcttacagattaccttacagaagcaatctaatgataaaacacaaatgcctctgaacagctataggtaaaggcaacagtgtttttttttttcctatttaacgtagagtagaaaacatcttctaaattagcatatgcatgtaactccaataattcctcttacatgtttttaaaagttgtcttttcctgtgtaagtaatataggctcattttataaaactgaaaatattataaggtgaaggaaaaagtattacacctaccttcatcctctaaagaccagtgctgttcacatgtgatttgttcgctttggtagccaggaaggaaggtctaattatttcctagttttgcacccttgtgataataatgcatatgtatagttatcatcctctgaaaatgtgtcccttgattttctacatagaggaaaactaggcgcatcaatctggttggatgtgacagggaaagggtactagaatttatttatctagaagctgccttgcctcacaagcagtgttcacttggagggtctccatttaaagggacccctgcaaattataaggatagggagggtattaagtcccttttcaactcctaagcattaccactgcctgggaagttcactatggggatgttctgctgaacccctatcaactccagtgggggtggcagcaggttcaagatgccaaagaggagacctggagccagcgatgagacgaggggttttattggatgcttccatacaggggaatccagtggtggcaggctgaacaggagaaccacaaccacctgtaaaaggcatgcagtttatatagcattttcagttagcaccctttccctaacatccttcacctggcaactttcattccacctatgagtcagggcctggatctgccgtccatgttccatgggacaggccaggggttcagatgttcctcatagacaaggaaggagcctccaggtcggccactcccagatttcctagcttggaacagacatccgggtgcatcctccacacagagtcattttcagggtatgcataagttattgctatcaggtgcatttaccatgcaggggaattgtaaaaagagaaataaaggtctgaaaatgtgtctccaggtaaagtggctgcattttccaagaaaaagaaaaaggaggtttgtatgacagaccttatttttaatttgtgagtttatgaagcattttataatcatataaaaacaggcaaataaagttgtacttcttcactcagagtgttaatcaagtgtcttctatgttccaagccctgggaatgtgaaagagaataagaaagcaacagcctgagggacagttaccaccacccaccaagaggcaaggtgctcccctagctttaacagaccttgcaggcgaggagggctagagctcaggtggatgaggttaagtctgcatggagtgggcaggagaaagggtcaggggaaggttcagtgggtaagtaatcgccggcaccaagtccaggaagatgagggcatccccagcagagtaggtgggggatggccatccagctaaagaaaggcacagctcagagggctgtgcctcatgctgggttgtggcttcggactggagaagcaggtggagacccatcaaagaagagctctgagattttaccctctggcagagggagccattgcaagttttcatggggtgttttttgtttgtttgtttgagacagagtctcgctctgtcatccaggctagagtgcagtggtgtgatcttggctcactgcaacctctgcctcccgggttcaagcgattctcctgcctcagcctcccgagtaactgggactataggcgcctgccaccacgcctagctagtttttgtattttcagtagagacggggtctcaccatgttggccaagctggtcttgaactcctgacctcaggtgatccaccttcctcaacctcccaaagtgctgggattatgagcatgagccactgtgccaggccgattgcaagttttcatatgggtactgccccagtcagatgtgggtttgcattttagaatgaccattctggttgcaattaggacaggagatgggataaaagagaaatcagaaacatggaggccagggaagagactacttaatattcatttacgtattcattatgcaatgtttatttaaaagcccaccacgtacggcatactgttctaggctctgaggacaaagcagacaaagtagctacttgagatctgggttaaggagcagaggatagaggttggcagagtgtgggaggaggacaatgacttgcagaacttggcaactctgtcattctgatacttcaaattcattttctatacaaggaaaaaagagtaaccgattaaagtgcaattcaagaaagtgagaacctacagggaagtaccaaaatatacaacgaaacgccacagtcacacatggcagtgggggatcctggattggattttggattaaaaaaaaaaaaaggttactagaggccgggcgtggtggctcatgcttctaatccgagcactttgggaggccgaggcaggcagatcacaaggtcaggagattgagaccatcctggctaacacagtgaaaccctgtctctactaaaaatacaaaaattagctgggcgtggtggcacgcacctgtagtcccagctacttgggaggctgagtcaggagaattacttgaaaccaggaggcagaggttgcagtgagccaagatcacaccagtgcactccagcctgggtgacagagcaagattccatctcaaaaaaaaaaaaaaaaggtactagaaaaactgatgaaatctgaatacataaaatctggagtctagttaatagtcaagtatcagtgttaatttatcagttatgaccaatgttccatttttacgtaagatgtcaacattaggggaaattggatgaagggtacatgggaactctgtagtatctttgtaatagttctgtaaatctaaaattaccacccgaagtttataaatgaatacacacatatacacatacaaacctcaacctcaaccacattgagtagaaataattgtataattcatatataatgaccttatttatgtaaaaccactcaaagctgctatatagtctatgagttcatatgtatgcaaatacattaaaaacacacaccacattgtatcattcattacagctgagaatagaggtaggcatgggactttgcaggggaactgaatggaacattggctttgtccatattgtgtcacatctgtaaaaggcataccgtgagaacacccttaaaatcaaatcaaggagtcactacctgctccaggcctcagtactccctgcccctgcccggatgcagaagacactggtcccagctatgcgacgcccacctcccccccccaaacagccagccaggaagtctctttacccaggtatgaggcaagactcctgtgtgctatttacatgcccttccagagtgttgacaccaggggctcatgttctttctcatccttagctattttttccattccaactcagaggacaagaaaaaaaaacatcccactgtgaaaagaagtgtggaattacaaagaataataggaagttctcgctaactgtgaagccctgctatggagtatataatgggccttaacagctgctgcaacagtcgagactcgtggcagggtttgctttggccagaggagtgcactggatttcttatatttcttgacattaaacaacaacaaagggctgcaggctcagctgctgcagctgtggagttcccaggagttgagcacagcataatcaaggtggtctggaaacacacttgatttgcatggagtggttttgaagcatggctgagtgtatccttgggttatggtcattgcatacctcccatcccccagttcgtgaagttggaatatgctggggtccctctgaaaacccagctaggcaccaagaagccagagaggtggtgggtaattcagaagggcttgagcttcctcctggatctaaactaagccaagacactgagctttcccctgaagagggactttccccactccactttcatgctttcctcgccaagcttcctccaagccatggggtgcctttaacacacgtagagatgttgcatctagtgactttaagaaaaaccaactctgctttctgaggtcttagaaacaggtttttaaaagacttcctgttagtgttatatgtttaaaataggtctagaaagaaggtggcaaacagacccagcctatttttagcagagggctccaaacagtagcggtggaaaccagcatcagtgatactcaacagggatggtgctgaaagctgcccaaagcagtggtcttcaaacttgggtatgcgtgagaatcacctggggaggggggattgttaaagctcagattgccagcaattctccccctaccctgatttctgatacaagaggcttgggggaagcctgggaatttgcgtttttaatgagttcccagtgatgctgatactgttccagtgaatcatatcttgagaccaattagtctagagaaagcaaggcccctactggaagtgacacccaccatttccctgtgctggtggtcccatagggcctctcactctgggaacaccattcttggctgtgggtgtttcttcaaagtgaacatagctctgaggagcaggaggcaggttcagcagccacatccttaagaacataaaaagttgaagagagacagaagagagacagacgtgtgcagtgctaagctggggccctcacaatggggactggcttctttcctggggaataagtaatttcaattcagcagcaggagccaactcagctaggtcctgcctctaagacctttgtgtctgtaccaccaagtggctcaagctctctgagagagggcaagaaaatgactgagacccacccttggcagcagaagggaaagtcaccctgggataatttctgggtctagaattcagctttctgtgccgagtggcaggcagagaaacgggagggtggtgatgtttgtcccaagaggcccattcccccaccccctccttgtttcttctagaaggtctgggtgctgtgttcccaactttttctgagcagagaagggtcaagaaaagataactaacagcccggaaggcttttcctggcaggtcttcaccagcggggcctgtgtctggcagatagatgggtcagagaagcccattcttgggaagcatgattgcttcatagctcttgtagaattcccatgttcgttgctcgtcagaatgcattgtatgttaatagaatcttcaaaaaggacctgctcatctcaggtgtgcttaggagaacaagaggaaggagttttaatccatatttgggcaaaggtggtaatgagaggtgaagccagctggacttcctgggtggagtggggacttgcagaacttttcttagaagaggatggtaaaatgcaccaatcagcactctgtagctaggattgtaaaatgcaccaatcagtgctctgtagctacctagaggtttgtaaaatgcaccaatcagtgctctgtaaaaacgcaccaatctgcactctgtggctcgctagaggtttgtaaaatggaccaatcagcactctgtaaagtgggccaatcagcactctgtaaaatagaccaatcagcaggacatgggtggggacaaataagggaataaaagctggccacccccaaggcagcagcgacaacctgctcggatccccttccacaccgtggaagctttgttctttcgctcttcacagtaaatactgctgctggcagagaggggtgaagcaataatgaccacagtgacagagaagaggtgagtgtgcttggtgaccccttcccacgcagggagctgtttccagagcacttctcttctgggaggcctgtgaattttgttattaaaaaggaaacctaggccggacgtggtggctcacacctgtaatcccagcactttgggaggctgaggcgggtggatcacatcaggtaaggagttcgagattagcgtggccaacatggggaaaacccatctctactaaaaatataaaaattagccaggcatggtggcgtgtgcctgtagttccacctacttagggggctgaggtgggagaatcacttgaacctgggaggcggaggttgcagtgagccgaaattgcaccactgcattccagcctgggtgacagagtgagactctgtctcaaaaaaaaaaaaaaaaaaaaaaagaggaaaccacctattccctcagaaaaggatagagataccattcttacccattaacaacagtgtaattttattgtgatgattaatattggaattattagctttgattaactgagctccttctgtgtggcaggacatgtactttatagatgccatctcattaaaccctcggcaatgctgggaagtaagtggtgtcatctgcactttaaagatgaggcgatggaccgtgttcatactcacacagtggatcactgggaaagctaggattgcaacatatagctgtctaatccgtggagttcattctcgctacttgccagccacagggatccaatggtgagcccagtaagctgtggctcttgacctcatggggcttccaggcagcaagtagaggggtcagtggaaaagtatcagttggattaatcaagtcaagcaatgactgaaaattattttcatcagagagtatcaaacacctctttttttttttttttttttttgagatggagtcttactctgtcactcaggctagagtgcagtggagcaatcccagctcactgcaacctatgcctcccagattcaagcgattctgctgcctcagcctccagagtaacagggattacaggtgtgcgccatcacgcccagctaaattttctgtagtttttgtagagacggagtttcaccatgttggccaggctggtcttgaattcctgacctcaagtgatccgcccaccttggcctctcaaagtgctgggattacaggcatgagccaccacgcccggcccacatagtttatttttaattttcttttgtatccaattttcagttactcttaaaaatacaaacatatgtaattggtgtttagtcaacactcagtgtattttaataaacaacattttttaatcggaaaaaaaaaaaacctgtaatgccttgagtgatcctgccagatgaaccctggcgtaaagttcatgctgccttaggcaccattgccacctggtgtcagacatcggaattgcaggcttggcggcagctaaagtggcgggggtggtggggtggtggagcagggggcgggcaggacccattttgattaggagagggcaggtttcctgtcttagccacctaaaccctccaggcgctgttgagtatgtgtcaacaggtgcctgttcgtttgtaatttggtgacagctagatctgtatcagctttcttttatctgtgtgtcctgaatgattattgtgttcatgacctttcaattgttttgttataatcaaattaacgtttgaaggttctgatgataaagtgacataaatatagatgaatacttgagggtaaactctagattccacttatgccaataatagttctctttagttgcacatctacataaaaagaccaccccccatactttgaccccaactgcttctcagcctaaccctctacatgcttaagcatatgccagtaactcacgatttgcaaaactttccagactcttccttgtctgcctgctgcctttgtctgtgctgttccctctgcctggaactactctcctccacctttcccttccaaatttattcttcaaatgtcaaatcaaggtcgacaatttgtaggaaaattccataaagtaaattcagaaacgacagtgttgtatgttgtattgcagtgtctctagagaatggaagatgtggttctgaacccatttttatctctttcatagctttggccatggccagcttgctgactcattctatctcagtggtttcatccattaagtggaaataataatgtcctctgcctccagcattgaaatatatatatatatatatatatatatatatatatatatatatatatacacaaccctaatttgaggtttatatataacatatatattttatttattatatatatttaatacatagggatttaatatatgtaatatttaatatatataatggggtttaatatatataatatgtagggtttaatatatatattaatatataatacataggggtttaatatatataatacataggggtttaatatatatattatatatcatatttaggggtttcacatatataaaacccctaaattgaggtatctatatataatattgatgcatatatatttaatatataggggtttgatatatataatatttaggggttatatacatattatatatataagccccctaaatagatgtgtgtatgtgtatatatgtgtatatatgtatatgtataaaccttttctgatgagacaaagtgcttcctctgcaccatgcctagtacctagtagaagtgacagggcaggtgacactggattagtggatatatgtaaatacctggaatcttgatcaatgcatgcgcagcaaatggcttccattaccttttttgttttgtttgcagataaatatttttttgaaaaaaatatatttcgtggagttaaaaataataaaatgtccaactttgactgaactggcattattgccctccttgatccatcactgtatgtcacccgagtgctggtaagcttcctcagctgccagctgcaaagacgtggatattaggatgaaaggcgttaggcagtgatgctatttctggtgctgttactttagtcaaatctgtgttcaccaggtacccatgtgctggcacctgtgattagtgaattgctcatgggagtatgtttgcaatgtgctttctctgtgttttccaggcagttttaaatgtctctctgtttttctgactaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaagtgagtacccctctcccatgcccaccctgtgcgcagaaatgtggctttcaaagattgttttcttcccactgagctcattatttctgtgcctcatcaaacccgggactgcatggctttagggtgtttctgtgggagctgaagtggatggaattgaaccctgacagggcaacagtggggggtctttatctcatcagtagagccctccaggcctgcatcagactttgggtaccagagaccaagaagggagaccctgggggcatctcagaggaggtcagaacccttagggcaactttggctttccagagaccagcttgatgatctagagctggaagaggtataaaccccaagacctgatataattagcaagacatggtccttagggtgaaaacagttgctaaatattcagccataaaggagtagttaaattatggcagattttgcaaggcagttttctctagccatttaaaatgcttctgaagaagttgtgttatatgggagagattcaagatattgaatgaaaacaacatacagacacatatggtatcctcattaccaatggagtatttgcacatatcatgaggtgtatatgtttaacaaaaatgataaagaaaaatcagtgggttaatggttgtatttggaagtgattgattgattgattgatttggttttcttacctacttaaatgcattattgtgagtttgaagtgagaagatactataagggcgttggaggcataaagtgctggacagacatagagcagtagcatgatggtaggtagtaaagtccccaccctccagcagaacccttactgggcaatgcgctcaagggtctcaggccctgggaggatgcgggtgctttccagatgtccatctcggaagccttgccaaagccttttctgagcatttgctgggggagtcacctgtcaatgagaactgaaacgtgagccatgagtcccaacttatactcaagggggaatcaggtagttgtataaattgaatgttggtgacctcagaaatacccagttccagctggccttgacagtaaccagaggtgacctggcagctattggggtccagctcctgtaggaacaaccagcagcagactatggatagatgccctcttgtctttctgtgcccatcatgggagtctccaagaaagttctggcacaaaaaactaaggaaagatacaataaatttcataatttcttaacagagtgatcaagagctgtgggatctgatatggtttggctgtctccccaatctcatcttgaattgtagctctgagaattcacacgtgtcatgggagggacccagtgggaggtaattgagtcatgggggtgagtctttctcgtgctgttctcgtgatagtgaataagtctcatgagatctgatggttttatgaatgggagttcccctgcacatgctttcttgcccaccgtgtaagaagtccccttgttcttcctccatcttctgccatgattgtgaggcctccccagccatgtggaactgtgagttcattaaatctctgtcctttgtaaattacccagtcccgggtatgtcttcattagcagcatgagaacggactaatacagcatctgagatcctccattcaggtctcagtgctgctgcgtactgagctgtgggaccttgagcaacactcttaccctccctgatcttgggattcttgtccataaagtatgattacagctaacgcttctgaggattataaaaaatgaaattactagtttttgctaactagtaattgctaaacagctaataaaacagagcttcggttgcagcttggagcttcccatactttttaaaaactgaggccatataatattacggtagttaaaagcatggattctgcacacagccagattggctgcattcaaatcatggctatcatgtactaggtgtggaaacttgacaaattgtctgcctcaacttcttatcctggaaaatgggaaaaataataatgatgtcataggatttcataaggattaaatgagttaatacatatgaagcatttagaaaatgctggaaacatagtaagcatcatataatcttcctacatgggtgacaataatcaatgatattaaaggtgaaggaaggtaagtgaaaacccaaaggattccaagttatagcccaatctctcatgtccagcacaaactttccttgagtagtcttgagtttttactatacttttatagtctatgtcatagcatatggattgattgagcaattcattcattttacatacatttaattgagtgcttatagggtaagggacacgcttcaaggtgttcggaggatacagtagcaacaagacacactgggttccttgctttcatgtatcttttattctagttctttgtttcggaataaactggcttgaattcctctcttctgtgtgtaggtgacatggcaggaagttgtgcctggtttgtaacatggcttgttgataacaccagcacagggtcatataccctcattggaaagggtactggtatttagtgggaatgcagtttcttacacaagtacttgggttacttacgactggcagactggggcccagcccttggcagcgcactcttcaatgggctcatgagggcctactttctgatgccgtttccctccgtgcttcatgcacttcagttcggtcattgtcctgttttcatcatacccgcactgaagcttcttacagttgctgaagcttcttccttgaagaagcaagtttgaggaagagccccgatcattctgcggttctttatttttagatgatgagaactgggttactctcatgttggtctactttgggcacaggaatgttgcaatttccgttcattccaagtgcctgtttaagaataagttactattttagtagtacagctagatccatggtattcatggtagtcaacacggttgggagcaaatgtggttcttcaaagaggagaatcctgggtctccaaatcctcacattttagtttctagtcttgcaagtttaaaaaggagagagccgggtgcagcacaccaacatggctcatgtatacatatgtaacaaacctgtacgttgtgcacatgtaccatagaacttaaagtgtaataataataaaaaataataaataaataaaaataaaaatagaaaaacagagcaagaaaaaaaaagaaaaagaaaaaaaaaaaaggagagagcctgcaggtgaatgtgttgtcatcataatagcgccaatgtttctgttgtttaaagttaagtgctgctcacatgcaagtacgtgttgatgtattaacgttttccaaatccaacaagaaatattttgatctaaacctcagggatttgtatgataagaaataatctggaatacatttgtccttgggcccctgaaagtgcatcaccattgaagctcctgtttattgaacactgcatggcagatattatgctaaacactttgtataattctcttatttaatccatttcacacaagagacttaagaagtaggtgttaacaccatttcacagataagcaaatagctgttaaacaactttttcaaggtctcacagctggcatgtattggatttgggatccatatccatttcttttcagctccaaagccccacattttcaatcactaagaaacactcttcctattttatccccagctagattttatatctaatctgcaaattccttagctcctttcctaggaactctgcttaccggggctgggaagggagtttggctggctgggtgatctattactttttaaaaaccatccatttccgtgacccactgccatcttgccactcctccctgccccagcccccagaaaaacttccccagcttctgacccaaagtagcacctggcaaaataatttatctcttgcagtattggaagctgacatactaatgcaaagcctcctgaaatattactcattattatgcattttgccagcatttgagtgatatgtgaactcttcactggaataaagtactgtaaatgattcatgaatgaccaagtttatgaaattctataaaaatattagcaggtggtaatgattccctcacactgtgaatatgatctactggctgcaaatttgccaatatgggatgacgggagtggagtgggagaccatctgttaggcgagtgggggaggaagacggtgggggggcggttgggatgggctctgcaggaggtgcagggcaaaacaggaagcatggccaagaccatggtagcaggcaggtgtccttggcaggagaccttcacactgatctgttgtccagtgggagatgctcagataactgggaatgtcagagctgggtgggagaagagaggagcatatggaagaagaggcaaaactaactttattgagcatctattaagtgcccaagaattccctagatccctgacatacacagacctatgaaaatggttatcttgtcttcactgatgaattagatgagggctaaacaggttcccaagatgtatttttactattaatgttggggtgaacatgtcttgaacatttacagtgtgccaaggctccatgccaaatactcagatgatggtctcatctcatcttcataaagataaccttgatacgtctatcacactcaattctagaacaggtaactggaaccacctgtgttcctggcctcagaacatggaaaggacctcactgccaccttctgagtatttgctcacatttcatactatataacttgttcttttttgagccaatttcttggtcaagttttgaatttgtggtcaagaatgttgtcataaaattgaaatacaactggcattcagaggtatccttgctcatatattttcttttgttaatgtggctctacccctattctaacccatctgtagctccatgacaatttggcagaatacacattaaagtgaaagctgctgccgtcatgcggaaataggtgtatcataatgtcagtgcttataagacgattgggagatatagatgtacccatattagagagttatttaagtgattaacctggttataaaaacgttcatgttatgaacaaatgatgcacatattaccttgatgggattgtactacacctgattagacttgtacttggaaaggaccccagccctcactagtagggacatgctatgtaagtcttctttgtcctctactctggtctcccccattgctacctttcttagccagggttcttggtggcagtcaacaaaatcacctccaactagtttacaaaggaagagatttattaaagagtacaggtagccattaggattgcccaaagtgccaagtaacctagctgacaaggccagatgaggtggtgctacaggaaatacccacatatgaaactattctagggcaaggtttttcaacagtggcactattgaaatttgaggctgggtgattctttgttatggggggctgtcctgtgaattgtaggaggcttagcagcaccaatggcctctacccactagatgccagtaccaccaccccccacccacacacacacctaatctggacaatcagatatgtctgctgatattgccagttgtcctataaggggcaaaattgagaaccactgttagagagaagtgtcatagtccattttgtactgctgtaacaaaatatcggagcctgggtatttataaagaagagaatcgtattggctgtcatttctagaggatggacaatccaaggtcaagacaccagtaggtttggtgtcttgtaaggccattctcttcttgcaatatggtgcctggcaccttgcaccctccagaagacaggaaggctgaattctcatatggcagaaagtggaagggccaaaagacagcacctattcctgaaagccttttaaattaaggcatcaaacctacccatgagggtggaacacgcatgctctaatcacctctaaagggccccacctcccagcaccattacattggctattacattacaacaagagttttggaggtgacaggcatttcaaccatagcaaagagtcaaggtcgctgctggctcttcctgccactttgctctgatgctcacaactggatgtggcagccctgcttgggttacctaaaagagccaggtgactttgccaagctcagaacctctgatctgcaaagcacagctgtggcctcccgccactcacttccatccagtctcacgctggtgcatctgcaggaagaacctagaccgtaagcaggactctaggtgcaagagagctgggtcaacatagtttttagtttttccagctccctggtacaggaaagtccgcttgccagaggactggagtggtggttgtcatctaccacattgtgatgacatgagtgcaatttttttaattccatgggtttttggggaacaggtggcgtttggttgcatgagtaagttctttagtggtggtttgtaagattttgctgcacccatcacacgagcagtatacactgaacccagtttgtagccttttattcctcattcccttcccactcttcccccttgccaagtccccaaagtccattgtatcattcttttgcctttgcatcctcacaacttagctcctaattatgagtgagaacatatgatgtttggttttccattcctgagttacttcacttagaataatagtcttcaatcccatccaggttgttgcaaatgccattaattcactccttttgacggctgagtactattctaccatatatatatgtatgtatacacacaccacagtttctttattcactcattgattgatgggcatttgggctggtttcatatttttgcaattgcgaattgagctgctataaacatgtgtgtgcaagtatctttttcgtataatgacttcttttcctctgtgtagatactcagtagtgggactgctggagtgcagttttgttccaagtgagagcctgtcagtgagaagcttagttgcccaaaggcaggtaacaggcttacacctaggagactgtgttctcaaacctgtgatcttcacttctgtcatcattagggtcctatcaatcaataacacacatgtgacctaggcaagagccctgagtgggacaaaacaaaggatttgggttaaaagcccaggctttggagccagacctacggagggaagaatctcgactctcctatcacgtgaaccatatgaaattgccattcttacaggtgaaaaagaggtgaacattggcaatttcatggttcattctaatactctgacacctttagccagttacttctcagcctctgttttctcatttttagaatgagagtgagattacagtatcatctcctaacagtgttatcattagtgggtgtttatcactcagcccagtcacttagtaagtgttccggaattgggagccagcctgccacatatcggttttatagtttaagctccctgcaagtacaatggagttgaaagcacttgtgagggagcagctagcaggtaaacagttgaatgtcagtaactctctgtaaaagggaatcatctcactgggcagtttcaaactgtggccccagactaacagcgtcacctgggaacttgttagagatgtaaattgttaggtgctttcccaggcctgctggatcagaaactctcggggtgggtctctccatctgggttttagccagcccaccaggtcatcctgacgctcactgtagttggaggaacacaggtctaaataatcacactcttgggtattaacatcatggcagctgacctgatcactaattggccttgatgaagatgacctttgaacctgtttcgttacagttctggtggggtaacatgtgcctcaactgtgcttatttctcctggtgctccggtgtgccatttgaaagccctctccatccaattccaactcttccaaactgctttctttttgtttcattagtggcacctgagagccaggcaaatttgtcccaggcttccttgctgcatcctgcctagactttggatgactgttaaatgccatgttactgcgtgtttgcttgtttctcagccagagatgaagatgtcctcagaagattggagttggaacaggctgatgtaattcctgataggggaaattagccttggggtcggcagaaccagctttatctgccttagtagatctgtgaccttgaacaaagcatttgtggttcttgaactttgttgcccttagaatcatctggggagctttgaaaaccctgaatgcccaagctgcactccaaaccaattaaatcaggatgtctcagagtgtgaccaggtgtcagtatgtttataaaattctccaagtttttccattgtgaagccaagtttgagaaactgttgtgttactataacttgtctgtaccccagttcgttcataattaggaattaatataatgataccaaccagctaggtgtgtgtttgaatatcaagcgagacaatgcaggggtttctaacacaaaataaaagtcaaagatctcatttctcccaactgcttcactctgagcaaacatctgaggctgctttctaatgcctccttggacacaaacacttaaaaataggaattctgagaaacagaatttaataaacaaacgcttgtcttctgagtgcttgtgaaaaaataattcgaggtttgttcacagcccctccctacccctgcacctctgatcacctccacctgactttttccagttcgtctcttcgtatttccaagcacttcattttattacaacccggccttatctgtcaggtgcagctggcgaaactgaggcatgaagaggttaaacgaccttgtggaggcagctacatacctggattagactgctgagttgcttctgactgattatttatttggtccactaagcaaagctgcttcctcactcagggctatggaaacatatttttctctgaacttcattagcacaaactcctcagaagaggttcaacttgaatcttggcaggtgggagaaccccacattccttaattttctcttctccacccccacactggtctttgcacctgtggcacctggcccacactcggtacttagcacacatccatggaatgaataaatgacaggatggctacccttttttttctgttttagttgtctaactacaaccaggtctacttcatcatgctgattcttcaaattacttggcggcattttctttcccaaggtgcggaagcatcgcaatacattgggactgcaagagccttagacccattttgtccagcccagcagcccagcgaatttacagggaacaagttaaataacggggcaactgctcagactcccaggacttgagattccctggctatgacgagcattgtgagtgacactctgggaccagatccccaaatgcaggggcacggtgggggaccatccattccagctcccgccacccattagccatctatatgccttcagctatcagcataaagatatttatttttatttggtaaaaatgagaagggagaggaagaagaagtgcattagtggtgtggactggaagacagaggagcgaaagaggggatacggacaggttgtcctcctacgctgggaccctgaagtgtgttgaagacccttgggttcgagaacagaaaatgattgaagtcatgttttacgaaagactgcaagattgaaagtgaaggccagaagctaattaaattgatcacaaacgattgggtcagaacccggatgcaagcaccacagctatgggaacaggtggccaaggattacacagttggaaagagaggccccctctgacacctgtagcactgtggcatgggaagtgctggtcttcaggggtgggtcaccgtggtgacatctcccgcagtggtcctgataagggaggaggcagcagcagttggcacatggtatggaagctgacattgatcagggggcccttgtgaagccagccttgggcctcccaggaaatacctggggaataatgttgtgatgggggctgagttcctgtggagcaggttggaagctggtggtgcctatgatcagggaataaaggcaaatgtgtcccatgtcgtcatgcaatgctgggaagccagccaacctccgtgttacccatctcgattctggcctgcccactgcttcctgtttaattgaagcagatgcgtgactgctctggatatgaaatacggataacctgtgagcaaaacccccaggtaaaaagcacgtgggggagcatgctttttggccagctgagtcttctcttccagtctagagaagtggaggaaaacaggggagcatctggggaccatagagccagcgtccacgccaggcagtgcagactcggcagctccatcagaaagggattcagctcaacctgggggccgattcattcaaaggacattgatctggcacccaacttgtgttagccactatttcacagtgctggggatacagcagcaaacaaccaccaaatccctgcttcatggagctctgtcaatctacaggcattagtgagtatgtgacgatcaggtggccctaagtgctgggaatagacacggagccgataaaagatatagggtggtgggagacactgcttggtccaggaaggccctcctgggaggggccgtgagaagggaggccagatggaaagtctcctgagggcaggaatgagtgctgtccttatctctcatgtacccctgacagcttttctcaaccatggatgcttcagtcccctagcagatgcctggcagtgtctgcatatgtttttagttgtcacaactggggctgttattgccatctggtgggtcaggcatgctgctccacatcctgctgtgcacaggacagtccccacacgtccgcagggccgtgctctgcaggctccttgcatggcgttggccactcagagggtctaaaattattgcatggtttgtttgctcagtattcatcaggtttggatagtcaagaagtctgtcttcatctctggggcaccagagatgaaggaagggacactatcactgttcttgtaaagtccacacgctagctggggcaatgatttgcaacaatcgactatattatcttgtgaggagggtcatgttacaggttcagccttcggaaggacatgaggtcaaagcaaattctcaagaatgaggaatgacaggagacagagacgcggacggggcaggaagggttttgtgagaacagctgatggaagaaagcatttaatggcacctccagcggagtgcgtgcagtttagagcagacgagggtggggccatggcagggcttgactaggagcaaaggtgggactcgcatgctaaggagtgagcttagacatgatactcctgcggcgaaagggacaaatgatggaggattttaggctgaaagtgacatgatcagatttggattttacagggactgatccggttgacatgcaggggatgaatgggagacagtgagttctgtctctgggtctttgaagccagagtgacacacatcagatagatgcagttttcacccaagaagacctgggtagtgaatgggattagtccaaactcatagtgaagatattaaatataccttgggatgaaaagagtagcaggaatgcggacttgtgggaggagggcaggccataccgggcctcacagggcaggataaggtgcttggattttactctaaggaagcctcagcctcagagggttctcaggaagggagtgacatccaatttgcatttcaagaagataagatttatttgagcaagtcaacaataacattcaaattgtcatgaaatagaaattaattcaaaaatgcattcatttattgaggccccactaccaggcactggggaaaagagatcaaagagaaaactttgctttccctggagctctgccttcaagtttccctctacacatagcaaaccagaaaacctttattttttaattcacaagtagagggttggggagcattttatgcactgactcgttctccccatttagtctggcataatttccatgccaagtaaatattctctcttaaaattttaaattttgagggttttttttttcttctacgggggtttatcagtgggctctctcaaaatttattaaacacagttggccagagctgttagctgttgatttctttgattggtatctgttttaagatctttattatccagaaggcgtatcttttctcccagtgaggcattaggtagtaaaagagatcatttccgtatttttctttcttccaaaggtgcagatgtttgcataataggctcctttaagtaaaatccaccttttctggaatcatgttggaaagcctgcaggcccacgatgagggactatcttatattctttaactcaggaatcctcgttcctgtttctgcatgtgggaccaaactgagccatgttcagtgtgccagaccaaacactctgaagctggactagagtaatagcaaactggagagtcgcatcctcgttaaatgatggcttagcatgtaaaacattcgtgtgactggatagtcagtgtttgacaataagatgctgggaggagagccctgtgctcttttgaaattgattgtgtcctccttcaatggatcattaatagttggggaatccacatttaaaaggggtagacccacagcagaggtcttggtcagaggtcagaaaggctgagaaaaatgggcagctggcatttcacaattagtcgtgaatgcattttctattcctttcgagtttttattgcagaacctaatcatgaactccaccaaagtcacattagttcctgttcagtgtttcttatctcctgtgatgtgaggctctggtaattagcagggctgtttctgctcccaaataaaaaggagatatatttagaaaatggatgtgttaacccgggaaagcaggcacaggaagggctgcatgaagtatctttctcttggtgaggtaggctgcaagttgatgtggaagaagttctagatcatactgtgtgttccctgcctgaccacccccgcaagcctcttgactccctattcccaaatctggaattatttttagaaagctgtcccaggccggcacggtggctcacacctgtaatcccagcactttgggaggccgaggctggaagatcacctgaggtcaggagtttgagaccaacctggcaagagtggccaaaaccccatctctactaaaaacacaaaaattagctgggcgtggtggcaagcgcctgtagtcccagctacttgggaggctgaggcaggagaatcgtttgaacccaggaggtggaggtagtggtgagccaagatcatgccattgctctccagtctggtgacagagcgagactctgtctcaaagttatcccagaggatatcaaactgagaagacaagtatttcttgggaatgccacaatgtggatgacataattttgggtcagcccaggaaatctgggccctaagatagaaagaaaggaaaactgtgaattctgtatttggaatgtgaaccaagcatatgccgggagacatcctcgaaataccatttccattcagaatggttgctccctttgtccacatgccttcatcttcctcgggctctgaccttcgcccagctctctaaacttgagcaaatgctcagagcaagacctggtgctaggatcggaacagggaagacacatggaaatgaataaggtcacattctagataacttgcacatcacggccccatttttgtaataatccctttctccatcctccacccctatcctcacttccctcttctctatgaagaattcagtttaactgtgtaggttggatcatggcatgccggtaccctggggtgatggagagttgccttcctactgaaggtcagctactgaaagagcatctgtgcgttggcaaatctgctaggttcagggctctccgagggaatagataggagaaaaattttggattcacctttgattgtacttcctgatggagtcaggattggggtgaggagaattgcacgttaacaagcatagattgcacatggagtggctgtcctttgaggtagtgagtcccctcatggttgatgtgttccagcaggagctggtgagcaccttcaggaagagcacagagggattgttactttatgtagttacattagaagtagggggtctgcaaactgtggcctgcaggcccactccattttcacccactcattgcatattgtctgtggcctcttccaccctgcagctgcagagttgaatagttgtcagagtgtggcctgcaaagccaaaaggacttactctgcccctctacagaaaaagcctgccaaccccggactagatgaaccctggtatgggttggatgtttgtcccctccacatcttatattgaaatgcgacccccagcactggaggtggggcctggtgggaggtgattgaatcatgggggtggacccctcctgaatggttcagtgtcatccccttggcgaccgagttcttgctcagctatttcacatgagatcaggatgtttataaaagaatgtgacacagaaacagaaaaccaaataccacatgttctaacttataagtgggagctaaacaatgagaacacatggacacaaggcgggcttttcagagggtagagggtaggagaagggagaggatcaggaaacataactaatgggtgctaggcttaatacctgattgatgaaataatgtttacaacaaacccccatgacacaagtttgcctgtgtaacaagcctgcccttgtacccttgaaattaaaagtgttttcttttttttttttttttttaaaaaaaaaaaaaaaggctgggcacggtggctcatgcctgtaatctgagtgccttgggaagctgaggcgagcagatcacttgaggtcaggagttcaagaccaacctggccaacatggcgaagccctgtctctactaaaaaaacaaaaattagccaggcatgatggcgcatgcctgtaatcccagctactagggaggctgaggcaggagaatcgcttgaacctgggaggcagaagttgcagtgagccaagattgcgccagctgcactccagcctgggcaacagcaggactctgtctcaaaaaacgacaacaacaacaacaaacaaacaaaaaaaaaaaaaagtgtggcacctcccttcccccacacactttgctcttgcctttgccatgttatacgcctgcatcccctttgccttccaccatgattgtaagtttcctgagtcctccccagaagctgagcagatgccagcatcatgcttcctatacagcctgcagaaccgtgaaccaattaaacctgtctcttttataaatgacccactctcgggtatttttttatagcaatgcaagaacaacctaacacaaaccctcatatttaggaattgatagctccagcccttttatatctaattttaagagcttttgagactatcgtagtttatgccttaaaggaagcttataagtttccccttttctgggtatttccaaggaaaggcaaaaatgtgtcaccctgaaatgatgctgatgttgtctgacctagagatgaactaagtccagtctgggacaggctccccagggagcattttcatggaggtcagtgtgaacccccttttccagattggcggcagggccagctttaggtcccttgagattgtctgcatcccacttcctaagtaaacaaaataatgactagaaaagtcttttcaggaaagggaaaatgtgcaaatatacgagacaaaattgcttttctttcccagcagttttctcccttaggaccatttcacaggcctgagctaccctaggagtctgttttgcccacaggctatgcgtgaagccgacccttaccctctcacccagtgacgaccacgacaatgttgatgatcataagcagtgcttgcaggcttggctagtccttcacagatgctacgtcaccagtccttgtgctgactcaacgagtaggtggctgtattagttttctatttctgcccaaacaaattactgcaggcttggtggcttaaaacaacacaatttttatcttacagttgtttaggtcagaagtccgacatggttctcactgggctaaaaccaagctgtgggcagagctggcttcttctggaagggagcatcattctccgaccttttccaacttttgggggccacctgcattcttcagctcatgactgcttcctccatcctcaaagccagcaatggaagcagctcctttcacactgacatctttcctattctcccatccccagccctctttcctttataaggtcccttatgagtccattgggcccatctacataatccaggatcctttctttaatttaaatttatctagttcacaacattaatcttctttaccatgtaacctaacatagtcaaagtttccagacattaggaggtgggcatctctgggggccgctattctacctaccaccacactccttgtatagatgaggtaatggagagacagagtgggttaggaacttgttcaaggtcacacagtgctaagtgatggatgatcttaacctttgaccccagctattgtcatctttggaaagcagggatggataatgtggccagcacagtgtccaaggggttcccctcttctgctggcttcaaatagggtgacggccggaaggagaagtaactctggatgaacccccaggggcaaccctagattcttgctctgaaagctcataggcagtgtgtggcaacactggtgtctctgataggttttctttccagagtgggagtgccccagtcttttgcaaatcttccttttctcataaatgttacctaggtgctttgcggggatgattttcttcagaatgagtgagtgtcacaaaacagccggccacttgatttttattcctgtttggcacagtcctgggcacagagctcctttccattcgttgcttagcaagaagcaggccccaaataaccacctgccccaaggcccttttgtccactggagaggataggtgattagatggagggtaattgataacgcagggtcagtagggagagggaaaccccttgaggttggacctaggcagctccaagtccagattcctgctccagtgcaactgatgctaaacaacaacagctaggcttgactgagcaccgctggggttcaggtgtggcgtgagtgtgtttcctgaatgatcacttagaagttaagtctcccctgccatgccgggggcattgttctaggcacaagggattttagagtgaacaaaacacatttgtagccctacccccagcccctctggagcttatagtcctaaggaccttaaaggtaaagattgtttttgtccactttgcatgtggagaaactgagcttaggaaagtgtctggaaaaaggttacatggtagctgatagtgaaagaaccaaatgacaaacccacgtcctcccctccagagcccaagctccacacactgactctgttaactgcttggtttgggccgggcaccgtggctcacgcctgtaatcccagtgccttgggaggcctaagccagaggattgcttgaggccaggagttcaataccagcctgggcaacatagagattccatctctacaaagtaaacaaatagataaataaattagcacggtgtgatgttatgcacctataatcctagttacttgggaggctaaggtgggaggataacttgagcctgggagttcaaggctgcggtgaactatgattacataactgcattccagcctgggtaacagagtgagacccagtctcaaaaaagtacatacacacatatataaacaaacacttaggtttgcagggaagcaccctccaatgcacaggtcagcccctgccccagagaatgacgcaggtccgagtgccaatagtgtcactgcggagaagccccggtgtaaaatgaaaataataaaatccaccatagagcgttgctatgagttttgaaagccctattatgtgagccttcatctaaccgaatcatgttttcactgactggattttcagctggaatcgtggcatgtcagggctctgcctagccgggccccactcctaccccgacccaaaatctgagaaatgaccagtaacacggttctagaggaatttgccaatgctcattttttattctatgtggtggtgtttttttttttttttctcattgcagaagacaaattctatttccttactcctgagggaaaactaattccagcaaaggccatttgtctttggtaccttaagatctaggtaatttactgcaagtttatttttattgaaaattatgtagatattattcagaaacacaattttcaactatacggcacacttaagcacgttatattttaagtgttaatacatagactgaggatatatgctagaatgtgcatttctcaaagacacttttttcttttttgtcactcactgcattcgaggtccttaaacttgtgtgctatgaagtgctaaaggattaaaatattttcaaatggatattgtgctgtaagttttgagttgttaccatttgactgcaattgaaactcatgatgctttatatagcttagatgattaattcagaaataatttgcatttaaatgcgtttaagatatttaacttatgattccaaatgtgcctattttaagcctggtagaagtactttagtctccaaagtatgtggacgctctacttctccctagtttgtggacctgaaaaggatttagatattaatatagaataacttttccaaactagttctgaaaacataagaactgagagatagccccctgcaacacacacgcacatgcacacacacacacacacacacacacataggttttgtgctgtcttgggagcatttaagatactctgcaaactacaattgcttccttaaaatgtacagtggacgtttgacatagtaaagatattttgaagatttgcaggccagaaacctgtttaagccaacatattacacacttttaagaaagaaaagctcttaataacatcctataagaaaatcttaaccattatagaagttactctttgaataatattgtgagaaaaaatttaattagtgaaaccctaaggaagttatcagcatggagatttgtgatggatgccaatgtgccttcctaaaatgctgcaaggctattctggaaaaacagttctggagacagattctggcattaactatctctgttaacatagtggtagctaggttcttcccacttctgcttgtttcagctaagtaaaatataagggagtccagtaattcatgaatggataaacaaattgtgatacatccttgcaatggaatattatacagccataaaaaggaatagagtaggttaagccatagaaacacaagttagatgagtggcaggggtgggaaggagggcctacttataggtctgggtttccctttgaagtcatggaaatgttttggaactagacagaggtggtggttctacaacatcatgagtacactaaacatgactttaaaaatgtttcatatgtgagtttcacctcattttaaaaatcacagtgcacaaaaagaggtaagggaggccagagaaactggacaggaaaacccaggtgtgaggaccaggaggaagagggtggggcagaggggacaaggcagattcgaggggatgttccgccacattcttcagggtggcatgggcagcttttatgtagatgaaaacaattttaggaaattgcagcctaaagcggtgttcagtacacaagagaggccctcaagagaaggtcaccaagggaaggcagaagagcagcctctgcctgtctcagcaaagagctgagtgggcacccaccccatggtgatgctcacggtcacagcctagtgacccacacttgtgtctttgctgtcaagcagaagctagtgaccacgaaactaagcttaacttctggtgttctttacttgtgtaaaggatcgtaccttacatcgtagagaaggagtagaccaacactgtgtaatagacctctctgcaatgatagaagtgttccataactgcaccgtccaataaggaagccaaatagatagtagtccacgtggtgactattgagcatttgaactgcagctagtgcagctgtagaactgagttcttaattactgttttttaaatttaaatagctgcatttggctgatggccttactgttggaaagcataggttttgaatgtcacaggtgaaaactgtctttagcatcacgtgggcctatgttttaacaccaattttgcctctcccttgctatgtaatttgaggcaagttgtttaatcgtgaactttagttcctcatttgtagaaaggtagaaatgagagaatatgcttcctagagtcactgtcgagataaaatgaggtatagcatatgaagtacgtggaactgggcaaataataaatacttgataaacattatttgtgtctttgggtattgataacttatatatgtcttatgcagtggtgctttgagaaaatgaggtacagagaggtgaagtaactatgctcacgtcacatagccagaaggcagagggctaggaatttaatcccagatgttctgatgccaaagcccatttgcttgctactgcactgggtttcccttggaatcctggttaccaaattcatctcagcctgtagcattagactgggactgaggagtggatccctttttcctacaagttcgtccattaggtatgaactgttctggtctttgctgagatggtgtattagtccattttcatactgctatgaagaaatacctgagactgggtaattcatttaaaaaaaaaagagagatttagtggacttacagttccacatgtctggggaggcctcccaatcatggtggaaggaaggaacaaaggcacatcttacatggcggcaggcaagagagcgtgtgcaggggaactgccctttataaaaccatcagatcttctgagacttattcactatcacgagaacagcatgggaaagacccacccccatgattcaattacctcccaccaggtcactcccatgacatggggggattgtggagctacaattcaagatgagatttgggtcaggacacagccaaaccatatcagatgggatttcttgtaggacttgaaaccctggggaaacatgtggttgtgtgatggatttctatgtccatagtggtctttgtttcttacctaggttggttctgggtaggttctggactggattggcaggggagatcctggtctctttcatctcaggcacctaaagtcaaatctttcagaaataacatttaaccagtacctccatatgtgtttttttgtttgtttgtttgtttgtttgttttagcgttgaacacttcttgttgaatgccttctttttcattctatatgaaaatatctccaagtcatggagaactttgtctggcatggacaagggcaagacagtcttcttctgtcctgatgttagttggaaggacacatcctattctcctcacctttgggctaagagcagagtttgggtttttaatgaaaattttgtcctgacgagagataagtcaaagtcaggcattgcaaagtgccttgcatgtgctgttactggcatctcagttacattctccatgggcgcttaagaagctaacactcactgttggtcaggggactgatgctctacttcctactctaaatatagcgcctgtcttgtcacacttgctgtttaacagccttaccatgccattcttgagagaaataaagtgaggtttcattaatatgagagatcaacagtagttcagttataagttatcactgcagagggagagcagcaggttcagctcctcaagttggaaataaaaaagatgaatgggaggaggaaatgaagttagtgatctaccgcctgggcactttgtcaagggtgcgtgaggagagaggggaaagccctttctaaacacagattatacaccaaaggcaattaataattgtttaatccttctggagagccatttgttgtggtgatattcacatgactgtctttaacaccatgacaccaggagggtcttacttcgccagccaccaagctgggggcatcatgctgggtaattgtctgcaggtgcatttaactgaaacctttctctaagattctggagttcacagcacacaaagaaaataggcatagcatcattccagtctgtctactttctgtgactgaggtgatttttttctggagctaaatctgtcttttccacttgttctactctcattcactcactggctaattcaacagatacctacttggctcttactacctatcaatcactattcaaggcactcagtaacagcagtgaaccagagtttccaccctcagggaacttacagcagaagagcaggcaggtgatgagaaatgcccctgagtaaagttaaacaggaccaggaggatggggaatttgtggggggcaggggagctggaggaggtgcatgatattgtagtctatacatgatgatcagagatggcctttctgaaagggagacatttaaacagagatctgatgaaagagaaggtcatgagctatacaaatatctgtaaagagagaaagccccacaggtgtacagccagcaagatggtggaggatgcaggaggttgggtgcaggggaactgttgcaaatcgtagggccccagagtctgacaagctcaaggcaaatcctatggaaagatttttttcttttagctgctctgcctttgttggtgtacccctcatttcttttttcagcaggccgtgaccccttcttggcaaccctggaagtaggtgcaaagatccggaggtcaaagtgggcttagcatgtgtagggaacgtaggcctgggagggggtggatcactcagggccttggaaactttgcatggattctggcttctgagtgaaatgggaagcactgaaggttttggacagaggcaggatgtgttcagatatctctttcaccaggaatgctgtaaacagattggaggggaattcagtggaagtgaggagccaagctggaggttactgaaggaaaccaggtgagaaagaggagaacttggattagagagtgaggctagagtgcccatggccaaggtggaggtgataaaaagtggttggatttgcagtatgtcttgaaagaggcatcagaatttgctactggattaggtgcagtatgtgatgaaagagaggagggttgagggtagtgggaagattttttaaatatttcaacttttttaaatagtaaaaaaaaaaaaaaaaacatgactttaaatttactgtcttaatcttttttttttttttttttttttttttgagaaacaaggtttcactgtgttgtccaagctggcttctaactcctgtgctcaagtgatcctcctgtctcagtcccccaagaagctgggcctacaggtgtggacctctgtgcctagcttcttaaccatttataagtatgcagtaaagtagcattaagtccactcacattgttgtgtgacaaatctccaggacctcttcatcttgcaatagtaaaactttatacccattaaacactaattctcttcccccaaccctctgatcttagcaaccatcttctcactttctggttctgtgatcttgactgctttagatactttgaatgtgtggattcatacagtatttgtccttctatgactggcttatttcactttgcataatgcacttgaggttcatctatgtagtctcatatgacaggattttcttctttttcaagaatgcatcatagttcattgtgtggatataccacattttctttttccattatccattcatctatcagtggacatttgggttgcttccacctcttgactattgtaaattacacttcactgggtatgcaagtatctctttcagatccttcttcaaattctttcagatatgtagccaggagtgagattgctagatcatatggtaattgtctttagctttttgagaaacctccatgttgttttctataatgattgtgctattttatattctcaccaagtgtatacaagtgtgacaatttcttcatgtcttttcaatacttactctttctgtttacttgatagtggacattttaatggctttgtgcagtgacacctcattatggttttgatttgcatttcttttaggattagtgatgttcagcattttttcatatgctcattagccatttgtataacttccttggagaattatctattcaggccccttgcccattttttaatcagtttatttggatttttgttggatgaagttggggaagttctttatatttttctggattttaaccccttatccgatatatgtcttgcaaagattttctcctatttagtaagttgcgttttcattctgttgattgtttcctttgatgagcataagtttttaagtttgatgtagtttcatttgcctagttttgcttttgttgtctgtgctttttgtgtcatatataagaaatcattgtaaaatccaatgtcctgaagctttcccattatgttttccactagcagttgtatagttttaggtctcacatttaggtctttaatccattttgagctgatttttgtatacggcatgaggtaagggtctaagttcagttttgcttgtggatattcagttttccaaacaccatttggggctgctcatttcccattgtgtagtcctggcacctttgtcaaaaataattcagccatatacataagggtttatttctaggttctctattctgtttcattgagctagatatttgtcttcatgtcaatacatacaattttgattaccattgctttgtagtatgtttctaaaacaggaagtacgaggactccaggactaagagattttgctctcttgaaccaaaagatggacagattgccatttactgaggtggcaatgactgagagacacaggtactctgaagaatataaggaattttcttgtgccatatgaaagtgccgttagaaaaataggttggtcattttctgacatcaaaagattttttccccaaattgtctgagttgcagccaatataaacataggccaagtttttctaaatcagatgtgtttggagagggtggaatggctgtcagaatgggctgggcttatagggtgacatacaggtccaggcagagtgagccaaccaacatcacttgcaagattgaagaaggctcatggagttagatcagtggaagagaagatcctcatagaagaggcaaaattctctgtcttagggacaatggcaatacttgggaaaattcccagaaagtgatagttttagatgattgtcttcttggagaccgatgttggggaagactctgaggctgcttccagatgcagcaggatggagaatgactgtcagttggcaatgtccacctttggagacagacatatcagtcactttctcacttcccctgactcagctggattctcatcttctctggctcagaggggagtatcatcaagtacagctaacatctttgagcatataccatgtgtcaaaaactattcagcttttcttactctttataagaactcggtgaagtaggcactattattattttcatttgaatgttgaggaaactgcaggattgacaggttaagtagcttacctaagacatggtgagtaattggtacagccaggactggaaccctggccacttgactccagtgtccaggctattaaccaccataccgccaaagagtggcctcgtaccagggcctcgagctgcctggggcttcaggagcttctctcatctatggctgtactagtctgtttcacgctgctgataaaaacatacctgcgactgggtaatttataaagaaaatgaagtttaatgcacttacagttcctcatggctggagaggcctcacggcgatggtggaaggtgagaggcacatcttacatggcggcagggaagagagagaacttgtgcaggaaatttccctttataaaagcatcagatctcatgagacttattaactatcatgagaacagcacaggaaagacctacccccatgattcacttacctctctcacctggtctctcccacaacacatggtaattgtgggagctacatttcaagatgagatttgggtggggacacagccaaatcatatcaatggctaagactccatctctgtacagggggctgggagattcacttggcaatttttgttcctcttggcttcaaaggactcaatctaggatcatcacaaaatgtatttattgtccaaaactggagtgcttttgagagcaaaaaggactatgttaatatttaggctaggactacaaacataaaccagtcttgtccggagcaaactggaatatgaggtcattatacttatggtcagttagtaaatgagatcttagcctcagtgaaagtgaaattttactggaatgggcaacctattgaacacacactttatccagatggcttagatttggatcttttaaaagagtaacatcaccatttgaagtgttttcttcttcattaactatgaagccctttcccatatgggtttatcagcattgtaggaagggctttcatggaaccatataaattcatctctctagaaacgaagaattctaacgtccatcctcacttctgccaccaaaattagaaacatacataggtgtcgagctttctgcttggtgaaggtgcagtgacccctctttttttcagcatccatttatttctgctcgctgagctttctgtctgcattttcatctacagctctgttctttattgatagtgtttgttttagacttgtgagctccaagagggctgagactgcacactttaaatgggctttactgtgttggcacagcactttgcaaataaaggctttacaatttatttaacaaacatctagtgatggttactgtgtgtgaagcagtatacatagcacatggaagatactcaagggtatggcaaaaaggatttctatttcccataagtttatcagcagtaagaagtaacactgctaatgtctattatgtatagatgccatcttatctgtcagaaactgtgctcggtgtttaacatacattctctaagtctgtgccactgatcagtgtttctctaagtagttcccctggaacactagttcttgcaaactgttgatgaatgctatgtgtgtcattggtccccaacaccaccctcagatttggtgatttgctagaaagactcatggactctacatctagttgcatttgttgctaaggtttgttacagtgaaaagattccaagcaaaatcagcattaaaggcacataggcaatgaccaacagaaaccaggcaacagctttcaagcggagtcacacgggacacacttaattcccccagggagaaatagtgacaacgagtataaaatgctgtctaatgagggaagctcattagagacttactgcccagagtttttcctggaatctggtcacataggcaccctttgcctgataggttccaaatccctgacctccagaaggaaaaacggtgttcagcataagccatatctatttgtacggtttaggcacgttgagccactcttatcagagaatggtaggaaccttccccaaatcatcattcccaaataccagccaagagccaaccttgcaggctggcctttctagggatagcagtcccacacttgctatgttggctcttttctggatagtatgcaaaaaaaaaaaaagtttcatattcagataattttgaaaaccttaatcaaccaattttaagctgctttctttacctctggactctaaattcccagacttatctggctctctgccaccccccactgtacatcttagaagatttttgctttgtagggaacaaccacaagaagttctcgtggggaaatgacatcagtcctattcaatgtagcattaaatgctgagaaaatccatagcaggaaaggacagtttaaaaatttatgaattatcttttcctttacacttcagcattgacagataagtgttaaattgaaatactgtctcatactttgatcacagaagctaaggaaagcaagtgctgaagccgcactggcctcctttggaaagtaaaacccgagaactccatctaggcttcgagttaatagatgtggtggtctttacacacctgtagtgaaggggtcatctgttaagtaatcattagctttttcatttgaattgtaaattcaaattgtttctcaatgcagtagacttagattacataaggttagagcttaagctttgaaaagtaatttaaatttgttttcagcatgttaaagacttagtcaatttttttccttttattttagtttatttttatttttttcctgaggcagggtctcaccctgtctcccaggctggagtgcaatggtgtgatcatggctcactgcagccaagacctccctggctcaaatgattctcccacctcagtcttctgagtagcccggactacaggcacgcaccaccatacccagcttgtattttttgtagagactaggtctttccatacagcccaggctggtcttacacttttgaactcaagctatccacctgccttggcctcccaaagagctgggattgcaggtgtgaaccactgcgcctggcccaaattcctatttcttgtttgaccaggatgtcttttgtcccaaccagaattagttcttatttattgttacagtcaagatttagaatagggttttattaattatatatttggactagaatttctttattctgcaagtgcattagttttggaatcactgataaaaaccaaaagttgatttccactaacttttccaagagggagctttaaaaattcacctgtgggaaattttatgcaaaaacttgaacaagacatagtatttttctgttagcaaattataattttccccctgattcagggggggtctgtgattgttttcttccctggctgctccttccatttgcatttgcaaagatcacattcctaatcttcacctcatcagaagcctcattttgattttctgctttgctgacttctgtactccgagagattcactagctcttaatcctatcattggcctggcattcttcctcttctctatacttttccatggttcattcatctccattttattccttctagaatgtatttttttagaagcaattaccaattcttattggtttgagctatgaaatatttcttctttggttgcatcttcagtgtggttttcttctgactgtcattgtcattcacttgaacgggtgaaattaacctctgcctttgaggcccctatgtttactcttcgccggtgttgctgccagaagcttaaagctggatctaatcacttccttgctgaaaccattgatgcttctctgtcgacttcaagatgtgttcagttgggacattgccgtctgtttccttcttcagttctcctttcccttctactccagtccttacaagtgacatcttctgttcctgcatgctaaaatgcccgtgacttctctaatgcagctctctgccttggtgcctttgcgtatccatctctactgaggaactgggatgacttcagcatccggggtagatgcctggcatgaaccagaaaggatatcagattagatctgtaggtgatggtgagaatggatacaggactgtttcagtcaagtacctacctctaaacaggagggcactgtggattttaggattggagatcattggtacctgtgccatcctggggaggtgggaagaaccagttcacagatctagttttgagcaaaggaacatggggttttagcaggtcatttagtgtaagcccactagaaggaggcatgtggtgtggggtccaggacaggctgtgagtacatgttctgcaccagacataatttacatggaggcttggggagaataagcttccaggtgaggaactcagtggctgagttgcaaagagctggaaatgagagaagcaagcttaatgactttgtacgtgcttcagtttagtgcatatcccactcttgtgtcctaatccagttatttttatttctgctgaactctgtacatcctgaggatgaagcccatgctgtcaccactttttttttaattaacagtgtctgttaaacatgcatgtgattcagaattagatatcactccccaccctcatgaaatcctctttaaatacttgatttattatttattttccactagaatacttctggatttttcatgaagcctgagggaaaatgagaagttattatctacatcatttttcactgttttaatgttaatcattgatacaggaattggctttcaccatcttggagtccaccccacctataattaattataaatcctttcagtggacaaaccaataacacttctatattgaaccaggaaccagagagcctaaatgcatcccctggatatcatctagtgagtcagaggcacagaacaaaatgtgcttccaaaggacagatgattcttcaaagagagctactgttctttaaatgtcacccatgtgttagagccttttgttccgctctgtttctgcacgctccatttctgaagtccaggaagccccaggctgttgagtggaaagagtagaaaggcgagagtgagaaggcaagatgaatctggaggggaagattcatgttttctgatttctgagggtccctcctgatcagcggggtgctaatgagatcagagacaggggatgtgaacaccacgggaacctgctggctttcttccactcacagcgccagaatgttcccaccagctgggacaaagcacagggagagcatcaaggaggggatgaaaaaagagatcaggaaggaagagaatagtgtgcatgagctcacgcgtgggtgagaagaaggagaaacagaggcaggggggtacataaaaatcctaccctctagctatgtccttcaggagcgggtctatctgttgttgtttgctacttttcctatgctcttgggagcttatcagaaacttcccctagatcagcagccgcaaatcagcagcaggaagccctgtcacatgcaggtgtcattgtatcatcataaaaattacttcccagggttagtaacttaaaatgaaagtcaggctcaagggtcatcaggtagttagtagatcaagaagatttctacaatgtagtacatctcttttctcttggcttctgtgatactaagtttcctggttccgtttctgtctctcagaatacttttcccctaaaggtgtaaagttctctccttcatgtacttctctttcatgaacttctctccttctaatcttaactgagccttctccaagttccttccctatctcattatcttccatttctcattatgttccctcacaatcttaaccacacccgtagcttcacccatcactttctgcaggaaattgcctgtctaccacagaactctcccctggaatttagtgtaggcaattgtccacttgaatcatcctcaaatgtgatgtgatgtgatcttccccttggtgcatatccaaactgaactcaacacttaactcgtgccctgaattttggcaaggaagttatcaccagctttcactctttgagtgcataacctttcactctgtttcttatactcagggactgtagtgtgtgttgcagtctcttatctgactctcagaaataactttgagtagagcagtactactaaaacacaaattcaccaacttttctctgctggaccttcatgtcgttctccctgagtgagtcccttttgcaagttattaatatatgtcacacagagcctgtttctcatatttattgaccagactaaggagagaacatcgtaccctctaacccagtggttggcacgcttgagccagctcataccagctttcgtgagaccgttgttaatgtctctttctcactctgtcttcactgtagcttgatatcagccatggcaggattgtcttcaccatggcaatgggcaacaccaaggattgtcttacttcttcacagagctggtggttaagttacagcagataactgccccaccacacccattatgtcctgtgcagttatcgatgatattaactttctctgcttgaggcactctgataaaacttcactgatttatctcatttaatcccaatagctacttcatgagaaaggtgccatcattctatctgttttacaggtaaggcaaatgggcactcagagaggtaagatctgacaccgtgtgtctgagagcaggtccatgccatcgaagtagatttgtagcagaaacctggctgggggtatttttccccatattagggatatgtctgtctccaattcatgtccattctaagacaatgctactggtaactgtgatggatcagactttgcacgtttttctttcttggaacaaacaggatttggaagctttgacgttggtgttacagatcatttaccaaaaaaactgctcataagacaggcccagttttctgtttggatgatagcttctcatgatggtcctcatgtgttaattgaataatatttgaactttaaattctttctacaaatgtttgactaacaatctccccaaaatagccctattggtaaccaaccaagtagttgtttcattgcaataggagtgtaatgagagacaacagatcctaagttaatgagttatccaagacctttagttgcaaatcctttagccaaatgaccatacccatgggtgtcagagcaacagtaattgtgaattattgctatgtttaaaataaaacaattttggtctagattagattttgtttataaacctgaataaatattcagattgccactatcagaaaaaaaactcattgacccaatgagcattcaaaaaagtcatttttcctcctttttactttttcattcattaatttaatattcaaagaacacctgatttatgccagccaccgttccaagtgttgagattagagggatgaagaatataggcaagatcttagctttcacggttcacattctagttagggaagataggataaaaaataaataaaaccagaatttcggggcgtgatgagccctagggaaaggaagtgatagcagaagtatgcagtcagaggctctgctgaaacagagctgacaaggtgtttgagcagagaagcgagcgttcataaggaaccagccatgcagaggtatgcactgagacgcacccagtcgagggaacagtttggagactccagcaaccttggagtaatcaagaaatagagagttggtcgtggtggtagaagtgaaataagggagataggattgtttagtgaataaatccaagaggaaagcaggacccagatgatacagagtctcagaggttatgagttgggatttattctaagtgcacataggaagcactgtagaattccaggcaggatacagactttcccatctgtgcttaggagtctaagctgcactctttctttcttcaagtgatatgggagtgacttaaattctttgttgcaaaaccagtgacactgttatgcaaacatgaagtattgaactatatggaagtatttatctgtttaaacattgggggaagagacttttaaaatatggtttatatgctcggtggttcggtaaaggtttttctcctgctcctcatcccccagccaaccttctccaatatattcagccatggctgactttggaggataatgaaagccacaacccaggaacttcctgatggagatggaactgtttcacatcttgattgtatcctagttgggaagtcatttcatagatttgtaagatattgccattgggggaaaatgggtaaagggtatataggatctctgggcactatttcttacaactgtgtgtgaatcaacaatgatctcaaaatagaaagtgtaatgagagaaaaagctctatttaagtgttttattaggtaccagacatcatgttaagtattttacatgaattatcacgttatccttacaagaaaattgtgagttctagcattgccccattttaaagagaaggcacctgaggctcttagaaattaagggatttgcacagttacccagctggtaagtggtgaggccagaatcattccagatggtctgtctccaaagctgagattcccaacctcagccctatgggacacatgtctgttctgtcctcattctgatgggtccaatctggaggtgactgaatcctgaatgtcaggaggcagcagagggtggggccagttctagagaaggcacatcacctgtctctcctgcaggatggtctgtggccattggcgtaggccttcgttgacaagccaagcctctgacatctgaatagctacgctgagaaaggtagaccttgtctttccaccttgggaatcacagtctgatggcaggcaggggctttgtgccatcaggcaacccaaaatcagggtaccctgcaaagtcacctggcagaggtagcagggctgggtccacctagaggcagggaacattcttcttcacacaaagaggccttcccctcaccaagctgagctttttaaaagtttaatctatagcccctgagggagtgcctctttctaatccctacaaagacccttataggtcagcagtgtcctgtattgactgatccccgggatgcattggatttttaagctccgagattatcccagcttttacctcttttttaaataaatatatatatatagtatatatgtatatatgtatatatatattatacacacacacacacacacacacatatatatgtatatatatatatatctttaagttactgtgctaggcatgcctggaagtctccccacccctaatgcatttttattttaagatttgactggcattttttagattctcttgatgtgtttgctacatcttttttttctttttttttttcatttttatttatttatttttattatactttaagttttagggtacatgtgcatctttaggcaagaatttattaggatgttatggttaatataatcatggccataacttcctaatgaatgcaaatggggaaaataagattttattaaccaaagatggtgaccttaaaaccattatatcttccttgtgcttatggagaacattttaggagcacgcctattcttaaagtgaattccgttatctttcctcatgctaagaatggaagggggcttaggctgagccaagtgacatgttgcaagcagttgtatgatgtcaccaagtgctggccgttggtgtctcagccacagtgggaagctcagcacatggattaagggccaacctggggcgaaggtgattaccttcttagaagacacttggtggagatgtttttgagtgtcatgactagggaggagtgcgcctgacttctaatgtgtaggaatgctgctcagtatcctaccgttcacagcacagcctgccccccaccccaataaggaatttcctagccccaaaaatccataccatcaagaataagcgtacagagttaacatcatgggactcctgagtcagagcaacttgttttcaaatcctacctgtgtccttggatggttgaccttaattaactttctgaacctctgtgtcctctcttctaaagtgtgtctcatcattatacctattttatagggtactaagagaattgaggtattgcgtgccaaacccttagcacagcacctggcacagagtaagtactcaataaatagtggagattgtaactcttactaatctggtggtggtgtcctcctcaaagtaaaataacaaggcaaaggcttcaaatcaagctgcatttgaaaagttgcattttttggtatcaaagtcctccaagatggatttatttttctattttatgattccgtaaaaggcttcctataagacttgtttgttgggggtgggactccctctctggtgctgctagggcggggtacctgacattagtcgcacctgcagtggattcgacacattaaacctcagagcattgcgtgagtgtggctctagaaagccgcctcaactgcccaggtttcttagcgatcagtcatcttgatcaaagtaagaagcagccagtgtccaaggcaaaatctgtgtggtcgtgttgagagaaccaggcacattcgccacaagatacctgtgccttctgccattaagcaggtctgacaacgtgaaagctggctgagctgagggagttgatgagctgtcaacctcaggggctgctcagcccttcgggggtgctttgcaagcctggttgccctccaggtgtcattttgctaggggttgacagagcaggctactgcccttctgcaaatactcttaagatcatgtgagttaatacacaggacatgcttagacaggggctggcactgttctcagtgttctgttagcaattattaccattattttcacttagatttgtcattatgtacacacagctgcctgtggacatgtgcaggcacatccatgtaatatattaatataattaggaaagtgggggcattcagtactttctaggtatacacatgaacagacacacaaatatacataggacgtgcagatgtaatgggatttaatgttcccaaactcttgcagtcataaccgtctgcccagagtcaatcttagatagagagccagcaccgtgaggccaagagaatgtcttgctcctggatctggctggtgttcctgagagaaggacaagacgccgcagtgttcctttgacccaaagatggaagcaagacagataacactccgaagtgtggtagcaagccaagcaccctggagttaggggcttaaatccaggcatcaggtggttatgagtcctgtgaccctgtgcaaattagcctccccacctggggattgggaaccacagcgaagtcacggagctgctgtatggtgcataagaaagcgtatagctcactgcttagcatcatgatcgttccttaaaatgagattcagggctcatggtgccaaggtcctcttggaagcctcatgcacagagtgtcttcagacctaagattgaggaacctgtttgagaaagtttcaggtgttcttcctcaccaccatcaccatgagcaaaatggattattcactggccatatttctcctttttacctcagccaacaaggcacgcaggatcaaatgtgtggttctaccataatgactctatggacaggatcccctgtggctggcatgctgtcaccatctcctcctccttttcttttttctctgatccttgtttttatctgcttgtacttctgccttattgtgcttagttgtgcaagccaccgcaaatccagtatggattgatgtggggtataaataaatttttaaaaagttgaaccttgaatctgttcaataattctccaggattttgcttagctttactgtgctgcttccaatttcagactccctagctttgcctattggctgactgtaaccataaagataactgattcctgtaccaagcctaataagatcaattaaattccttgtaaaaatggtccctactaggggaaatgctagatgagatgctaaaactcatctgtctaaaaacaagagacaagctctttcttggattttttctttttctctttctttctttctttctttctttctttctttctttctttctttctttctttctttctttcttttttgcagctgatcagtgctcctcatgcattttgaagcttctttgcccaaggtgtctgtgacagatggctcgtgaagcagcaggaatgcacaaaacctctgctattatttttaataaaaaaatactgactctagaataaattgactattgaaaaggctgagaattcagtccttgaaactaattgtgccaagtatgggcacattataacttctccagcatggactatgtggccatgatggtaggcttggcaattaaaaagacaagtggagagatgccccaaactgccgggcctcctgctccatcctccaggtttgaactacggctggttgcaaggagtgtatttgtgcttgcattagaaaattaggaacgcctgcagaaaatggctttcccacagataaaagactattaagtctcttaaatgctggaaaatgtcttcatgagcatattcagtgatttggcacttactccacatgagaacgtccctaccatgatgtccagtaaagaatgggctacgtgtcccgcagacttgattacctccctgctccagcttggctctttctacaagggctgtgctggcccaaacatcaatgtctcatttaacttttgaaaatcgtcctcttggcatctagacctgttgttttcctggcctgctaggataaatacggaattctagggtgacttttattatgctcttttcaatattggtaataaagtggcactatgctgtggataggactgggttcacatcccaactctgccttttcctgattgagctgctgagtaactcttctgcctcctgatttgcaaaataaggatactggcttttaattcctaaggtggttctgaagatgacatgagacaatgtcagtaaaatacctagcactaagcttggcacatagttggcatagaaaaggaggagttggcagcttgattatggtcaaatctaagaagatttgatgcagacccaacttcctagggccactgaggattaaataggtatatataaattagctcaataaaagtgattatttttttcttgagacagggtctcattttgtcacccaggctgaagtacagtggcaccatctttgctcactgcagccttgacttcctgagctgaagtgagcctcccacattagccttccaagtagttgggactacaggcgtgtgccaccatgaccagctactgttgtactttttgtagagatgggattttgccatgttgcccaggctggtctgaagctcttgagctcaagtgatctgcccacctcagcctcccaaagtgctgggattacgagcatgtaccactacacttggcccataagtgattttttaaaaataagtaaatatttacaagaaattaattccctgagatcgtcaggacccaaccttgtcttcattttaagtattgtcagctcagagttctaatgaggctacaagagcattagagatagactttcaaaatattaaaagaaaaaatttcctaggcacctccaatgaaaaggatatgttccctgacctcaagaagtttccagtggccaggcacggtggctcacgcctgtaatcccagcactttgggaggctgaggcgggcgaatcacgaggtcaggagatggaggccatcctggctaacacggtgaaaccccgtctctactaaaatacaaaaaaaaaaaaaaaaaaaaattagccgggcatggtggcggctgcctgtagtcccagctacttgggaggctgaggcaggagaatggcatgaacccaggaggcggagcttgcagtgagccgagatcgcgccactgcactccagcctgggcgacggagcgagactccatctcaaaaaaaaaaaaaaaaaaaaaaaatagttcccaggcccctgttagacttcatgctccctggctttccctctctcctacaaatattagaatttgttgctcgcctgctatatgttggggcctgcatgctgtgtgttgtgaggagggcaggcaaagctcattgcccttgggatttgttacctggcaagaaagcaaacactgaaccagtaatgataagtaatgactgattttgaaggaaccatacaggcacctaggaatacagaaagggatttccttcctgagttgggggatggaggaaggtttctttgaagaagtagcatttgagcctgcttcctcgagggtgagtaggagaaaagacagtagggcttcatggacaaagagacagaatatacacaggcgaagaggagagaaagcgacggtgagcttgaaaggttcaaagaagccgagacagctgcaactcaagtagaattcatcgtattttttttcttttactaaaaatagaatgacagaataagaaatttatataaggagtattcaagcagaccccaaaggccaaagttcatggatgaggtttcctctttcctctccgctcagcttttaggtttctttctttgtcccacccatcttcgttccctgatggtaggtccatgatgtagaaagtttacaaaagaaaatgtctcagggaaaggttcctccatgaatctgttaggaagaaaaactccagtgaggctgcacaccagcagcactaatcattttattttatttgtggctgtgtagtagtattgtgtggcgtatatgtaccaccttttctttatcgtgtctaccattgatgggcatttaagttgaatccatgtctttgctattgtgaatagtgctgcaatgaacatacatgtgcatgtgtctttataatagaatgatttatattcctttgtgtatatacccagtgatgggattgctgggttgaacgctatttgtatttttaggtctttgaggaatcgccatactatcttccacaatggttaaactcatttacacttccaccaacaatgtataagcagtcctttttctctaatacctcaccagcatctgttattttttgactttttaatattagtcattctaactggtgtgagatggtatctcaatgtggtattggtttgcatttctctaatgacactgatcattttgaagaatttattcttgcatactcttggttaaatgcataaagtgataaattaaactgagtctttataagcaagtataaattagtggttatttgggggctatttctgatttacacaataacgtatactaatcacattcattaagatgagtgaagaaattgatttagctggaaagcatagctctacagaggcatagccaaagtctggctatataaaaacatttttaccaccaatattttcaggcaaatgtgccaataaaaggtatattctatgtgaaattgcagcaccctattggaaatggcctgctttaacagtcctggttcctgcttattaagatgcaccttcttaatgtatgcaataaaaattagactcaaagatatctagtgatgtttagccagcttcagtgactggtctagaaataaaaagatatgccagtaaaacccgagtgttgcaaatactgttactgatgatgatcaagaagagaggaaggcactctgtgaaagattgggtacacagtgttctgtctgatatgtggcttttttggcatcaaatgtgcactgcggaccattggcacttttcagaggtggccaacacataggtgccagggacaattaacagagacgtggtggcaaactcattaacgcaagaagagaatctgccattcagagacattaatttaacatgacaccaacaggggtgtttgtatgtgcgcgttgtggtgtcagacattctgctctaattgagttaattaaaagttaatggcacagagcacatcgtgacgctataaataacaggcacgtgaccagtccttatactctcatttgaataaacctttagctcaccatcacattccacttctgaaggattcattccacatcactgcctctccttccacctttgaagagggtgagtgctattccatttgatacataaacaaaaggaattggaaaagataaaaggaggcttgtgtgctatgtcataaatatcacccatcattgccagccttgtacttaaacttcttgctgggaagggggaaaatgtgtcctcctagccagggctgtggtaggatgtggggagagcagggaacctcctgctgctcatggtggatgggaggccggctgagggggacagtcactaagaagatgagttggaagtaagattgatataaaccttatggatgggaaagctgttttcctctctgagcttcagtttctcatctgtgaagtggagctaatgagaatctggtatccacgtcattgaatgcttctcagcatgaaatgggagaaatctctaaaacacttgacacaatgttgggcacacagcgagtcttccataaaggttagatggtgctgcttggaaagtctgtctcctgagcgtggggagaacagcccctcaggtatggctgtacccacctccctttctcagcatccttgtttgggtggccagtggagttctcgacgttcgtttttaagtgttggtttggttgattacattatgttacaaatgcatccaaaaaaggaaatgtgcgacatagtacttacatagattacaggcagagaaacacttgaaaatcattcacttaagacaaagtcaatagaagacttctcagtctcaaatttttttttattttattattatacagtaagttttagagtacatgtgcacaatgtgcaggttagttacataggtatacgtgattttgactgaggaaactcgcttcagtttgcttaaaactgaatgctgagccttctagccctgaggcaaagaggtatccatggcagcttacctacctttcatgtttccagcaccatgaaccacagcaccccttcaagtgaaagaagcaaacttctttgggggcctaaaatcatgggagaaattcagattgctcatcgtgcaaccaaatgaacatcattcttgagtgattctaacaattgaaagaggacaaaaatgcttcttacgtggctctctcggaagaatttctggtaatagtcaaagatgaggactttcaaactttttggcaggttctcacagtatataatagttttttttttttgtaaccatgtacccccaatacacacacacacacacacacacacacacacacacacacacacacacgctctctcaaaacaaagtttacaaataatacttagtctatgtggtgctttgtagtttctcttctactgtcgcttgttacttaaaatactggtcatgacctataaattgattttatgatctaaaaatgaattgtgaaacctggtttaaaaaatgctgatgcaagatgttaggtaagaacatatttctgcaaaaatacttaagtggagggacaggaatgagtggggctaggtgtccagtgttctggaaagaattaaattttttattagtatctatttctcatatttctccccagcacagtcagttctgcgtggcgcagccatcctaccaaggggagtctgtgggaaccaggacacttgattgctttttagctcagtcttcgagggagtgctggagcaactctgtgcatcggaatcacccgggatcccagcaggtctgggagggactgagattctgctcccaggtgatgctgatactgctgctccccaaagtgcgttaggccatacactgaacagcaaaggaagagaaaaatgcaaagttggaaccttgtgtttcctggcctccaccgacagccccatccagtaatgcctcctttctccttcaagggcatcttattgtctcattactcacatttagagactgattatgtcatttagtaagccttcgattgaatatttaaaagccacttggatgaagttaaaagtcagcaaagaatgtatttgaaaagcatgcatagctcatagctcctagaactgacagtgaaatggatgcaccaggtcttggggggcggccatgtatcgggggagctctgggctttggtagcaggaactggtggagatctttttatgtgaggccattggactgaagcagcatcccatgtcctttggcccttgcagtagaccctcacatttcagggaaaggatttaagaggccccttggctcacaggtccactcctcagccaaggagaacagggcatcttgactgacccaccaagactttgttatgacatagtgaccacggttcagtttccatgcaagggggcgtgcatgcggagtgggcagatacagccacagcacatgggttgctgaaaactaagtggctttgagaggaaggtaagtgcttttgctaaacaccaactctgtggaaagctcattaccgatacgttaacttcatcccctcgataagccagctgttctcaattggggatgactttacccttcaggggagaactggcagtgtctggatgaatttttggttgtcacagctgggttggggggttgggggtgctcctggcatctggtaggtaagaacatatttctgcaaaaatactgaagtggagggacaggaatgagtggggctaggtgtccagtgttctggaaagtatctattagtatctatttctcatatttctccccagcacagtcagggatgtggctcaacatcctgcaatgcccaggacagcccccatgacaaagaaattatccagtacaaatgtcactagtgccaaagctgagaagccctgcaaaaaacttgcatgatagtgacggttttctttattttcctcttttttttttttttgatgacagaaagttagataacagtcacaagatcagaaagcgaataagtggcagagcttgaacccagatctgtggggtaccaggacaccctgccttcttgctgtacctctcaatactggtctcttgtgcctgcctgccaaggaacagaggcagtgggaggagtcactcaaagagtcttatgagcctgataacaaatgtgtgagttccctccctttgctgatcagatttgttctgttccattccggagtcactgcaaactaccaggttttaattcaaccgtaacctgtgggaaggcttcacgtctgaggttacctggtgcagctgtcttcacgctggcacactgagaagttaccaaatgattaatagccgtggagtttcccaaaacatccaggtggaagacacacaactggcttattgtcttttaatattcagtcatataaattgaatataagagggtaacagcaggcacccctggagacctgggcatgaggtttagcttcatgcaatcccctgtaagtataatttccccagaccacatggggtaatgggcctccatgtctctgatttgcccatggggggaggacattaagtctgcacagctgtggtgtaatcagatgtgtagggagactctgagagccagaggaatctcttttccatgctgtctcacctgaaatgcttgtcaattaatgtagacttgtggtagacattttgtttgaaaagaagaaatttcattttctttcaaatattatatggtgcaggtgaagcacctggggtttttctaattataccgtgagccattgggaagtatgaacatattttacacattaaaagacctggattttgctggagaccctagagaatgttctcattggagtccccctcatttaccttggaaaggactgtctgaatttgaaaagaaatctgaagcaggaaaaacatataaagaaatatgaaaaaatggtataactttcaagggaaagggtttccttaaaaattcatgagatgggttataataaatgcactagaataacttgtaacaaaaataccaacagtgtttctttggcagatgtttctcaaatatttggggtggtttcaatggttttaaaagctttctcccaacgcttttatgttgcctatttggaccaccaattgagtaagaatttggctaattagtgtaaattcattaggctttagcataattatatttcaaaccaaccagctaaattgatatgatgttgtttgtcctgagaatgactaaatgactgataggaaatgggatatattctttgaaactcgatattcttagagcttggcaaaccgtctggtgttcaaatacattttgttatttgaatgaatacatattagctatggatataaacaaggagggagagatggatgggctgagtgtgattatgccagaaaaacaggagtcgagctcatcgcaagacctagcagtaatttttaggaatcaagtgatacaggtgttttcataagttctcagatgggaaacaattagtgaaagcaacaattccacctttttgtacaaaacatccttttgcttagttggttgtctgcttgctcctcaaacattcggaacatttccaggatcagtgaatatataacagcgatgttttgttttcagaaaatcaggctgatagtgttgtactgaactcaaatctgccttttaggaaatatccatttcctcctggttcttcctcttgagatatgcagagatctaccaaccacatcacagaatggaactcagatcattaaaggacagattccttgacttggttcataggaatggtcttgactcctccctagccaccgcccactgaatggtttgatataaaaaaaacaaaacaaaacaaaacttaaaatatgatcttcgtgatgtggtttggccaatgtagaggattaaaaccattaccactgcttcttctgcttatgaggcttttgactggcttcctcttttctgtcatccaggttctcaaaccccatgatgaacggtgcaggcagggagagtggcagagacagcaggctgctgccatggcctcaatcccagccacttaagttggcttcaccattttcctgcccatgtgtactacaggttgacggctagagacactgtgaacatcccactacttgccactgaggctgaattttttaaaaaaaataatgatagcagaaacacctcagacagtctttcatgcagagactcaatttaacacttcagaaaatttttgttcttatgtcaagatcctaaagttcctagatagattccaagatagaagtacccaacctattgtggctctacatccaatttccattttttattagcatgtgattttcttaacatactgccattatcataagttggacaccccattttcaaggcaactgaagtgaatcagagttatagatagcagacatagggtataaattgctgctgcccaaccctgaatacattttttttcatccagtatgatgctctcctgataaataccacctgttcaatgggaatttaagacaggttgtcattttagcagtcaaactttctgttggatcacactgagtttatggtcagcttgaactctcaaatctttgtttatgaatttttatcaatctctgacttttccaacttggtttggccaatcgctttttgaaatagaactttatatttaacttcatcaataacatatgtagaaatatatatacttatatgtggatatatacatcgtatatatgtatatatagtatttgtgtgtgtacatattatacacatgtatgtgtgtgtatatgtatatatgtatatgtgtgtgtatatatatgtatgtgtgtgtgtgtgtatacatatgtgtatatatatatatgccctttaagactaatgcaataacttttaaggttctttttgattgaagaaatatatgtaattaatatcaaatcatatctatggcttgcagcttacccctctgcctacccctaatttctaattcctagagacaacacccctctaaactcctttggctggttttttttttctggcatttgtgtatgcatttctcaatacataattatactatcatcatactattataattttcacttataaacatttatttctcctattaaaactaaagatatggctgtcaaactatgcacacatttattatccctttatattctaggtttatgttattgtggctataagaatctgctgtaaataattatatgaaatacgactctgatagaattttctttgtcacctatcattttgtttttccaggtgttaataattatttcttcatttgtttagtgttctatgtattttttattaaatcctatgccaaacattccaacagagctgtgagatacttgtcaatgtctttaaatgtctcaagtcgtctgtttgtttgttcttattttcttggaatttgtttttcttggaattctctgtatttctgctctagtttcttcctctaagcctgcttctcagccatcaccctgactggccatcaaactgggaactctgtttgcctttgtcctgtactgagtctcctctttcccaaatcctttctctttttccttcctggttaacctctggattatgtgtgtatttcgcatgcctgaaaatcctttttctacttttagacttgcaaatttggctggatatagaactctaagttgaatatatttttcaatagatgatgaacttggaagattcattatctaattttctttcagctcccttttacataactgtcttctcttaaaaatacttcgtacatttcttcaactttatcttatgaccactctgttgttgtattattgtttaatctttgccatcataatttcaattttaatggttttttttgttctctcaatgttcatttttatagtaatctttgttttgtgaatacagtatcccctcttagctcttcaagaatatcatttacaggtgtttgggttttaaagattcacctgttttctgttgcttctaaatttctgcttttttttttttttttttttttttttggtctgtgtcatgttagaagggttgttcacattctttgtgaatctttgctgccgttgtcctctgagtgaagcactaaaggctctttaggagttttgcatggacgtgcatgaaaactgatgagcctcaaaatgggtgatggggttgggactccaccatcagtatctgtagttattttcggttttttgtttatttctgttttttagatggattctcgctctgtcgcccaggctagagtgcagtggtgcaatcttggctcactgcaccctctgcctcccagcttcaagcgattctcctgcctcagcatccctagtacctgagattacaggcgcctgccaccacgtccggctaatttttgtgtttttagtagagacggggtttttaccacattggccaggctggtctcaaactcctgacctcaagtgatcaacccacctcagcctcccaaagttctgggattacatacagaagtcactctcacacacatactcatatttgccttaccatttgtgcaggaaatcaataccattactacccaagaccaaaggtttcactggatttaagcactgacatgaggccaagaccatagctccttccatggatatatggtccactttaatttttatgaattctaccctaagaagggggaaatgttaattgaaattgtagccattgttaacattgaatttatcacttaatggcagttacttattttaattataacatctgtgtccaagtcagtgtgttcattgttgtattcctcagaaagtcttatcaggaacccactcccactgtaactaacacagataaagtcttctgctggcatcatctcccctcttcacactccagggaatacctaaaaaatggaaaaggtagactgtgccctttactaactcttaaggcaaagaagtttaagtaaggacaaacattaagccaatatttccgatatggatgttaaggttcacagcacaacaaacatcacaacctgtggctgtcttttacctcattcatggaggcttatgaagtacacttttcttctggaatcctctcttttccccacctctcagggcttcttggtgaggtccacactcttcactcaccattcctggtctcaagtcgggatgtcttgtcctaactatcaatgacccacagttacctctacctctcagctgagccctcagcctattttctttttttctactcatgttctgattgcaaatgacaggagttatgactgttgttgccccagatctcatcatctacttaaacatcgtcatctgccagtattctcagccttgcttttttttctcagtgttaagaatttgttagggaggagctggtgaaatcctgaagtgcagcagagacatgcatgcctcattctttgctaaaacagaatgccttcagaagcaagtaccagaaaaccccaacccaactgttgtaaacaaagaggaaaatttatcatttcacaaaacacaaaggctgaaggtgcagggaagctccagggatggttaattccccacctccgcagcatcagggattgggttctctccctcttcctgctttatcattcagagcccggctggattatcctcaggctaattcactccatgtatgcagaatagctgtacagctaccagtgtcagaggcaggcacatcggcttataggagaaagagagagcagctctccctttctgtgtgtgcgatgatttaaatgccctctccaaaactcacgttgaaatttaattgccactgtgatgatattaagaggtaagacctctaaaaggtgattaggtcatgggggctccaccctcatgaatagatgaatgctgttatctcaggagagtgtttgttaccgcgggagtgggctcccggtaaaaggatgagttcggcccccttccccttgcaagctcactcatcatatgatgcctttcacaacattacgatggagcaaggaggcctcgcctgttgtggcccctcaatcttggacttcccaccctccaggaccatgagccaaataattttttttcattagaaatgacccagtcattttatttaacaagatattatgttgtcatagcataaaatggactaagacatcttttatcaccactttcccagaagttcccatgccccacacatgtgctctcatacctcattggccagaccaagtgaagtgtctctcagtcacaggtgagggaaatgagatgaccatgaatggcaaattaatcaagctttactcatttagagaagtttagaggaggataccttctttggccacatgactgtatgggaaatggtggacactgacacacacaggtgtatatagatacacctgcccctatgtgcaccactgacacatggatattaactcagtggtaggaccagagtaaacccctgatcatagtaattgacataattataagtgcagacattaactgtactgcagtttgtctttagaacagtggtgtatatatacctatactcatgttgtatacaaccttcacaatatgtaggagaggaacttccatggaagtatgaacagaagatcaactggacagttacgctgctggtgagctgtgtgtagcctgagggatctggcacatccttagttcttttcgcacaaatgctgctgccagttggctcaagcatttcagggcagttgccacagttgttactacagttaccacattttttccaaaccagcagtcagcatacacaattggataggtacttctttccaatctgtgaattatttgatgtcatatgagttacagaagttcatcccgggtcatgtttaaggatatataaattacatgttgtagacaaagtctacgtttctacgtttttttgacagcacaagtgacatgaagtgaaatgcacatttcaatgggtgtcgcatcctggtctcaatagttttagtgcagacattcttcctacacaaaaatgttgtgaaaatttgaattgatcataatgtgattgatgttgagaaataggatttatatagtccatgaactactattgggtataaccacttgaagctgggcacaggttcctaaggagtgagtgtctgaggacaccacagagaggccagagctgctctgctcacctacccagttcttaggttctacctggcattctttagctctctgttgttaaaggtaaactctgccacaagccaaagaccagagcagagagatgggaggcttgtcaaagaagcatgaaggtgcttttatttccttctgaccagacaacttgctcagccttagcttcagcaatcaactacatctgtaaagacgcttttactgttggtgttttaaacagaaaaacaatgacttcataatctagaactctctagaacctccttttctattacaaaagcagctgcttttctctcctagtttttggaaatgtgaggcttcttagaaattcaaatgttgtgtcataacctaacatagtttgcataattgcagagaactcaccagatgactgttgtatcttatgaggcccctccccagaactcctggagagacctaaagtggggggcagatcctatcaccacagctttgtattacaaaacttcattaaatatattatgcaatgcattactgctgtatgcatcataaatagacacaccatccttcatgtctcaaatattgattatctaaactatcccacatcatctatttggacctagggatatgaagatacaaagatgcagtctgttggcagaataaaattcttaaacagatcttagaatagtgtgagttgttcctggaaggtacagagtgccatgggaactcagagaacagattcccaccccagtaagaattctgggatcactccaccccaaaagaatgagggttatgttgtccttagtgggaggtggtagttgtggattaggtcctatcatttcacacactgaccatctctgcccagtaccctgaatgagtgctccatgacatcatcctctttgacctctggccaccttcccttctcctagccttgctcctcaccaggtaatcctagacatatggacagctcactatcaagaggaggattggtccactggagaaccgttaatcccttctgcactttggggatgatctcatctgatttgtctgtcctgcttcctcaaagcccctaaaatgcatttctatgctaagttaaacagaattgattgcggctagatttactgagtcttttgaaatggttctattattttgaatgtaagaaaataatgtactacacctcctgagaaatagatcttctgcaacattttcattaatctctttattaaatgtaactggtttctctttggaaattaattactgaagtagtattgagaattttaatttccacaatataccagcaagagatactgctgtttctttatacactgttacacagcagggcaataatctattgaaataagcccaaaaagggggcagcttgtaattaaaacagtataacacgagtgtttgatgactctcttagtgctaaaatggccctgtcatgctgtgtttgggtggaataaaatgtatatttaggaaacagctctatatggagaagtcgacagactcaggttttacagtctgggatgtggctgtgtttcactgcaataatatgcccacgaggaaatacggtttgtttttggcatctgagaattacaaccattgctgcacaataggaagcttcttcccttagtaagccacccccattgtgaaatttaaaatatttaaatgatgaagcagagagcatcaattatcaatgtcggtatccatggaaaagacatgagtatgcaaacacctgagtgcacgcacagctcacgtgtaggtgcaagtccacgaatggatgcggatcctgtatgtgtgcatgaaggccctcattgacacagattcagcactcaataactctccctcacgcttagaggaggcttcatatttttcaagacacgttcctatctgtcatcttctatcctcccagacgtgttttctcatgataagaattatttacacatcatttacatttacagatttgctttttttgttgttagtgtcaaagacatttttgcagatgctgtgttgctcttctcttttctccttcctcactctcttctttcctgccttccctccctccctcccttcctccctcctttccttcctccctcactcctttcctttctctttcccttcctccctccctcctttcttcctccctctctccttcccttcttttctccctctctcattcccttcctccccctcactctaagtgctaagtatacagccatgaacaccaccagctccctgcttttagggagcccaaagtcctgcccactcagcatataaaatcctataattgcctcttcttggaaagcagtttattggttttgaccactgatacatgtacctttgaggtctatgccctatccccagaagctcctcaaagaaaacagtacaactgaatcacatattgtatcctttctggatgaagtctgttaactaaaacttgctcatcttcttgtatttccagtaatgtgggtgagtcttacggataagtgatcagggcagatcccaggctggacttctccttatcctggcttaaggccaccagcaacattcttgtgttggatctagacaccagctctaccgcacattgaggcagagttcataaaaaaaaaaaaaaaaaaaaaaaaaaaaaattcatggttgctgttagagccccaatcctgcataatgggcttttatttaaaaaaaaacaaaacaaaacaacaacaacaaaaaaaaacgctgtacctagaagtaactgtccagaaaagaataatataatgcatacccaagatcataaatactggaaatcatacaaccgctggtttctcaattacagtaagaaaataattcacaatactcaaggggaaggtagcacttgtgagccagcattatttatagaaacctttcttttatctttctttgcaaagtcttttactagaattatttatttaggataattagagaaaaattctgtaatttcaagtaaatattaactacaaatcaattccagtaaaaatgctgctgtccaatcatctgtgtcactgcacttgggagaaaacaatttatgttcaagcctctttagctggattaatctcttcaaacctaagtgatccatatgaagatcttgtcaccggaaattacttttgatccaatacatctcacatatcataatggtaataaacatttgtcttgtgccttacagcttaaaaagtgtttttcatccattatctctcttaattttcatattgatttttagaaaattaatttgttcaaccagtgtttgggtgcttcttgtttgtttattccacaaaaatttatggagtacctctctcagtcctcaccactggggatgcaatggcaaataagatgaagtctccagccataaagaaactatattctagtgagggagatggatgataaaattaaaaattgtgcaagtgcatgatccagtgtcagggaatgataagacctgtgtagaattaagaggccaggggttagatctggacaagaaatgcttgttcttgctacataaagagttaaaggctgagcatccctgagtaatgtgagactgtgaaccaggaggacagcgttccaggcagagtgaatatttggatcatgcctcacatatcgtactgcagttagcacttactacttaataccacacgggtattttcccatgttgttcaaacttgaatttttaaagtctgaaaaatattccatttatggatgtccttatagatttatagatatccagcgttgcagtccggggctcatcaaattttttccactccttactgagcttcagacccaccaggctgcagagagacatctctagcaaatcataatcatttgcgttaataggtctgtgtggcccctgaagatttcataaggtggaaaaactactcccaattcatggggattgggctggacacacttcagtagctttccttgaaaactggaggaaaggcagagctgtggcagagtcaacgtgggaaatgtggtctgttgagtggtcctaggagtttcaagaacaactattctgtgcagatcagtcagccctgtggggattttagacgtggattgtactctgagagctaatgatgagtttgctggaaataatttttccatttccatttctaattgttaatatagtacagtgagctcggtaagcacaatctgctcagataacccaatctgcagtgtgactggtgcctgtggctggtgcctacacaacaggcttttgtttcgtaacttcagcacttgttgtggggggaagcaccacaaagctgctatccattgagcagtctttcaccctagttttggtgcatatcacttctttaatcaagcaaaatggctctaaaataatatcaatttttttttcttttttaaacttttaggtgcaggggatacatgtgcaggtttgttacgtgtataaattgcatgtcacagaggtttggtgtacagacgattttgtcatccacgtactaagcataatacccaataggtagtttttttcaatcctctcccacccccaacccttcaccctcaagtaggccctggggtcttttgttcccgtcttagtgtctatgagtgagtactcatagacatagtagtgtctattagctcccacttataagtgagaacaagggcatttgcttttttcttcctgcaagttcccataggtggcagctggataaagaaaatgtggtacatacacaccatggaatactatgaagccacaaaaaagaacgagatcatgtccttcatggcaacatggatggagctgtggaccattatcctaaacaatatgaattcttaagaagccaacagggaggcccatttaaaagcagccacaaaggggtacataaaagtgaagacaggttttaatgacataggtttcaagttaactactgtttgttgatctcttgtggtttccgtgggaggggcatttcaatactacataggtatcgtgtttttattttcgtaactacgcagcgaggtaagtttagttatctccacaagcaacatgtaagaaaattgaggctcagaggggtgaaaaggccacccttgatcaaacagttggtactgaacctggtttctagcctcacatgcaggacctcagagctcttaatgattcacccatactagtctatcataggcggcagtgcaggttttgcctctgaccacattgcttacactttccatcttcctctccaccacttacctggggttaagctctcttccagcctgcactatgacaacagcctcttcaagccaatcttacaccctctcgccttcccccaggccaggccgtctcctccatcccaacaccaaggtccctcaaaggaaagaccagtgaagtctcaaccctgcttaaaagcctcagtgacaaccattctgctgggtgggattgctggcaggaaggtggccttagggaaaggctggtttcagccaaggctggaggtggagagaatgttctagaaagcactggttgctggaagggtttgtggatcagagacctctcagttagctcaggcccttggtacatgctcttctctctgtttataatgttcttcctgccactcattatttggctcctaccctgagtgatcccttgcctccctcacctgctagagaccctctgccacaggcttcagttagttattccagcctcctgaaagcacttaccacagtttgaacttacctttgtgaggttatctgattagtgtctttagagctctctaagtaatgtattccttcaagaaagggattctgtctttccccccagagaaacccccacatgcagcacagagcctgatgtgtgaaacttgctgaatgagttgaaaataataagctaatgattttataaattcatttaaaggatcctcagcttctactgcaatggttctcaaacacctggtggcagggggggtgtttattaaatatgcacattcttgggccccacgccagatctactactaagaacctccatgggtgtgaactataatttgtaagcaaaatgtataagcaagctcccaggatgaattttgatttggataagagtttggggacttccttcttagcacacaaaatccagtctttattccatttaggtgtgttcaaatggtgtcatctcagtgagccctcctctgcccctcttatttaaaattccatacttccagccctgtctgacccggcactccctatagacacatgctttatttttatccagagaacttgtctgtcacttcccactattatacatgagggcagggatcgttggtcactcctactatattcccatttcctagaacagtgcctggtacacattagacatccaatacatgtttgaattaatgccaagtttgccccatagagcatttatgatgttcaaggccttaagcagctgggaaaggagagatgctgggccacataacttgagataatattgacattcttttttgctatttttcttttttccttttgattagatgacacttgagaaattaggtcagccatcatactttctgtccaaatggctgttgggtcatgtccacctaatagaaaggcaattttggctgctaatttcctgtctgatcagattaattgaattcagacagtgagcacagagccccctttcagagtaaagaagacagcactgacattagtgctcatgcaggcttcttagtttttctctgatgaggagctgtgttttatttccttgatcttggaattactgagagagatggagaagatgcaggggagctcagaaagcgtgtataggaggggcttaaggagggggcaccattttcctcctggcattagtaaaacctcaggagtgagccttatgactctggcttggaagataagggggggcctgctttgtcacttgtgactacaggattaatgacttggttatacgtcatttctgaacccatagtgtctgtcgcccactttatgggaattaaaccttccattcagagcaaataagttccccggatgccgggcacagtgggtagcggtgcagggaaggaaagaggggtgagggaagggtcacaaatgagccatgaaaactgccctgaagagcttacaaactaatgaagcactttcgtttttatgctttatgttctataatagaaaaaatcgaggtggcttataatgaagactacagattaatgatggtcatttaaacaattataacagaaggaaaaaatgtacaaggaaaggagttaattagaacctgaacacctaggccaagactgatttacaggatcatagcacatcaggattgaacaggcttatgaggagcactcagttcaaactcgccccacactctcaggctgttgtccgaatcctttcaagggacagcccaatccatcccaatcactccaactctgagaacttctgcttgatatatttcatttatcaagctgatatctgtttttccctttggtcctagccctatccattaggagccccccaagagcagccctatcattctacaagatggcccctcattgaataagttgagggtttcctcttgttctctgtcttctcttcacctgtgtctttggtgtttcccatatgacttgcaagcaccttgagccagtgattgcctctcaaacacctttgagttgcagaatgtatgagttcattttcaccctgctaattaaaatatacccaggactgggcaatttacaaaagaaagaggtttaatagtcttacagtttcccatggctggggaggcctcacagtcatggcagaagacaagagcatgtcacatcttgggccaggcgtggtggctcgcgcctgtaatcccagcactttgggaggccaagtcgggaggatcacgagttcgggagatcgagaccatcctggctaacacggtgaaaccctgtctctactaaaaatacaaaaaaattaccttggcatggtgacaggcacctgtagccacagctactcgggaggctgaggcagaagaatggcatgaacatgggaggtggagcctacaggagccaagatcaggccactgcactccagcctgggtgacagagtgagactccatctcaaaaaacaacaaacaaaagcatgtcacatcttacgtagatgttggcaggcagagagagtatgtgcaggggaactcccccttataaaaccattagatctcatgagacttacaatcatgagaacaacatgggaaagacctgcccccataatacaattaccccccaccaggtctctccaacaacatgtgggagttcaagatgaaatttgggtggcaacacagccaaatcatatcacagaactaccacaatacctgttacaaaatgggcactcaataaatactggataggtggattcattggtacctgtcttcttaaaagaagaaaggcaggataatcaatgagaggttttctcactcatggttatgaccttgcatttggatggaaagtcatctacaaatatgttttcaccttctcagggcaggctgaacaaagcctgtctgaaggttgtcagataactatgttctccaaagtatggggagtttattaaaaactcagatgcctaaaccatactccgaacctactgaataaggatctctttctgtggggcccagggaatctgcattttaacagattcctaggtacaattcagtttgggaatcctacaaaggctttaaaagggcaaagatttcttaaagtgtgatcagtgagaatccctgagactttttcaggggcttcatgaggtcaagactattttcataaaaatactgaggtgttttgtgcgttcatccctctcatatctcatgtatatatcatggagcttccagaggcttcctggtgtacatcattgaaccagactcaaagtagcagataagagaatccagcggattcccttaagtcaaacgtgaaagccctgcaatagccactctttctactatattttcttttgtttaggaaaatacagtttttaatttaaaaatatttttatgttaaaaagctatgagtttatttttttagtaatttggtaatctttttaggttttgtagaaatataaaggatcctgaaaccaaaaaatttgagaagtttgtttgctattgggcaacaaactaaataaatgtatttaaaaagtagatttcctatctttattcagtgaaatgctatatcaagtagttgatcccatgtcaacttaatttgttaaaattatgatttctattgataaaaggtctcatagttcctattctccaagaaggccaaggtgtttttgcagtattgcagcatgagcaggaatcaggcgctaagtattgctttcctttaaaaaaaaatgcattatatttcccagatttctggcaaatttgcagttattcaattttaagtagcgggaaccaaatccatctggatttttaaaaagtacaaccccaggaattttgtgatcatagatatgactcctttatctctcattcccaaagcttaaaccagatccagcttaaagtcatctgattttcttttagctcttccccattcaccatgggctccttaaaccaaagataccttctaagcaaaaggcaccttctaagctccaagacaaccctctgaaatggggaaaggtagcagtattgtggtaaaggtttaatgaatggcttggaggacgtgcaaagccaagccctgacttgccagtttccatggtgtgaagaatcccgttatagttggttttgagttgaagctatcaacccggcatcactaaacacggtaatgggaagggaaacatacaacaggctctggaggagacagcaagaaaaactgtctaaatccgttctctctttcaaccatccagagtttactctggatcctggcaatgccggttgaggtggcattattccagggtagtctttcatatgtcagcagagaagagaaggatacaagtgtggccaaatatgttagaggctggagcaaactccttgagagcatctgattcgcattctgtgaagaacctgtattcatagcaagaaatgaggctgaaaagagaagcagtgaatttagaacatgactaccttgcctggagaggggaaagggcaggatgttgaaccttagtctcataatcagtcttatcagaataacaatagccagcatgctaagcctggatagaaatacagaaagcacacagcactctgcctgccttatactgtagtagtgacatctttcctttttatttatttattttttattgtaatgggtgctcttttgggaagaatgaatcaactacttttgtgcaggttcgtctcattttaacttttttttttttcattttgtgaatttgaattgaatatttagtcacaggaaatagttttaagttctctgggaggccaaaggtaagaattccatgtcatagatacaaacgagtctaatatcagggctagatttattctgattaaatcattgtaagtcagctgtttttatagatctgaagtagaagagaaagtaaatatttcatccccgaggatttgttagtagagatttacatgcctccattccactcttgagtttgaatttaaaatagtcacaatgccgaggggctcctggatgcacgcacaaagtaattgttttacaattctgttagacaaaacccatagcacaatagctgcaatgcaagtgtcagaggttagggggaacattaaaatcattcaaacgctgcacatatctgccgcattctggaaaccgctgctaaaaatgggtattaaatctcaccttaaaggtcaggggcaatttacccatctttattaatgagtcgaaattatcctggaaggaaccggctattaaatatgtggagttgagacaatcggctatacatctgggaaaaacatcattagcttcctctctcacaacatgtagtgacacacatttctagatggatatgagatctaaaagtgagaagcaaaccataaaacatacctaaagataatataggcgtagctcagagatatcaaaggttgatttcagaccaccacaatcaaaggaatatcacaatgaagtgagtcacatgatttttttttttgcttttccagtacatatagaagctccatttatactatactgcaatgtagtaagtatgcaatagtttcatgtctgaaaaatgtacataccttaattaaaaatacgttataactaagaaagtgctaacaaacatctgaatctttttgctggtaaagagtcttgccgcaatgttgatggctgcagattgatcagggtggtggttgctgaaggatagtatgcagggtactgcagcagttttttaaaataagacaacaatgaagtttgtaacatcaaacaaggatttcttttccaaaatctttctctgtagcatgtgatgctatttgatagcattttacctactgcagaacttgttccaaaattggagtcagtcttctcaaaccctgctgctgctttgtcgactaaatttctgtaatattctaaactcttttttgtcatttcaactatgttcatagtagctttaccaggagtaggttccatcttgagaaatgtctttctttgcttatccataagagcaattcttcatccattcatgttttatgatgagatggcaggaattcattcacatcttcaagccacacttctaattctagctctcgtactgtttccatcacatctgcagttccttcttccactgaagtcttgagcccctcaaagtcatccatgagggttggaatcaacttcttccaaacccctgttaatgttgatattttggcctcttatcatgaaccaagaatgttcttaatggcatctagaacagtaaattctttcccgaaggttttcagtttactttgcccagatccatcaaagaaatcatatgccagctatggcctacaaaatgtatttcgtatctcataagctatagttttacaaaatgtcttttgaaagtcaaaattactccttgatccatgagttgaaaaatagatgttgtgttaccatacacaaaaacattactcttggacatttccgtcagagctcttgggtcactaggtatattgtcaatgagcagtaacattttgaaatgaacctttttttcctgagcagtaagtctgagcagtgggctcaaaatattcagtaaactatggtgttaacagatgtgctgtcatccagattttgttattccatttatagagcaagattaaatttcagaatggccaataagcatttgcttcaattttaccccctaaccagagagtctgcctattctttgaagttttgaagccaggcattgacttaatctctagctatgaaagtcctacacggcatcttctttcaattgaaggctgtctcatctacactgaaaatgtattgtttagtgtagccactttcatcaacgatcttagctggatcttctggatatcttgctgcagcttctatatcagcactcgctgcttcgcctagcactatgttatagggatggcttctttccttaaacctcatgaaccaacctccgttaggttcagacttttcttctgcagattattcacctctctcagcctttatagcactgaagagagagcactttggtctggattaggctttaccttaagtgaatgttgtgagtagtttgatcttttatccagaccactcaaactttctccacatcagcaataaggcagtttcacttccttgccattcatgtgtttactggggtagcaagttttgtttccttcaagaacttttcctttgcattcataattcagctgtttggtacaagaggtctggctttcagctatctcagctttcaacatgtcttcgtcattaagcttaatcagtctaggctgagtggtggctgacacctgtaatccccgcattttggtaggctgaggtgtgcagatcacttgaggtcaggagttcgagaccagcctggccaacatagtaaaacctcatctgtgcttaaaaaaaaaaaaaaacgtagccaagcgtggtggcgcgcacctgtaatcccagctactcgggaggctgaggcaggagaattgcttgaacccaagaagcaaaggttgcagtgagccgagattgcaccactgcattctaacctcggcaacagagcgggactccgtttctaaataaataaataaataaaattttagggaaagcttaatcagtgtagcttttgatttaaagtgagggccatgtgtctcttcttttcacttgaacacttagagaccattgtagtggtattcattggcttaatttaaatattgtgatatctcagggaatagggagtcccaaggagagggagagagatgggggaatggctgctcattgcagcagtcagagcatacaccacatttatcaattacatttgccatcttttgtcttctgcggacatggctcatggtaccccaaaacagatacaatagtaacatcaaagatcactgatctcagatcatcataagagacataataataatgaaaaatgttaaaatattgccagaattaccaaaatatgataccaaaacacaaagtgagaatatgttgatagacatgctcaacgcagggttgccacaaacattcgatttgtaaaaaacacaatagctgaaaagtagaataaaagcaaagcacaataaaatgacaatgacttatctgtgaataggagaagctaaaaatgtaacgttggaccagagagggctagtaagcaaggctccaacccaaaaaatagtaaataaaaatataagtcactaaaacccctgtctatttgggagatcataaggttataaaacaagtgacaacaggacagaaaaattttgcaacatacatgccagacagttactgtccttagtgtaaaaagagctcctgtaaatcaacaagaaagagacaaataggaaatggaagaaagttggcaaagaaataagttcttccagtgccttgagagaataagttttcctttccagcaaacctggacaccttaggggcttctgaacacattgcattgcttcctcattcagggctgctgatgggtggattttcatcaaagcatattttcatcctgttattctattgagcaattgacctctgtgggtctccatggttgataggctaacatgtaacctcatcatggtatttgatatttaattaaatgagataatttgtataatgctctagtacagttttaggccatggtaaactccgaattaattctgttcttcactccttatttatagcattgctgagaaaattaggtgagattctgtatttagaagaagaaaagttcccacttaatgatggggctgctcaataaatgttggtcctcttctctagaaaccctgactcattcagcacaatcccttagatcttcacagatttttaaatctttaattagggctcctccatcctggctgaatgtttgaattacctgtggagttactggatgataccaatggccaggccctaccccagacaagttgaatatgaactccgagtgtgggacccaatgtattttaaaaagttccacagaatggctgggtacggtggcttactcctgtaatcctagcaatttgggtggccgaggagggtggattgcttgaggctgggaattcaagaccagcctggccaacatggtgaaaccctgtctctactaaaattacaaaaattagctgggcgtggtggtgcacacctgtaatcccaactacttgggaggctgagacatgagaatcacttgaacccaggaggtggagtttgcagtgagccaagattgcgctactgcactccagcctgggcaacagggctagactccatctcagaaacaaaaatttccacaggagattgtaatgtgcagccaggggcaatatctacctgaaatgtcctttagtgttcttacagtggtgcctttatccctgaggtgccttttcccttccaccttgccatcatcggcctctctgtgtattaaggtcttagtttgagctggaaataaccttctttttggaacccctgcagcatttacatcctttggtcttagaatagccttttttggtaataatatctacttgtaataatatctttatatccagagttgtaagctcctggaggctggggatataattttattaatcattacatttttgtaatgtgtgtttcagcatttgacacatagcaagttctcaaaaactgttgaataaataaatgaatgtaagtgaatgaggatagacatgtatctttacacaagcctagagccaaaccattctctgtgagatctgaaaccaagcccctgtagtctgtgtgttatcaaacacagtagttagcttcacagacagccttattaactaactcatcccgcagttttcaaagagcatgtatttcttgtcattcatgaagttgttagttctggggaagtgttggactttggtaaacaccctctctttcggcttctcacttggattttcaatcctgagcaaagagaccactcaggagaagaatctgagtagtcaaagcagagagttggtactagatggcgctggacttactagctgtttgactttgagcaaattgcctgttagaccataaaatccttatctgaaaaatgagatacgatactaccacctgtttcacaggtaaaagtaaaatgagaccactcattaaaatatatttactctagtgccagctacttagtgaactctcaaaaaatgatggactccaggaaataaaaattagattaagattaaagagtacaggctactgtgaaaagaattgagcattttttagtggaaggagggaggaaactaacatttcctaactaccagccgtgtctgaggctgagaacttctctggtcaactcagtgcagaaaaaaatggcaaagtgtttaaatatattacataacataacatagcgtaatataataatatagtaaatataagtatagtgaatataattactttgattacataagtatgattagtaataaatgatagatataaaatagtgttaatataatacaaaatactatagtataatacaatataatgtgtatgtttctttttaaaaccttttcagtatacgttgaaggaaacaaagacccaagtttaatagggaaatgatttttgtaataaagtgaacaaactggataggttctcttgagctggttacagctgttttctgactgaattttaattataaaagatctagccagcttctatacacactctccctgcacaaatgttaactctggttcagacaccttttctgcacccagttattctcactcataatttctttctccttgggtttttgttttattttggaacggctttttaaccttcagaagtacattttgtctggaggaccagagtatcgatgtgatcctacctgtagattcttggcaagagagaaaatgttcttattaatgcagaaagtcctacccagaaggaagaaaacgtctcacctagaaaaaagtcattatgtagttttttctgggctcatggtttcctgaagagacctggtcctagtcaatttctccttggtattttattatttttgtccatttgaggtgaaatccggaggaagtaattatgaggttgttttaggggcacaggtggcattttcatggattggctgagctgactgcctgcagttgatttggggatggggtctactttagggtttcactgagtacaggtggtcacagatatccacaggttccaaccagtgatggaaaatattcagggaaaaaaaaacagtaaaaataacaccataaccataaaaaaagcaatgtaataactatttacatagcatttacattgtattagctatcatatataagtaatctagagatgatttcaagtatacagtggatgttggaagggtgttcataggttgcatgccgatactttgccgctttatataagagacttgagcattccaggattttggtgtttgtgggggagggatgttgaaaccaatatctgcgggtaccaagggacaattgtaactggattctagagcacattctgagtttgttggcagttttattaatcatatttgtattaaaatgcataacgaattatagaggaaaaaaaataaactctactcattgtggccaggcatcacagagaagtgggacaagggtgtggaccaaagaaacagaccaaggagcgtgggcgaactggagggttcctgcccatgtcctgcccactttctgttccaggtttcagaggagcaaagagccgttgcccaagaaataatggctcagccatctttaccctgtctcaaatgcaagtctctaaatttgttcctcctccttgtctggcaagtctgagcaacgttcctgcttcagctctctccccagtgtttgaggcatgaactggattccaggtgatgacttacccaaacacctcaaggagtttcgcctctaggacctgggtggaccttcactcttcccacatcagccccaggcagacctctctgcacgatgccagttgcatccatattacagctgacatttgcagttgactttactttgacaaatatttttccatttttatggtgaacccaaagagttctatcctcagggcatctgctagcccctgtggtatgtttgtgtagaatttaaaaggcatgctccctctggtcagaggcagctttacagatgtacaaatttgggtgatagaagtttccgttgtcaaatttaaaaatatatcctattcttcacacctgtaatcccagcactttgggaggccaaggcagacggattgcctgagctcaggagttcaagaccagccttggcaacacagtgaaaccctgtctctactaaaatataaaaaattagccaggcatggcagcatgcgctggtagtcccagctacttggggggctgaggcaggagaattacctgaacctgggaggtggaggttgcagtgaaccaagatggtactactgtattccagcctgggcaacaaagtgcgactctgtctcaaaaaaaaaaaaatgtatatatatatatttatatatatatacacacacacatataaatatatttacatctatctatctatctatctagatatatacctcatattcttgtgagtggactgaggctcatgccatgtggaaagtgaagcaagggctggatatttgattcctacttgtccccctgccatgcccgtgctcctatgtgtattataacctgtaccccatagatggttcttgagattactcctcctttcatctggaagataatgttcatcttttttagggccaccttcatgagcgcatgctgaaggtacccatgtaaaaaggccataaatgtttgaaaagccttcaggtactttataggccatgttcattctgcaaatgtcagtggaatgttcaggaagtccaacgtagagaaaggcccaggatggctagaatgaaatcagagatatccagtaggacctgatcactggcagaacccagactggggccagctgatgaagccagagaggcattcgcttcagggaccaaaactttcattcagtaagagcgggggtcctcaaccacgggccacaggccagtactagcctatgacctgttaggaacctggctgcccagcaggaggtaagtagcaggcaagcaagcaagccaagcttcatctgtatttacagccactccccatcgcttgcactactgcctgagctccacctcctgtcagatcaggggcagcattagattctcatacgagcatgaaccttattgcaaactgtgtgtgcaagggatctaggttgcatgctccttatgagaatctaatgcctgatggtctgtcactgtctcccatcacccccggatgggtccctctagttgcaggaaaccaagctcagggctctcactgattctacattatgatgacttatataattatttcatgatgtattataatgtaataataatagaaataaagtgcaccataaatttaatgtgcttgaatcatccccaagtcatcccctcacctcctcctggtccatgaaaaaattgtcttccatggaaccagtccctggcaccaaataggtttgggacctctgatcaagagtgatagcattgtaatgtaacatttttgaaactcaaaattaatgcatagaagtccatgagaagtaaaatgttaaagacaggatcaaaatcaatgcagaaaatccataatgagcaaaatatgaacatgttttaaaaagagggcatcagtattactgatttctttcgtttgactcaggctccagtacagcttatgttggcactgtgatgtatcctgtctgtatttaaaatttttaggtagtgtccatcatgacctttttgcagtaattgcgatttttaaaaatattgcgttaaaatagtacatatcttgattactgagttttttggtgcctcctttgagatggtgcagaaagcaagctcctcactcatctcctctagcccagccccaatagctaactcactcttagcgcctgtccttgagtgctgtgtgagccattgtgttgcaccagcttgttttaagtcccaacaatcttgttccatggtgtcttttaataatggaagagcaaagaggttaaatgactagcccaaggtctacatgaggtggaggaggagggaatcaaattaggcataaagcctattgcttggatcatgtttagtaacaaggagacggaaggtggaggatatgagaggctgatcaaggtcgcaggagcaagtgcagggcagagacagggtggcagctccctgtgccttctggaagccatcccccaagctgaaggagccacacagagccagctgtccaggcaggacctctctgcggtgacattcacatggcagagttaccaagaagaaagcttgtgtccccaagacttgtatttgaaagttaattgcttaaccttttcccaaagaatcgtcagcaaatattgcacacacccacaaaaattattttgcctttcataaagcacaagtggacatgtctttatttctctgcaaaacgagccgctgcagtgcaatcacttgaaatgtagggtctgaatgaaaattaatgctgttgatgaaaccagcagtctaaaacattacaggatattagactgaaaagacagtggtatttgcatccttttgaacattcgcctggatttgcataatggagatgtcacttatattgcaggagaaaaatcaagttacctgggctcccattaactgcctgctcgctacagttcccgtaaggggttggaacaccacctttttgaaatagaaaatgtgaaactcctacattcaccaagtgagtctttagtgaaacaggagtgaaaagaatcatgggctattgcttgctcctggcctacaagaaccaaaaaagacacatttctgctggaggcgaagaccaggaagaattcactgtctgcatatgaatgtgcgtgaacttggttgtcaggaaatgaacagtacataacccaacctgggacccttttggcctctacagcttgaaattgtaacaccagcttcactacccggttatattaatctcatgtatttttggtatctggtgacagcttctttctgaaaggcttctgtttagggcggtgtgtggtaactgtgggtgtacatcacaatcatcttggatgctttataaaaatgcagatgcccaggctccactttagtgtggaacccagatattgatattttttcagcactcttaaggtgattctaatgtgcagcctgcgttgagaagcactgctctaaaagatctctgctgcattttatccttctcttatttgaggctgttttaatggagtaaacatacaggattcagcataatataaatttaatattaataatgccagggacatctaagggcacattcaccccaacagtagaaactcagaatggggacagtctagctggaccatttatcagctgcttgggcttgggtacgtggtttagcttcttggtgtctcagttttctcactttgaaatggggataataatttcctttctgatcatatgtaaggatttatgacaatgtctatcatacagttagcctgtaaatgatacgttctattttatgtaaccattaaaacaatttctttgtgggctgtactttcatccagctggatggattttaaccaagtgatcccacctctatagccagcacccagattaagaagcagaacaagactcttcctcttatagccccttctaatcaccagcttctccccagagggaaccactcttctgacacttaactgtacagattagattggcctgtttggggactttctactgatggacccatgctgtgtatactcttttctgtcaccttctttcagtcatcatggttagtcagatgcatgttgttgttgcatatcgtttgttcattctcctccttgctgctgtgcaatataccattacgggaactaaccacattcaattctattttaattgttagtatttacaatggctccctaactgggatctcttttcaaacaattcactcttcagtccctgatatgatttggtgctgtatccccacccacatctcaccttgaattgtaataatcccctcgtgtcatgggaggcatccagtgggaggtaattgaatcacggggggcaggtttttcccatgctgttctcatggtagtgaagaagtctcacgagatctgatggttttataaggggagttcttctgcacacgccttcctgcctgtgaccatgtaagacgtgcctttgcccctcctttgccttccacggtgattgtgaggcctccccactcatgtgggactatgagttcattaaactcctttttctttataaattatgcagtctcaggtatgtctttattagcagtgtgagaacagagtaatatattccctcttatcgaatgacttctacacagtgtgaatgagatcagattcctcttcagtgcggaagaaaactagacctcttggtcctgtgttcagggcctttctcgggctccaaggccctcgttgtgactgtccactgtccatgcacgtgcactttttttctttctgaccatgcatcttcactcagggccgcctttcaccttgcttttcctgactgttctctctgcctactgcctagaatgtttttttcccatctctacgcagggaacatctatacatttctcaagatctggagttcagtttgtcacccgtgaggagcctccttccacttcgcctttgctaatccatcctgtcttttgtgcactcatgcagcatgtcacgcagacctttgttaaaggtcttatcaaatggtatttgacagtacaggtctatttctctatgagactacccgttgttcaaagcggcaagctaccaacctgatctcattcatctttgcatccttcatgctgattatagtgatcggctgttctcaattaatgaatggaagaattaatggataagtggataaatcacttaataaatcagaaatcttttagactttgctgctcttcctcgaagcataattctggttagaggtcacgtagtaaatatattcagggggttctacttcttcatcttccagggagaattgtcgcttttctcattcaacttttcagcttattgtacccccgctttgtaccccacctcactcccagcttctagatacctgaggtttggcgacccagctacgagactgtcccttccttccaccacctgatagtgcaaaattgggacaaagtcatcattaggcagcgtagttagtagcaagatattagaagtcctcagaatagcatttgcgttttcatatactactttgttaaccctatgcaaaaataatccaagatagaattttagtagatttatttccacagagaccaagatagttttcttggtggccgtcataactgtttgatgtaactaaaaataaaactagccctgactgctaataactcaaaaccggtggagattagagcaagggaaatgtggttaattcaactccagcttgctttgacctgaatttatgccaactgggacttttgcctgaattattcgggaaaatgccctgagctgccccttaattcatcttgtacgtttggtctcttacatattgaaaaagtgtgttctatgattcttttccatatagctaatgtcatcttgaccaggtcagagttcctccaagttgtttttaacatacaaatttatcacatcacgtttcatcatgcctgctcccaatggtcatgagttattgaatttgtataggagagttaatttgtaatgtccttgaggtatcatttttcactattggcctatgttggccacctttgtttacatttagttcagaaagcactaatttaagaagtgtcaggttgtaacaaaacataagatcaatgcagttagtttctgttcagactttaacaacttggtatctgtcaactgaagcatgaacatagatatgggcaaaacccaattaatacacagttgtaatcacagtgggacttagtggtactttctcctttgcacagtgggactcttagaagtggcttcattaatgttgcatttgtagtttgagttctgctcttcttctcatattgcctagttctgggcctccctgtcctctgtcctgtggccacttttccatgtggggacttttggggcctgatggctttttggtacctctgctgtcctgctagctgccaagaactctccattactccccctttgattgcttgggacacatttttaaataaagcagctttgggccacagcgacaaaaagtgtagagccatctttttgttttgcagcctctatttctgttttgaacaggtcttttcaaatcaagcggtaggagctatacctctcccagatgaggcccatcacacactctcactaagtaggcaatttctttggggtgataaaaatgattacaaatatttgaattggaatcgttgggaatctcattaaaaacaacaaccatgatcaggtgacattgtatttgtgaatatcctcagggtatgttcagaaaatcagtgttataagagcttgaacgattatattagtttagcttgatagtgctctgtttcttttctctttacacttgcatggcataatatattaataaaaattaagaaatttttagtgaaaccaatgaatttgctttcagaaaacagcattttacaatatctattgggtaattatatcaaatactcgattccatggtttctggtattggataaatgactaaatttgtaattaaacacatcttttggactaaagttactaaacagatagttgagtcaattacataacagcaatgggcattacattagattttatcacaacagtaattactgtgtgatgttagattctattttgaattgctctttctaaagatgggttatcagcaacagaatatgcattgggcttttatgagcggtctttgcactactcatatctgataagggccaaatcctatgataagaggtcagagactggtctggcagtaaagagccttcattaaattatttttaatagtaagcatttattgaagcttattacgttagaacctgaagagtcacagacatgtaaccttccccatgccttctggggtccttgctctaatttgggagatacaacacatagagaaaaaggtacatgaggcagccttgccaccggaagaaaatggcactcaaattcccagctgtcatctgggaaaggtcaattgttttctttacaaagccaccttcatagcaagactttatccatgtcagcagtctagaatgtcgtcatctttatagactcagaagcttgatttggtgtctatattcagaggttatttctatctcagggatagtattttactaatcaaatacataacagatatatacataaaccagaatgaaaacatattatagtgagaaatgtaattattgattgaactggatatttgtcttttcatgtcaacttattcattcagagcaggtgtgggaaaacaaattttagtcatgaaccgggttggaaagtattaaaaacgaggatttggtcatcttaacaaagtgtttctcagctacagtttcttcccaacagagtgggagctaacaataggaataacaatcagagccataatctctaagggcttcactgtttaccaggaattatactatgcccttagcatgtattatctcatttaactcccatgataacttttcatacaggtattattgttgcccctgtgagcaggaggagaagattgaaaaaaatcaataactaccccaagttgtgtagctaggacatagcatcaaggattccaagccaaggattatctgacttctgtttataaactatttttcttttagaattttttcctttcttttctaaaattgacataaaattgtagtttttactgtgtacgacatgatattttaaagtatctatacattgtggaatgattaaatctagctaatgaacatatgcattatgtcacagttactatttttgtgttaagaatattttacattcactcttttagcatttttaggaatacaatatattgttattcattgtagttgccatattggacaatagttctcttgagcttatttttcctatccaattgaaatgttctatcttttggccaacatctccctaacaactcccaattccctgcaaccaccccagcccctggcaaccaccattctactcactacttctgtgagctcaacattttagcattcacatgggaatgagactatgtggtatttgccttgctgtgcttgagttacttaacataatgtcctccaggttcatccatgttgtcactaatgataagatttcctgtctcatataatatatacatatatatgtgtatgtgtgtgtgtgtgtgtatatatatatgtgatattcatgtattgatggacatttaggaacaaattgaacaagggaagtgaatgatctttacactgaaaactataaaacactgataaaagaaattgaagaaaacaaaaataaatggaaagacatcccatgttcgtggattgccggaataatattgttaaaatgcccgtactacccaaaatgatccacagattcaacataatctatattaaaatatcaatgacattattcacagaactaggaaaaatcatcctaaaaatcatatgaaaccacaaaagaccatggatagccaaagtaatcttgagcaaagagaacaaagctgtaggtatcacactacctgacttcaaagtatactacaaagctgtaacaaccaaaacagcatggtactgttataacaacagacacatagaccaattgaacagaatagaaaacccagaaataaactcatgcatctatggccaactaatttccagcatagttatcaagaacacacaatgggggaaaaaaactcttcaataaatggcatttgggaaaccgcatatccatatgcagaagaatgaaattggactcctatctgacaccatatataaaaatcaactcaaaatgaaataaagatttaaatgtaagacttgaaactatgaaacaactggaagaaaacatagggaaaagttccatgacattggtctaggcaaggattttttggacataacctcaaaagcacaggcaacaaaagcaaaaataaaatgattatatcaactaaaaaacttctgcacagcaaatgaaacaacagggtaaaaagacaacctatggaattaaaagaaaatatttgcaaactgtacatctgataaaatagaaaaaacaatgaataattgaaaaatgggaaaaggaactgaatagacagttttctaaagaagacataaaaatggccagcaggcatatttttaaaatgctcaacatcactaataatagaaatgcaaattaaaaccacaatgagatatcacctcatacctgttaatatggctgttatcaaaaagataaaatataaatgttggcaaggatgtggagaaatgaggaacccttgcccactgttgatgggaatgtaagtacagctataatggaaaatagtatagagattcctcaaaaatttaaaagtagaactatcatatgattcaacaatctcactagggttatatatccaaagaaaataacatcaatatgtcaaagagacgtctgcacttctgtatgtattgcagcagtgttcacaatagccaagatatggaatcaacctaaaaattcatcagtggatcaatggatcaatggataaactatttttaattgaaagaattaaaattgtatctttatgagcctattgatgtttcagagaaataaactctggtcattgaatgaaatctctgtgttgcagaaacctctataagctcctatgtacagataatctcacagggtaaatttctctgactagctttccacattcttagcattcttttctcagagaacatgtgtatagtccttgtatagggccataattttcagatacacttttcccactcttctttgtgcttctctgtccttagttgcttttctcatttaatctttataatttccctgtgatttaaattatactttcattttacagatgagaaaattgagacacttatattcacatatcccactctaggtcagtcagtagcagagtcggatgatgcattctgttgttagtgcctggacaattaagtaccaagaaatgctattgattataggagttcatggtagggaagaataaggctgataagtaatgagtatagtttaagggcagacgtatttggaaaggggagaggcataagacaggagactaggaaatggtagacctctgtagtttattagtaatgtctgcctcggagtgacttggaggatgtggtaataaaagcatctgcatgtacccttgtggctataagtttcagttaattagtacaacacaagtacacacacacacacataagtggatctcagccatctagatgggacacagagtttttatgacaggcagggttaatgatttcataatggtgaacttttgccaatctcactactatttgaatatttcacaacttgttcaaattgttaagtacaacagcagattgcatgtacacccaataacacgggtttatgtaatgtacatgggtaaatgtacatcttccaagggagaaagggtgctctgtgtttccagcatgatggaacccagtttcatgatggattggcatattccatagatgaagaataattactggaaagaatgcagagccattggggactttctaaatagaggaatgatgagataagatatttgtttgggaaatcgctctgaagaagatggaatgaaggagagagggacttctggaaggctgtggatctattttcattttaataagcatggggggagaagggtaggagagaggatggtcaacaggtacaaagctacagtcacataggaggaataagctctggtgttctattgcataatagggtgactatagttttcattattatattgtgtatctgaaaatagctagaagggaggattttgaatgctctcaacacaaagaaatggcaagtgtttgagatgatggatatgctaattacctggatttgatcattatacaatgtatacatgtaccaaaagctcacattgtaccacataaattattaatacaataattgtacgtcaattattatgtgtcaattaaaaaaacaaaacttaaaaaatagtactaatgggaggtgaagaaggtgtgaataagggcagaaagactgagtgggacgcaagtgaatgtaacaaatgctgttctcaaatagctctaacttatctctcatgcaccagagcactcttgtttctcactgaacactttttgaatgcctctttcatgttgggcttgggcactgttctcagtggtctttgtagttagatgtttttgccaaaatgttggaaagagtccttgatatatggaaactgacaaagacataacttcaaccagtcaaggagatttcagtgtcagataaggctttgatgtgaacatgcctggcacatagatggttaatatatatcctatggatgaagaaacatacaaatgaccaaaggaatggaataggtagactaatcgaaggacattcaagatagacttctaaatgcccgaaacttttcaaagtgagatccagacctttcttgaggaatgatgtttctctactctgatctgtacagttggtgaaaataagaaagaagatggaacccagcacggcagctcacacttgtaatcacagcactttaggaggccgaggcaggaggattgcttgagcccaggagttctagaccagcctaggtaacatggcaaaaccttgtttctacaaaaaaaaaaaaaaaagaaaaagaaaaagaaaaaaagaaaaaaaaattagccaggtgcaggggtacgtgcctgtggttccagctactcaggaggctgaggcgggaggaaagcttgagcccaagaggtcgaggctgtagcgagcaatgatcgccccactgcactccaggctgggtgagagagcaaggccgtgtcaacacaagacgagacaaaatgagatgagacgagatgagaaaagaaaaagaaaagggaagaagtgagggagggaacatcagtgcaggtaaaatattatttttcttagaatgaaaccaagccagcaagaataataacttttgaaagcagtatttctccctgtgtagcccttagacaataggcatcaaaatttcttgagtgtatgtgacggattcctaggccctacctcaagcctgcaaaaataatctctcacagagagaaagggaactttaagcaagctcctcatttccttttgctgcagtaaaaatttctaagaatcagtgggttagagcttcctaagcacttaaaaactccaagaagtaaggacctgttattagaggtaacaagtataggctaatttgatttccttagaaaaccttcaaaacagcagtgtcacagaatcactcttgattaaccactggacttggaaaggcctaaggttgagaggctcagatggccccagagtaaaagccctcagtatgcctgcttcactgagcattacatgagactgttccagctctgtgatgatcaaataagaaaagcttgtgaggattttcactcttcacaatgtgatgtcttttccaataacagcattaatagagaagtgttatctttagggcatcttccttgctttatgtattttgcaataaatttatataatttttactgtttctgagtgtaaaagtaatgcatgcttgttttaaaaattataaaatactataaagcatgagtaaaaataaccaatattcctaccaccaaaagataagcaatgtcagtatatctcctttcagacatttttagtatgtacatatgcatataattttaccaaaatagaatcataccatatacactgttttgcaacctgttttatctaatctgaatggagataatatctttctgaatcatgtatattttcattttttaatggctggagaagataccacagtgtggatgtttctctttgttttattattcccttattttggatgcttgcttggattgtttatcaggccatgaaaaaaaaaaaaaaagatgaattccccagaacattataaggaaatctagggaaagacagcactaccttaccttaaactttctggctcatgtcacaaatcagtaggtttggactcctcatgcttgcagcacatacactcttgctatcctcattctctctaggaaccaccattcttcccccaagtctccatcactcatctgcttttccgtggcatgtcattcatcctcactagagatcatcttacttccctcgattattctttgttcattccacataagtgtattgagtacctcctctgtgtaggaattttaaaagaccctagctttatttagtgtttgttaaagcatctcttaacctcctctcattaaggatacagattcatgataaaaaccaaacaccttgaccaaaaggctaacttggaaaatgccagttgttattactgcaatctcaagtaatgaaaattcatggagtttatataagttattgcagcataacactttatcccaacacttagtggctgaaaacagtacataatgatgagctcacagcttagtgagatcaggcgtctcctcatggcttagctctgctggaggcctcaggctgtaatcacgatgctgaccagggctacaatcatcccaaattcagatgagggcaaggtctacctgcaagctcacttgattgttaacagaattgagttcctcataagttgtcaaatgagagcctcagtttcgtcacaggagtaatatcccatcacttttgccatattctgttcattagatgcaagtcactagttttagcccatactcaaagggaagagattacccaagagggtgagtaccaggaagctgggatcattaaagaccatctttgaagtcaaggatatgctcatagagctgatagacagtgataaaacctcagcaactgaccagaaaaggtcaacttagaaaatgagattttgtagtttaaactcctggaaattcatagatcataacatttcaacttacttttaagttgagtgacatgaagagataggtcaaaatatttacatttgctaaatgtgtacttactgttctttatatagagctttgcagcttacaacatacagttctgtgtcaatattttcatttgattttctcaaacctggaagggaggaatggaagatgttatctcaaatttaaagacaaatgaactgagacctgacaagttaccagctgagtaggttacatctttctgccagttcatgtgttggttcaacaaacgtatacaaacaaatcttatgtgcttggcaccatgccaggcagggtctggggacgcagtgttggacaacatgaatgtagttctgccctcccagaacctagtatcttgtcaagatgagacgttaatccaattaaatcttacataaaataagactgcaaactttaatattttctaatggttgaaaaggttatagatcatgatttatgcagtttatatatgcaggtttacatattttaaaattatccagctgcattcttaagatttgtacattttactgtgtatgtgatgtttttagaacatcctgggaaggaaagctacatagcgctaaggtagttcgttaaagaagacgtggctgagagccaggaaacagggatttagatttcctcttcaccaagtggcacatgtgtcctgaaaatgttaaactgtgggcatttttaatattgcacatgttgaactgatacatataactttctggggttttttttttttttttttttttttgagacagagcctcactctgtggtccagactggagtgcagtggcacgatctcagctcactgcaacctctgcctccggggttcgagccattctcctgcctcagcctcccaagtagctgggactacaggcgcccaccaccacgcccggctaattttttgtatttttagtagagatggggtttcactgtgttagccaagatggtctcgatctcctgacctcatgatccgcccgcctcagcctcccaaagtgcagggattacaggcgtgagccaccgcacctggtcagggttttatttcagaaccgtttatttccccagtacatttatccactctacctccctctctgtgattttccattttcaggctgtgccgtgctggttttacccagtaccttgtttaatgatggagctcatcatttcggagtttttctctccgtgatgctgccacatgtgtcagggctgtgtggctgttacagaggaagggtctcgtggggagggagcagtgaaactggtggagcaagcaaggtcggaccgacagactatcttctcggatgtaagagaggttgttctagggaagccgtgttcctggcgctgggaggctttacgaagagtttttgaaatctccagcttgaacgttagtgtaccttattatggctatacttggtctcaggatgccttctgccctcttattttttccttctttgatgttcaaaaatttacatcatttcctgtaatttttttttctgtaaagttttggcagacacagagtcaccactattcattttacaaaaatacatttatgcttaatttaaagaaataggcagggagaggggtgctctggttcttgttttctggcagatacttaagaaaattggaagaaatcactttgaaagatcaatgagacttcaataaagtaaatttaagaaaaaaaaaaaagagttaaggaatgaagtaaaacttgctagggttaaaatcccagctagtccattccttacctttcttacctgaaaaatgaaagtggggatcgtccttacctcatgttgttgtgagtactacgtgatgtaacacacagagaatgcttaacagagttctcagtgtagagtaagctaacaaagttgacagctgttggcctcatgacatcatagaaaatgtgcctaacctaaagtcagaatccctaattttaagccccgcttttacttcccggatattcatcctttattggttacttttaacctcctgttgcttcagttttctaaatctgtaaaagggaatgtaatactgacattatagataattccatggcaatcaaatcatggaaaatatgtagaagttcttggcacagaatagcagctctgtaaatattagtcgaatctgacttgtaacattaccaggacccaacatttatgtcaagaaggcatttttcacactgcacaaatggggctccttatattctagaaaataaatatcatgaaagtcacaacataaatgtcctctcacttcttatcccttaattcagagctattcaacaaagtcaattttgggaaaatgttgcaaacatctgatatttaccaggaattaggggagaaacagtggatactaccatggttcctgcttttaaggagctcatagtctaagagtggagtcagataagtcaacaagattacaaaataaatgccagaagaggaaaaagtgggagacgccaaggaggcaaggagggacaccaagcccagccacaataagagtgggaatgtcagagcaggtgacacagtgaggttgctttagcttcatgtgacagatatctctaactcagactgatctaaacttcagtgagaaaataaatttcatcaaactgggaggtcagaggaagggcagacttccaggtgcagtcactacagttgctcaaaaatctcatcaaggtattcggttcttttcatgtctctgatctatcatggctgctgtcatttccagtccaacagtagctctgtttcagtatcatgatggctccagcaattgcccacatgatggcatcagagagacaaggggcatctcttttatctgtcatctttgggaggagaaggaaggaaaagagaatttcctatgttcttttcagcatgggccagtgttggggccaagggaaagcttccccttcaccttccgaaggttcaccttctgccctctgaaaaagaactaatgttaggaagatgaataggagaaaaggcacacaaatttatttaatgtgtattagcctagaaaatcaaaggaggatgatcacgcaataacccagtaggtccagatgcttatacaactttcttcattggggaatgagagattgagtcaatgtgtctgtcaatttgaaggggagtaaataacttttagggggaatgaataagcccagtgctgagacaatggttagtaaataatgttctctttgggaattgaacaggattggagacaaagtttgtctgggctgtaggtgtgatgtttaatttccaggctctttgtcataataggagttttaatcttctggttaatgaagttacagggagggggttgaaggccatttgttccttttgctgggtatggtttgtaggtagataaggaaacttcaacgaacagccttatcctgtgctttgggagtgaaaggtgattgaaagatgaaggaatagggggaaggtcagagaaaccttgaggctactgcttcagtttagcatatctcaaagagccatattttggagtgttgtgttctgatccccaataccagaattaaatcatctacccacccttaaactacaccttggcaagggcacaggattctcatgacaggcttagtggggcatcttgggtgacaggtgcattgaggggttgacctccacaatgaccagggaaggttttcccaggggatctcagactttgcctatctgataggatgaattgggctttttctagtctctatgtgttagaggtagacagagaaacatcccagggtgtgcaatggtattgagcataaaatattttaattattcatggaattccaagtacttttatttgactagactatgggggtagcgcagagtccaaactagtaataggagataaggctggagaggtaggtgagggctggattatgaagactcttaccagccataagaaatgtgggttttatcccacagaaactgggaacacgctgaaatatttgaagctgagaagtacatgaaattggatgtgtcagttccatcttgaaccatccactaaatggaaaggggagtgaggcaagattggaatcttgggaaaaaagactgtgttggtaattttagaaggagtctgaatgggaccatatagctggttaagtgggtgggttggggaatgagaaggagctcaaggtgattattctgtttttttttctgggattttcaagcttccctagaagtctacataaaaatagatatgggaaaatcagaatctaagagctggctactcagatttgatgtagttaatacagaatgactatcaaataatagatatttgtcctcgatacatatgggatcttggccagctggataaataaatgagtattgttttaataaatgcccattggaacaggttctttactgaaaggaggaataatgataatattgtgttgtacgagagagtgtggatgagatatttataagcaaggcattcagcaggtgtcctgtgggttaatagtctgggagtaaattcatgttcatgtcatgtaataaccttggtgaagctgctagtaagagtgaattaggcttcagtagcaaactctctccctctctcccccacctttcctctctctgtctctctcccgtatgtgtgtgtgtagtgtgtagtttattaagtctttaagtattttattcatagcagaactttcccacttttcatattttacaaaggagcattttatttaagctccaagtatgtgtaattgcaatgagccatatacgcattccccacagaccgggaagctttgccacctaaaacagaatgctctcaatgtaagcccaggtgagagttctaaggggctgtcctggggggactctcctgctctgaagggggccatcctggtctaggggagctgtcctggtttgggagttggtggggctctccttgtctgagagctgactcatttgtaggcatcctcatttcagtgtcagaaggactgtcctgctgttgatgacttcactttacttaagcatggttcaatcagaagcaggggagtgaggaaattccttaacatatttatcaacatctgtttctaggcatccagctatgtacaggaaggaactgttgaccacagaaagcatcctgcttgggcatttctgtgcaatgtctctttgctggaaggaccatttttaatctacccgtgtagccagtatgtcctgaggtttccattctaatcccaaaatatgtatatgtcatggcacttttggagggttttgtctttctttgtacagcgttgcggtattatcataagaaaagtctagaagttgcaattatatcttccaagttggcatcccagttcttccacgtagcagctataaccttgatgcagtggaatacaggcgacatggcatgtgacttggagccagatgggagtttgtatcttagtgctgccaattaatagccatgtgatcccgggggcaaatgatgttccattttctttcatctgtacaatgggattaatactacttaccttaggatgttggtgaacagatattatactgtaaagctacctagtaggaggccaaacgcataatagatactcaataaattgtagctgtcgcaattattgacctcctggactctgtgtcctaatctacaacataggaataatgacagtgcctaacttgcaggtttggtgtgaacaatacagtgatcattctaatctagaacagggtttctcaatctcattcttggcactattttcatttgaggctgccctgtgcactacagaatattcagcagcatccctttactgcaccccctagatgggtgtagatacctgtagcattctgcagcccaggttgtaataaccaaaaatgtctcccgacattgccaaatattccctggctggggaaggtggggagctaacgttgtcactggttgagaactactgttccaacatatagaagaaagtattctataaacaagggtaggtaccgtatctgtgctatggtttggaggtggtttgttctggttcccaccaaggcttatgtagaaattggatccccagtgtgggggtgtcgggagcggggaggctagcaggaggtgtttggcttataggggcagatgtctcacaaatgctgttctggagtttgagtgagttcttgcttttgagagcccagattcattcttgtggggatggattaactcccctgaaaggaggctgttataaagcaggatgccccttgggtttcattcccttggcatgtgcccacttcccctttgactttctctaccttgttgtgacagctcaaaagtcctccctagaagtcagcgccgaatccttgaacttctcagcctgcaaacctgagctaaattataataattctgtaattattcatggaattccaagtacttttatttgactagactataggggtagcacagagtccaaactagtgataggagattaggctggaggggtaggtgagggctggattatgaggactcttgcaagccatgataagaaatgtgggttgtatcccacagaaactgggaacccaccaaaatatttgaagctgggaagcacatgaaattggaaattagactcttctttggaaattacccagtctcaggtatacttatagcaacacgaaatgggctaagacaatcagacctatccgtaaagttgtggaaagaaatgcagacaggaaaaagaaaatcatgtttgtttcctgagcctctagatagtaatgcatacatgagaatagtggaacaaattaaacctctttcggcatgaataagctcttcaaagttcagctccacatataagctacagttgggtggggctgtcaattttcaggaaaaacttgtggtaacaacacagggtttgcagtcacttctgctataagccatggtgtcctgggaatgtaagtggtaacgcctgttccctacccccgtggctgaggaacaccagccctgccctattcctctgtgggtgattgtggcgataattctagttccctggaaagcacacatctgagattcagcatgatgtatcttatccccagcacgattattttccccctcattttttcttaagcccttctcctgggaagataaaggtcaacttaaacctgagctccaggcagtgctacctcacttcctcttcactgatcaaatcttaaagcaacaggaatgttccagaattcctctaagtgaattgcacttgtctgtagttgtgtgggcagttctgaagtagctctcacctcacattttaaggcaattttactaataggagcaccaaatccttcagggccaggaaagctctatttaaccatgaatttcctcccttggggtttcgttatgtttggttacaaagtaaaataaacccacactgcttcagagtctggagaggcacaggggcatgatttagctatgttaataatagaaattgaaaagtattttaaaagataacacaccacctgtgccttcttttgattgtgagactaaatgaagaagaaattttttccccggaaatgttactgctctgaacagcattttagcactattatcccatgataacatcagagcgggggagtaattatttgccggtaatatgcgtgctgccgttagctgaatatggcagcacttccatgctgagatctatgaagtatagattatacatttccatgctcattcaaaatatgtattttttatgattgatgaggacattgcagcatgccaccttcataatttgcatttttaaatggttctgtgtgtaaatcattggcgtgtattacctcaatcagaagccaaataactaattgtaaaagctctaaaatatgcttttcttaaatatgttgtgcgggaatcagagataaatataccttaacacatttttatatttcattactattcaatatattttttttgttgttctaacaaagaaaacctccagcttttataataccattaccgtcaaattaaagactagccttcatctttccaaacatatattttgtgctttgctcaaagccaggaatgacctggctcatgaaggggttcattagcaagatgcttgaaggaaaggaaaaatttgctagttgatcgagaaaatataaatgatgaggctaaactcatatttgagatgttctagattttcctggtgagatttcaaggtccaacacaggattctaatattctcagaagatctcctacatgaattccttcaaacttgagaattacatttactctccacacaaagggagtaggaatttttcagtataaggcaaatggcaacaaaaacacactagagattacaaagccaacgtcactattatttttaaaaggctttatgaaaacattagtgctgagcctgggtgatttatggcacagatccatggaaagaacctttcctaagcccacatttcagctagggctttgcctgggagaaaaaaggaagcccttgcttctggaaggctcccctcaccgccgtctccatatgtgggaagttcagagctgaggtaaaatgaggaaggagaatcaagaccctggaaacatatgcccaagagggagcctgagaatctttgcagaagttgaagttgaaacagaagtttactaagatgctgaaacttaaagaatgaaaaccatcaactagaagagagtaggggattcgggaagcctccaaagaattcacaagaacattcagatgaagggaaagagggcaccaggtcacactgggttggttgccgagggaaatccctccccttgtgtcctaaatcattcccttgtcaccttgttatgcctcagtcctcagaaccactccttactgtggcttggtgcttgtccctccatatcgtaactctgttttatattcttttgactttcctgtttcttctgcatgtacatgagcctcattagcattgagcttgtgtctgttttgtttgcagcgttataccgagtgcttgcctaccagtgggctccaaagggatttttgcaatgactaaggtggaaattgaatttgggagtactgggatctttgggaaaagatctatatcgaagtcagatttatatggtgagagcactgtcttcagcagatgtcctttgagggtccaggtcagtctctggaggcactcccctctctcccttcttttttttttgagacagaatcttactctgtcacccaggctggagtgcagtggcatgatctcggctcactgcaaccttctgcctcccagcttccagcaattctcctgcctcagcctcctgaggaggtgggattacaggcgagtgccgccacgcccagctcatttttgtatttttagtgaagatggggtttcaccatgttggtcaggctgatctcgaactcctgacctcgtgatccacccaccttggcctccccaagtgctgggattacaggcgtgagccgccacgcccagccccctccttctgaaacttggaatgtcctgttgcaatccttagagcacctgtactcagggtatggaagcactcatgaggacatgagcctcagccttctggaaaagaggacttttcgcttgctataactcccatgggattttttttttttttaactttgtctttgtggacttcagaagtccttccagacaaatggctgctttatttgtgaggtagtgatttatatccctggcagaataatcctgggtgaaagtggctctccctcagcataaaggaatagcaaaacatttatgaaagggagacagagcttcagatgagtgggtacaaaagttccgcacaatatcaatggttgaaagaatatgcatatattaattaataattccgacatacttcttttataaggtcccttatgaaagatagactattttccacatttactgtgcattggaagtgacagatgaaattaatatgcttcataaattgccatcacagagggtcaattaacaagtgaactaaccttgtgaaagtcattttgaaagactagttatgtctgtaatattccctgtcaaattaggtaaaagtgggaaaattagatgcctgtcaaataaatagcagtctaagatacggagtaattgcatttttgataaggtaaattagtttctgtgattgttgcttgagaacagaaaatgagtagtggaaatagtaaagatctgaaaattctgtgtgtgggtacatgtgtgcacatacatacaaatatatgtaacagatgcatatttgtgtggatgtacacacatacgtacagagaggcagagaggagaacactgaagattcaaattggaagtaagacaggtccacactccttagctaaaccatcacctcctcttccaccaaggctattgccttttaggtccttcacacgtacctggccagctcccacctttctgcctttgctcacttggcttcctttttagttatgtctgcctctacttcattccatcaaaatgaaccctggtgcttgtacaatgggttggacagtgtttgggccatgcatggaccagcacaatagtgtctgctgccctagagctaaaattccctccaggagagaacaataacctaggaccctgaagctgagattcttgcaggtgacttgcttctgcctgcaaaaggactagagaaaggaaccctcctaacaaacccaactgagccagtttggaggctgaaggaattaatgtagcagtcagatcacatggctgttttcacccaatccacctgacaggaagttccagaaagaccacacaacacacacaaagtactcccacataaaggttatcctcttccaggacagatgtggtgggagcctccccacttccttcctgatgtaaaagttccatatggagttttactgctctcctgctcctctgacgtctcggttctgttcttcaaaactctgccatgtctgtgatgaaattaaatccctgactgggtctcaagttcctacttgtcatatgaatcagtagagcttaaaattcatctgaagtcttggttgtctgtccccattcctccatgacctcctttggggcttggagcaagtcaacttcttatcaggatgtgtgtcccggtgtgtgaaaggaggctgctttgcagcaaggagattgttaaaaaaaaaaaattaaaaagtaaaagtcgttatatttttgtgtataccagagcccagctacacatatgtaatgtagagaaaatactttctctccaatcctttttcttcctctgagttttctccttataccttttaattgtcagcgaattcccaaaggcatatgtactgaatctgcatgtggattttgtatatacatatatattcacaaatgcatatgctatgatttgtgattcccattttacagagtttaaaactgagtctcagtgaggggaagtaaactgcatgcagttcatgcagttactaacaacgtgccttgttgttctgtacatagcataggaggttgaacccaattagtctgactcaaggcttgtactctctatgatatccagaacgctcttttcttcaaagccaattttattccagcttggacaaattctacgcatcttcctaataaaagaagaaccttgccaggtgcagtggctcacgcctgtaatcccagcactttgggaggccaaggcgggtggatcacctgaggttaggatttcgagaccaacctgaccaaaatggagaaaccccgtctctactgaaaatacaaaattagccaggcgtggtggtgcatgcctgtaatcccagctctcgggaggctgcggcaggagaatcacttgaacccgggaggcggaagttgcagtgagctgagattgtgcattgcactccagcctgggcaataaaactccatctcaaaaaaaaaaaaaaaaaaaagaatcttgggagacagtgtgcctccacttttttgtctattggttgtattacaagttctttttcattttctgcccttgattgcacaatctccttctctccctggtctgcccagtgcagacagatacagatgagccggctcagtctgtgtccatacagatgcggaccagctcacagtactgctcttatgtgagctgctcagagttctgtgattgaaggacagggaaaaactgccaactaaagcaatagaatcattggatggacactggccatattttgcaaatctaaaagctgacagctgggtctcagaaaggacaggagcaagttcagttctggggatcccagcgagcatactgtctcttaggcagaaccaatggaataagtcctctccaaccaccttcaattcatgtgccctttgtttcttggttcctgttgccaggagagagcttctgattggcttaggttgtatcataaggccacccttcttgggcaggtttggaggaaacaacactgtgactgacacccctgccaggtctacagggaaacacagagaggtaatggccaaagataagcagaatgctgctgatgttagaagagggacaggaaagctagcaagtcacaatctataggcatctcccacaccatgtaattacataaaataaaaccacaaaagctcaatcacttgtctcttgcctccaaacctaaattgcaaatctccatgcaaaagtcagcaaaaataaaggcagcagcttgtgagtgtggggaaggccaggagaatttgacctcagaaaatctgcacttaaatcccagtcctggcaccatagctgtgttgccttggtattagatacaccattccaaagcccgctgtaaagcataagttttcccagtgcttgcagggagtcactagaaggatcacatgagatgcagcttctacaagtgcatggggaatcagcacccactcagctgaatctgctgtagaaaggattggcatcagggttgcagatagcaagtgaagctcatgcacatgctcatgagtttgcaaactgttttaaacacttgtaaaaatctctcctgagccatttatttaagtagagctgggaacattgaataaatgacagccctttcttaagggggagtctttgaattctgagtgactggcagatttcacagccattgatattttgaaaggtgcattggtgacttgaaatccttgagagcagttatctttgaaattgtggattctgcaaatgtagatattgatatccaactcaatatatgcagctttctctatataccattcagcatatgttagccatctgtcataagcatcatgcccctaaactttcagctatccagaaatctaacaactgccttttcagtaaggttactctgtgctaataattgaataaagcaatataagattcagccaaatagagtgtgtctgccatttttagaggttctcaacccaaagttgaagggccccaggccatggtagatttttaaaagaaattttgacatgggcagtgccaataaatgactctcaagaacccttaccattgtaaaaaaaaaaaaaaaaaaaaaaagggaggtccttggtattaccaatttaaaatgtgagcattctagagggacaaaacctataatgaattacaattgccttttttcccattattttagttaatgttgttaaacaatagtgtctggaattggctaaggaagaacagttacttgaaatatgtgctgttttgaataaactgatcctgtcttaatgagcttttatagggttttatgcatgacttactacccatattacattgctaaggtaacctacttaaaactgtggtgcaatatgatgtttttcagttcatttgtctgtttcattaatgatggaatgtattttccagcacacaaatcctatttatgatcaagacattgttgttctgtatatcaacttaaactcttacactgtgtaatttacctgctgtcaaatctcatttgaagagctgttgtctagcattgctctaatcaaaaatatgccccactgtaatgagctatgcatgttgtgtctagtattatttatttttaataaactttattcactcccaacacactttgggaaacggacaatctataatatcttctctcttcttcttcttttttaaccaactatctttccagctagggtgatgattcacaaaaatgtgatttttttttctttcaaatgtgtcttaatgggtaacagctgattagataaatgtacaggagaaatataaaaataatttggtatttaaaacaagactaatcattaataagacaagcagttttctaaactaaaatggctagaataatatgtgaaattagacttccaggacagagcaccctctgtgatttgaggagcccagctcattcattaaatatgatcaatatgcctcatcatggaaagactattccctgagatggcatgtcagtgtgttaaaaaaaaatacggtatttttttcatctacactctgtaaagacaagcccacaacttcatatggggctcagctgaaggtcagccatctcttccaacacaagaaaagaaaatggcggtgttggacttaatgagacatgattctgtactatacttaataggcgattttactgatttcatgggtacatcatgctgtagttttctctttacatgttgactttacattccaaattccacattaggtgcaacttcattctaagagctttgggatgcttgtatgtgaaacaggttttatgcacagctcttttccaacctattcttctttagtcagtggttcctgtgggttcttgggcctttgccttcctgtcttcagcctcttctctgagcagtgtgatatagccttgaaaagacttgggaggtgggcagaacggagtttgaatcctggctccaccctgtgtgactttggacaaggcacttatattcaactacaaaagggtcacccatgctgacgttacaaagtgatagtgaggaataacagagttacagaatgcagaagaacaaccagcacaatagtagcctgtctgtgtatgatgcttataattgtgatcatcatttatcctaagctcatatgtggaagcccacataagtatggcgtcttaccagtaaactccgctgaatccgaggaagggccttaggccttctggcaaggtaacattcagagtgctgagaatgctgctgcaagtggaatttacttatcagaaggtcagttaattccactaaactctgatgtcatatctagcttgtacaggaggcaaacaaacaaatgctaaacagtagtgcagaaccttggagttaactgtgtgcacatttaaacctcacctccaaccccactgtgtgtacagtaattatttccagtgaaatcactgctttctttccgtgaatgactaactggtgatgatattgtctggtatgatagtaactgcataagacctataggcacatagttcatcaccaatttgtgctttgtgcaatatttgcttcgggggaaaaataaaagaatcaccaaatatgttacaaactctggatttaaaaaaaaaaaacagctctaagaaaatttttaatttttttagtgtgttctcgctatcttggagttatttctagtcatcgggatcttgcatgatttaaacaaggcccttaggtgaccatcaatttatatctaaattattagtgtgcttgttatagtgggtgaatgttctttcagttcatttgctcattcaccaccaggattctacaccaggaactatgctaggttctagtgttatagggaggttaatatatgggagtatatattgaaacacattgtattagttgattttcacactgctctgagaaatatccaaataacccaaattactgggtaatttataaaggaaagaggtttaattgactcacagttctgcagggcttaggaggcctcaggaagcttacaatcatggtggaaggggaaggaaacacgtccttcacatggtggcaggagagagaagtgcagagagaaaaggggaagagcccctgataaagccatcagatctcatgagaactcactgactatcacaagaagagcatgggggaaccacccccatgatctgatcacctcccacgaggtccctccccaaacacgtggggattacaattcggatttcaattcaaggtgagatttaggtgtgtgacacagaggcagaccatatcacacatacacacacatactgaataattgctaccgtaattgatacactggcctagtggagggggaatctagtttgaactatttcatatgtgtcacgagcctggatttccagcatcataaactgggagaaacggggagcgatgcaaaagacagtcagtgctaccgctagagctggagatcagcatggtgggggatgctggctcctaaagcagaagtggggcaaatgtagggtagttggatgcagtcacagatgtgctagggaatgtggtctagggagcacagtagtgagtgctgctgagggtggtaaggggttaatgctgcaggagagaggtgagatgcgtcacaggcagctcattatctgatgcagtctatgcagagtttaatgttagaaataccagctgcgagtgcccacactctgcatggcattctgtaatgcatttgattttactcctcacagctaaggtattagttgggttacttttgctgtaaaacaaacaacttcaaaatcacactggcctaaaacaacagatatttatgcttgtcttccacatgtatgttgatcagctgagcttcatctgggctgggctgggctgggctgggctccaggctgatctgggttctggtggattccacggcttcgcctttcttcttgaacaagcggctacccatctatgagaacatagcagaggggttcctaacctgggctttgatggccccctgggattatttggcaatgtctgcagacatttctggttatcacaactcaagggaagatgttgctattggtatcccatggatgaaaatcagggttgctgtgaaacatcctacaatgcccagaaaagtcacccaccattaattatctggtcccaaatgtcagcagtgctaagactgagaaacccaaaagcccaaggcaaacttctataaacttatcactcatcctgaactcgagtctggaagcccacataaggtaggcatggcatcttaccagcaagttctgttgaaagcctttgctggtgtcacatctgcttgaatgtgatacaagcaaagactttgaatgtggaacttaccagcaagctccaaggtcaaagcctatgcttgtgttacatctgcttgaatttcatcaaccaaagcaaatcatagggccacatctaaagtctttctggttgggctttccatcctggaatccacgtttgctgggggcacttcaagctacatggcagtgagcgccagtcaagtgctgcaagtaagaatccagtactttgggaggccaaggcaggtggatcacctgaggtcaggagtttgagaccagcctgaccaacatggtgaaaccccatctctgctaaaaatacaaaattagccaagcatggtggcatgcacctgtaatcccagatacttgggaggctgaggcaggagaatcgcttgaacccgggaggcggaggttgcagtgagccaagactgcaccattgcactccagcctcagtgacaaagcgagactctgtctcaagaaaaaaaaaaaaaggaatccagtctgccacatcaatgctccccactcccaagtggggaaactgaggatcacaaatacgaagtaatctgctgaaagtcacccagcttttaagcaacagggcggggactagcacccaagttttacttcacatccttctcaggtggactgcactgcttctgcttagatttggcttgtagagtttagccaaaggaaaaaccactggaggaagctgtagtcagcctcagttttccctctgtgaagtaggggtaataatgatacctatcccatagagtaactagaaagattgaaaagatccagtatttgtaacacagtgtctaaaacatactgagcatttaataagcttaagctgctgctgcttttgccattgagaaaagacaagattatgtagggctcatttccagtaaggaaggtcttactgtgttttcctgagtgtgggttgtctagggaaattgggcccctttctcttttctttaaacttttaaatctaatcactccattttcttgtgtctttttggtgaactctagtatttggaggctttctggccttcagctattaattaaagtcatttctactgttaaaactgaattatctgtttttcttcttctaaaagcaatgaaccagggattcacacagactttaggcaatcataatcttctaaggtttgatttgaatgaaagatcccacatgaaacctgattctgtctgctacacgtaagctgttgctttcattctgttactcaaaattggcctaggacatctagaaaggaatctctgtggcacgttgatgcctacttagtggcagttcgtggctttaatgagtctgttacacagtgcaccttcctcctgtggcctacggaaatcgaaggagggatttgcttggtgggttccagtatgtatttctgagtctcagaaggtctgccaggaacaaatggcgaggcactggtattcggataaaagcagttttctctcttagtgaccagacaatggtgctgtctttcttttgaagtcactgctgggattttatgggcatagttgatcgaatcctgtgctagatgctagaaaatcagagatagggaagaccttgtccctacctctggagagctcacaggagtaaaaaacaaaaaaagcaaaaatataataataataattcaatcattattcattaagaaatctatgaaaatatatattatacaaaatatatatataacatatatatacatagacacgcagtaaaatagatgcacctgcaagtgaagcttaggcatgggttgaaggatgagtaaaagttctttgggcaaacatcttacaaagtaatattcttttcttgctgcttgttgtctcttatagaactataatttagaaagatattttgtattgtgatgctcatgtttacctactaatgtaataatttctgttgtcttttaaaaatattggcatgtttggatatcaaatatttgacctctaggattctctttggcattccttccgaaggcgtttattcctcggtgtttctctgccagcaaaggtagcattccggttttcctgtttgagatgcagacacctagatgtcatcaaagccagagacggaaagcagctgcagctatatccagtgagctggtttcttttttgccaacctaagaaggctttgttgttgttgtttctaggcatgtgaaaaacaggccgaattgaatatcggagaacagtaaatcacgactttacgatttacttcttggagagaaaaatatgaaatattgaaatcctcaatatttttcatttagaacaaggagaataagttttaaattactaaacaaaactagtgataaaggagtgtagcgagtttcataaaacatcatgtcatctatgcaaagttgtgacaggaacggagaaggaaaaaaatatgctgggtgaggaagacaggtgacaagaaaggagttgtgaatggcatgaagaatgagaacacagggaaagcttgaatgggctctaagtgaataatcaggtcatagctaaatttcaggggataagtgaacagctcactgtttcagttcttcacctgctcgttcaaaattttcaaaagcccaacgtaaatgaaatgattaatacagcccacagacagtagacgttaggcatcatggaaaaacgaggttctaagtaattctaggattattctgcagcacgtgacacaggtggtcacacctcagttagacttggactgtcttggactgcccgtttgtttatgagacagggtctcattctgtcactcaggctggagtgcagtgtcatgatcatggctcactgcagcctcgacctctcaggctcaagtgatccttgcatctcaacctcacgagtagctacgactacaggtatgccccactatgcctggataattgttccttttttttttttggtagaaacagggtctcattctgttgcccaggctagtctcaaactgctggactcaagtgatccttccaactcggcctcccaaagtgctgggattacagatgtgagtcacaatgcccagcatggattgtccttttcagacccagaccaaagaacaggacttattgtcccaagaccaatctaggaaaagtataagctgtgttgtcacccaggcattgctagaaagtggtaggctggacacaggatgaaacagttgcctgattttaaagtaagagaaatagatcaaaacaaatgacagaaatcagataatcgtctaaaaatgtttattacctatgagagtgttttcttgctcacctcaattagagcaaacaaccactatttctacaagaacagatttttcccccattaaaatattctgaagataattttgttcagatcatcagtgctgcaagtcaaaaaaggaggaaatcgggctgcttgtgaaattctcttgtcattagttccggttgcttattagagtgtgtagaccaagcgcaaggaatgagaaaaagcacacatcaccgtcagccaacaatcagccacaaagtggagcccattagatctctggcttaggctacgagagttggaagttaccgaacagattttagggatggaagaatttaggaactgctgtggaataaacctgagaagaagaaaagaatcccaagaccaaaatcttagtctgaatgtgaagtctttggaaaatgctaagtaatgacaaatatctaaaggaaactgagaccatgtgatgctaccaggtgatagtttaatgagaactgaaggttaatgaaacatttcatagagttcattgatgaagtatggaatacaaatagaaggagattgaaattaagggggccttcctgatgtctcactattttgaaaactagtttgtgctaagactgagctggcagacacagacatcaatctcttgtgaaacaattgtctattattaacgtgctaattcaggtcagatggcctggaattagtgtctcaagttgatttccttttacaccacttcctttgcagagctggacagaaagctcgtggcaatgtgtactttaatggaattaattagtatcacagcaagttgatcaacttggaggcacgtcactcacccttcattggcatcggaattatttaagttggcgcggcctctatgttaactacacagttatttttcatgcaaaatgctatggcattaaagacaacgactaggctgtcatacctcctcatttttttttctggaaaatatggaaatctggaatttttttttttttttttttttgagacggagtctcactctgtcgcctaggctggagtgcagtggcgcaatcttggctcactgccagctccacatcctgggttcacaacattctcctgcctcagcctcctgagtagctgggactacaggcgcctgccaccatgcccagctaattttttgtatttttagtagagacagggtttcatcgtgttagccaggatggtctcgatctcctgacctcgtaatctgcctgcctcagcctcccaaagtgctgggattacaggcgtgagctctgcgccgggccagaaatctggaattttgttaaacacttctgtcttaaggtgtcagcagacaagtttttaaacatgtgaggacaaattctgtgtgactatcttggggccagattcagtccatggagcactggtaggtgggagcctggttcagagccagagtgagatggtgagaaggagccacagaggtagctgtgcaaggccactggagacagcagggacttcagcagggctggctgcagactggaagtcacttaataaaaataactagcttaaggaaaacaaggggctgttactaggaagcccagagccctgggatcgttgaggggggtcaggagcacaaagaggagggaaactgaggcctccagctacagacacattatgtcgatgagattagagcctttggtgttgccggctggtgtctctctggagcagcacttgctaccctccaaggaagtggaaatgatttgcgaggcagagcgtgtgcaccctgcagtgagaccattgcttcagtggttatggagcagccagagaacataaatgaactgctagctttaggggatattactgtggtcttatttctccaaaactaaaacgaaaagttctagtgcactcactcggtgatgattcatttgttcattgattcatttctttcatttgtcattcaaccaacaaattaatgagcacctcatatacactagacactggggagacagagacaaagccatttttacacccaaataattgaggttcttatgggggggtgcagcagtatatacctgcacacagtgtcccacgggccatcatagaggtctctgcagtgagcagggggtgcccagatgaaggatgaactctgggactgtcaagaaacctggcagaaaaggcaacatctagacgttcttttactaatgtattcaggtttaaagattcatccggtctatgactctacagtcattataatgtcaggaccatctcctactttctcagtacctacaggttataattaatcattggtgttcacaacaatgattccaaggccgtcaggaactagaaccaccttctgattttttagagaaggatgacactttgttatttaattgatactgagtgtttatcgttgacttttaattctgagaaacctggcatccccatggaacatactactctgaaaagtactttcatacccatttgtttgattggccccctaccctgtagggggccacaggttactcttgctatcgtgcaaatgagcgaatggaggtggtggttagcccacggtcccagaatcaatcagctacacctgtggcagatttaggattagaatgaagacctccctacttctttctttctttctctttcttttttctttctttctttctttctttctttctttctttctttctttctttctttctttctttctttctttccttccttccttctttccatctttcttgttttctttttttcttttttttttaagagggagtttcgctttttttgcccatgctggagtatagtggcacgatcttagttcactgcaagctctgacccgcctcctgggttcaagtgattctcatgcctcagcctcctgattagctgggattacaggtgcctgccaccacatccggctaatttttgtatttttagtataaatacggtttcaccatgtttgccaggctgctctcaaacgcctgacttcaggcgatccacctgcctcagcctcccaaagtgctgggattacaggcatgagctaccgcgcctggccaaagacctctctaccttaaacctctggaaaaaaacaaaaacaaaaataaacaaaaaataaagcaaaacaaacaacaaactagaacattttattttctacctgtctgaataagcagttttcttcaccactattccatacaaaaagtgaccaccatagtacaggccatcacactctccctgcacccctctagtagattcttcactagcccatacagtttcctcttgttcctctttagtacattctttctacatgtttcagaaggatcttcgaaaattcaaatctgagatagttatttcctcaccatcctcccttacctcttgaccccttagaggttttaaacagccttattaagatataattcacacaccacacaattcacccattgaaagtgtacaattcattggtttttagtatattcccagtcatgcaaccatcatcacaggtttatttcttcttcttctttttttttttttttgaggtggagtctcactctgttacccaagccggagtgcaatggcacaatcttgggtcactgcaacctccacctcccaggttcaagtagttccttgcctcagcctcctgagtatctgcgatgacaggcacctgccaccatgcccaactaatttttgtgttttcaatagagacagggtttcaccatcatggtcaggctggtcttgaactcctgacctcgtgatgcacccgcctcggccttgcaaagtgctgggattacaggcatgagccactgctcccggcctctgcagtcagttttagaacattgtcttcacctcaaaagaaaccccatcactcttggaagtagcatccaacaccccctctttcctatctctaaacaaccaccagtctacttcttgtctctgtagatgtgtctgttctaaacttttttaatgaaaggaatcatgcaacacttgcccttccatgagtagcttcgttcacttagcaagatgttttccaggttcccccatgttgtagttgatgtcagagcttcatcccattttatagctgagtaatattccactgcgtgaatatatcacgttttgttcattcattcactgatggacagttgggttgtttctaccttttgactattatgaataatactactttaaaatgcgtaagtgttttgtgtgtggggacacatgtttttatttctcttggctatttgtctaggagtggaactgctgcatcatatcatatgctcactctaggctgaactatttgaggaactgccagactattttccagttttaatgctgttacgttgcccttaggaaagagatcaaaatgcttaacattgtttacagggacccatctgatttggccccactcacctcttcaggcccagcccatgtcacctttcccacttctgtcactctacttggtccccctggattttgtgcagtttttcaaaggtatgggcatttgctaaggctgtctccctcctcttccccatgaacttccatcagacagaccttctctgaacagccttcatccgcaatctaaatgggatctcgttattatattcttccatgtttcataagttcttaagtgattcttctttaatcccactaaatcatgactccagatgagtttaagaaatcttaagactattttttaattattacaaaccaaaagtctcacactgaacttgagctacaataggggcaccttatctatctgttgaatgaataaataacaatgagagagggggagggaggaagagaaattagtttaagaggcctcaggttgccacgttgggtttgaaatctagatgaagattgacatttcaccccaaatctttaactacttcttcctttttcactgagtaatatagcatatgggttggaaaacgttttctgtaaaaggccagataacaggtactttaggccttgcgagtcatgcagaccctttctgctgttactcagttctgcttttctagcacgagagaagccgtagacagtagatacatgaatgagcatagctttattttaatactttattcacaaaatcaagcagcagcctcgatgtggcctgttaaccataactcgacgacctctattctagagtattttgatacttgataccttcacgctctctgttttctctccccagaatcccatatttccttccacctttgttctcctagaagattcttctcagggaacaaataccttatttagaaaattttccttgacctgcaaaacagaattaaacacactctatctcatcactgaatgaggcatattcttatgttgctgcatgccttcggctgtgttaaattaattgaatatggactcacttacagaacgaagtccacaatgtcccttcttctcatccagcatcaaatatgtgatatgctcagtaaatgctaaactgaaagagaaaaaaggtgacatgaaccaaatggattatctatacaaagtacgcaggcaagcagatgatagaatcaagactttaaaatagagggaaggagaaataagtcatctgaattgatagcaataccagaacacagtattggggataagcccagtgtcagtgtgcagggtctaggtcttttattcatctttccagaacatgagatttttttcctctttttaaccagaatttttcgccggacaacaacaacaaattactttattcttcctggaaatttcttggtagcaatgcctctgccaacatgtaccatacccatacttcttctatcccatcactatcttctctcttacctggggcatattctttaaggggtagcataaatcattagtatctcaaggattggagaaacatcattgtcctaatgattcactaccatggacaccacacttggtgctttttttttttttttttaacttttgaatgagaatattcctctgaactctatgggagtacaatatttgtttatgtgtgacctacaagaatggcaggactatatagttcaaccgaacaaaattcagaagagaagggagatgactcataaattatcagtgggacttacactttgcctggtagtggcatgcttgctgtgccctttgctgcacaatctaggtggtgggtaggactatatttacactttgtctctgcatggcccgcaaacatgcagaagggatgttatgagcaaaggaacaagtcactaagacactttaattctgggctggccaggacacttaagaaagttggatgacactgtgccaggagagtctagaggtcctataacaaagccaaatgctggctggttgtcatgtgccctgtctgtactcctaagcccagaacctatgcatcagtctgcagtgggggtatctggccaaaggagagaaaatggtgcaatatgtgttaagtccagaagaaactaacagaatgcatctcatccggccacagtcatgtctggctgctgaagacctcttttgtgcacaagtgaaagaaaagatgttgagctagggttgtaagaatggcagagggatttatgtaagaaatatgagtctatttccatgacttgtgtcatttataaaggcagggacagatggaatcacttcagtgagctagaatttgtattaagttctacttgctttattttccttcatttacatatgcttattagtaatacacgtgtgagaacaaaatcatatactatcagtcactgccacacaatgaataatcccatgtaaaatatttttgcacacttttgagagtgacaataacttcactgagcttggtttcttcctttgaaacaggcagacaggcttttgctgaatctttaatgcattgtcttttggctgggttcattcaccttcagggaattctcaaaagacaagcgtcatttctttttgtctattgatctgtcctccagaaaaaagggacttctttataaactcaaagcccttagctaattcattgttcatttgttacatttattgaaaatctactgtttgaaaggcacttgttctattgtgctatggaaacaagacagacaaattcctagtcgttgagagcttaccttctagtaggcattacagaccagaaaaatggctgttcagtaggcctgtagcaataagagccgtgaaaacaaggttgggattaaggatgagtaatgagaaggagttactctttttgatcaagaagtcaaggaaggtttctgttttgaggacagacgtgaatgaaatgagggagcaagtcatgaaaactctttggaaaagaaaaaagtcttataggtgaggaaccagcaaatgcaaagaccccaaaataaaaattaacacctggtggctgggcgcagtggcttacgcctgtaatcccagcactttgggagtccgaagcgggtggatcacgaagtcaggagatcgagaccatcctggctaatacagtgaaaccccgtctctactgaaaatatgaaaaaattagcagggtgtggtggtgggtgcctgtagtcccagctactcaggaggctggggcaggagaatggcgtggacccaggaggcggagcttgcagtgagccgagatggcaccactgcactccagcccaggagacagtattgtcaaaaaaaaaaaaaaagaaaaagaaaaaaaattgagacctcttttgtgcacaagtgaaagaaaagatgttgagctagggttgtaagaatggcagagggatttatataagaaacagaagtccatgcttggaatctcagctgttttctagttctcagaatttatgagtgagattaaaagagaagcttcagagtgaaataaaaattagcttagctatcttgaagaacaccaagaaggaatatgtggctgaactagaatgattttggggagagtgaaatgatcaaagttacatccaaggttcacatcaggaccttgcaggccacagtgagaacttagaagacaattgacataggatgattggaaagcagaatactgaaaggccaatttacgtattcaaagatcgtgtggaaacctgtgtggtgaatagagtgggaggacaagagcagaaagagcaactcagaaacaatttactaagctgggtaagagatggtggcttggctgagaaggtaaccagcagatgatgagagatggtcaggttcaggttgtagtttgaagatatagctgatggaagcagctgatggagtggatgtgtataaggagcattgggcaccctgttagcaggctttaggcttctttgactcaggcattgtaccaacattcacctagtagctgatgttgattcctctctcacaaagacagtatcttagtttgaaatgcttaagaaaaaaaaatgtacctgatccaaggggaaaatggagctccacactagcagggataaaaggaaggtggttctgattatttgtgctgctcatttccatgaaggtcttgttcacagtaagcaagtttgtcaaacctatgcctaggtagtcaaatttccctaaccagggatagtctctactgggccttagcaccttccattcagtaataaaatgaggcatcttgagcttccccgaagcacaaatctctgggccactgtatcagaattatgtgggatgagttaactcacagattccggagaacctactaaatgcttgtggttgaatttcagaaatctgcattcttgcagttttcagatgaatcccatgcaaattaaagggtttcttgttttgttttgttttgtttttgagacagagtccggctctgttgcccaggctggagtgcagtggcacagtctcagctcactgcaacctctgcttgctaggttcaagtgattctcccacctcagcctcctgagtagctgtgactgtaggcacgtgccaccacacatggctaatttttgtattttttttttttttttagtagagatggggtttcgccatgttggcgaggctggtctcgaactcctgacctcaggtgatgtggccacctcgatctcccaaagtgccgggattacaggcgtcaaattaaaggtttttgattgtgatgaaaaacacacataaaatcgatcagcttcatcattttaagtgtatatttcagtagtgttaaattttttcatgctattgtgaaacacatctccggaaccttttcatcttactcatctgaaactctatagctaccctttgccccctttctgtgtccttgagagtcaccattctactttctatttctggaaatttgattactttagagagctcatataagtggaatcacacagtatttgtctttttgtgattggctttatttcagttaatataatgtcttcaaggttcacttatattgtagcatgtatccaaatttcctctgttttaaaaactgaatagtgtttgtattgaatgaatataccacattttgattatccattcatctgctaatggacatttgggttgtttctattttttaaccattgtgaatagtgctgctatggacatgagtacgcaaatatatcttttaagaccctgctttcaaatcttttggatgtatatccagaaatgggatgcaaattaaagatttaaaagcattgccttcaaatagaagagattcttgtagaaaatgaattattatgtatctggactgtggtggtggatacaagaacctgcacatgtaataaaattatgtataactaaatagacacacacatacacatgtaaacacacacacacatgcacacacacaggtgcaagtaaaactaaggaaatctggataccagaattgtataaatgccaatatcctgcttgtgatactgtcctatagttttgtaagatgtttccactggggaaactagaaaaatagcacatagtttctctctgtattatttcttacaactgcacgtgaataaaaaatgatctcaaaacagaaaggttgcccttgaggttagagtgtgccactgcaagaggagacccatctagaagggcaaagaattcttggcattgttccgaaggagaaagtggaacagggatagaggccaacccaaagtgctaagttaactctgggtcccaagggacatggcatccccaaccccagacagtaggaccaatgtagcacagatagggaaatggcagggaatgagagccagaaaaacagaggccaactcagtactgaatccccagagtgtgggcctggagctggtactgaccaccttcctcagattgcactggtcctgggaatggggtggcgtggggtccatgacctcagcccaaatcactcctcatacgaaggttggaacaggggacttggtcacatgagccctatgcttcctcttaattctgaatgagtttcagattcctgcaggcagcatcagcaacatgcaaaagacgcttcttagatgcttgagactgtaaacccttatcaggaacataatgcgatgggatgtttctctctctttaggcaaaatttaaggatactggtggataatatttacttaatgattgctatgtggcaagtgttttgctaaatgctttacaaatatttattttctgtgagatggttcctgttcttccatctcaaagatgaggaaattgagattctgagaaggtgactgagtaccttaaacaatcacacagctgataagggacggacttgggccttaaagtacagtctccctgaatctaaaacccacctttggaatctcagctgttttctagttctcagaatttatgtgtgagattaaaagtgaagcttcagagaagaagcagagagtgataacagcgatggctccaaaaataaagctgaggagaccaagttctgtcaggtgcattgagactctttttataatcccaaaactgtagaactgtaaagactagaaaagccagccacactctgtatggtactataatactgatgatgtcctatgtacttaatgtgtgtttctttctcattaatcatcaatgctgagggatgttgcatgtcttagagtttaacagccacccatagctccccatttgtaataaactctagtcagtgtgtagtcactgcctgaacaagttacaatcttaaaataaaaaccttattgatttcttttttaactttgaaattaacacatgcctagaaaaatctagaaagtatagcaaagcaaagaaaaatcactcaataaaaccactgttaatattttagcataatcttgatagtggaatgcctttattttttaaaaattgcattatgtatacactagttttagtcagaatttgtacttcttaacatgcatactataccattagtatatttttacattctctaaagtgtgtctgcaatgcagtgttgtactttctgcagataccatagtttctttcatcaatcttttataacattgtgttgattgtagttttttctatctttaagcaatattgtaatgagtatacatgttgctacacacatacacacacaaccacacacgcacatatcaggctaaatttctacaagtgaaattttcaaagcttgtgatgggtgttaacaaattgcatttcggaaagattttttcatgtaattgataatatatgagagtttatttcctcataagtctgtcaaacactatgaactttttctaattattgtaacaattttataaattgttacaatatataacatgctataaatatatgtgatgcaaatttttttacagttttctgtttattttcatataatattttagttgttgtaaaacctgcatttcagtagtttaatctgtcagtaattcacgcaataaattagagctctaatggtggcttagaagggccttctcccctgtattacttaaatattcaatgactttattcctcctaatacttaaatccatctggaattcattagactatactttaaatttgtatgtatcaaccctaatttttttaagaacatcatgtttgataaaacacattttaacacttacttaacaaaatgactttaaaactgtaaacttaaaaaaaaggtattgcatttatttctattcctctgaatttcacattaggaaaggaaaaagggcacgtaaaaatacaatccccagtaatttctctctgctggctttgttttctaaagtattatatttcccatctttgcacaaaaatccccttaacccttgtacatatccttaatagatctggcataattccatcatccaagagttatataagttctacttgaaccaattaaaatttttagcctgtgtcacctcttgaggcagaggatattcactaggactttactcaagctgcttacataaaattattttgaatatctgcatagatttcttccacataattaaagttacttcaaaagttaaatgtttaagaatgccctgaaagtctagtgtgattgtgagcgtgcatacacataagaaaaaatgttttcattatgtttgatgaaacaaaaattttaaagtaaaatttcaaattcataaaggaaatactgtacctctaagcagagcaggattttcaaagaacatttgataatagtatcaagatctttaattaataacctaacaagtaggaaacttttatcgcccctttgatcgtttttataaggagatataaacaccacatccagtctgtcaagcgggggataaatgaaggtggaggaatgttacaaagggcttaaaatgtcttttccctgggaactctctaggagttggtccgtaatgacatttaacttgaataagtgaaataaaactaagaaaaatagcttgaaatgcaagttgttggcgtcagagagaaacctggattacggtaatagaaaagcaatttcaaaggaataatggctgacaaataggaattgaatctagtatactgcatccacatttgcaggtttctacataaagatctactgggaatgactgatttccttacggagcgggggtggtcctatggggatgattggcacctctctcagattgcccagcctccccctgctcttctgggagactgtcagggtgctgctctttggactacctttgaaatcttgacctgtgacgaggctgtggctggtagtgatgttgccaggaagatggcattccaaggtcaccatactcccgctaaggtctaacaaagctttgtttagtatttctacttgctgggaatttctgtgtacacatgctcatttatctttttatttatttaacaataaaaccgagagtggtattctaaacaccatatgttgctatggtggaaactaaaacctggaaagctgaagtttcttagtaagagagcatgatcacatgacccattttgcccaggacagctttggtttgcacctgttgtttcggcttcattgttaatggtacctacttttattctaagaagattctggtttggacaataaattatgtggccactgtattaatgtcctatggctgctgtagtaaattaccacacagtgactcaaaacaacacaaatcttatcttgcagttctgtaagctgagaatccaacatgtgtcagggtaaaatcaaggtgtccgcagggctaccttcactcctggaagctcttggggaaaaacccatttccttgccttttctagcttctaaaggccacgcacattcctggcctcatggtacctttctccatcctcaaagccagcaacagctgttcatgtccttcacatatcccatcactctgaccttcgcttcttcctccctcttaacgactcatgattatattgggcctagccagatgccatataattcatgctagtctttctgtctgtctgtctctctctctgtttctctctttcttcctcctttctctctctctccctctctctcccccctctctccctatctccctctctccctttctccctctctctctctctctctctcacacacacacacacacacacacacacacacacagaatctccctctgtcacctaggctagagtgcagttgcacaatcacagctccctgcagcttcaaccttccgggctcaagtgatcctcctacctcaccctcctgagtagctgggagtacaggcatgcaccgccactcctggctagtttaaaaaaaaaaaaatacagagatggcagtctctctacattgctcaggctggtctcaaactcctgggttcaatcattcctcccgccttagccctccaaagtgctgagattacaggcatgagccaccatacctggcccaatctctgttttaaagccagctgatcagcaaccttaattccattggcaaccttaatttgggaggtggagagagtatgagaattgtagaccgaaacttcatgaaaagatttatcagtatgtctttgtttaaggcactaaattttagaaaggatatgtagatagagtactcttacccacacatcgtgatgatctaattggaccatgagtatattttcatctaaatctgcctaccaagcctgtacatatattgataatatattcatatgtaaggactcaggtgtaaaaagtaagggcaatgtaagtgtcacattaataaactgggttaggattaatgttatcatttcctgtcttatcacaacaaacattgtatccatggtggaaaatatcacttaaaaaatcttccaatcacactctaccttgcaagattatctgttataaataaacaatatagtatactgacacaaaaatctttgtgggcttatttccatggaatctctgcagaattttgttttaagctttgaacatctctgtggttcttgagacatactttcagactgccttccaggaagattgtatcaagttgagattccactacggtgatccttgtgtttgtgtcactgtacccttaacaattaccggctcttaacttttctttatctgggggcaaatgctggcatgttatttttcatgtgcatttcaaggttttgtgtgagtcaaacacacacacacacagttcctttgtctgaacttacagtcatgtttagctggagagatggcagtgttaagacttgtacatccctgcttacatgtagtgagcttctgatgatcattttatgtttcttgccctaagggaggagaccatccctcatattgtcttatgcccaatttctgcctccaaagaaggaaaaagtaaaaactaaaaggcagaaatgaaatccgcaagcagacggcccagcgccacaccctgggccttgtagttaaagattgacccctgacctaatccgttatgttatctataggttacagaaattgtatagaaaagcactgtgaaaatccctatcctgttttgttccgatctaattaccggtgcatgcagaccccagtcacgtaccccctgcttgctcaatcgatcacgaccctctcacgtgcacccccttagagttgtgagcccttaaaagggacaggaattgctcacttggggggcttggctcttgagacaggaatcttgccgatgcccccggctgaataaaccccttccttctttaactcggtgtctgaggacttttgtctgcggcttgtcctgttacagccctacagctatattctattactagatatttggggccaggcatggtagctcacacctgtaatctcagcactttgggtgcctgaggtgggtggatcacctgaggtcaggagttcgagacccgcctgaccaatatggtgaaaccccgtctctgctaaaaatacaaaaatttgccaggggtagtggtacatatctgtaatcgcagctactcaggaggctgagacaggagaatcgcttgaacctgggaggcagagattgcagtgaaccaagatcacgccactgtactccagcatgggtgacagagcaagactccatctcaaaaaaaaaaaaaaaaaagaaatttggaatgaaagcaatgagattccttcttgtttgtgacttatagacgggttccaatagaagtttctgaagaggtattccagagataacggcagtggcagcatctacgctaaaaaacattttagtgccccagagaggtaattcggagggaaaatacttattcaggtgagagatatcttatctgtctgcaaaatagaaacggagtcacattgtgttagagatgtaactactgtgtgctttgattctgtgtgatttgaaaacttacatctgaaaatcctgtgcacacacaatccattgatcgaatgttgaactatatcatctcaaaaaagctctgtgtgtgtctgtgttttgctttatttgcatattttgcccaaagaagaatcatcagagttaaagaggtcatcaaactgttttctaaatcatttctcttcggaatgactcacaagtccatggactgtgtgtcatgctttgtttctgattctgttgatctagattttgcatgtgttgcttgggtcatctcatattacaaaaaatattggcttttaagagccagcttctgcattttggccttcacccaagaaaccttgtaacacattttgtttttcatcagtacatccctttgggtaagatctcagtgtcaaattttgtcggactaaattgtgtctttcatggctgaagatgagaggatgactcaaatgaagggcaagctgttaatagttcgccatgaagctgaaggccacgcaggctttgtaatttggttcattatgttcttgcatttttaagggattcttttcaaagcattttacgtacagccaattcctattagtgtggtgaattaattggcttgaagaatcattgttttgcgtactgtgacttgatggttcacatttctactggatacctgctcacccaaccccccacagtatggaaagagagtagaggaacccaggtgctgggatgccaggaagggtggacaacagggccctaaactcaaggctgaaactgctctccaacttagcttcccttctggctcctgtggtttttctttagctccttctccatttcaggagttgagccccttttttcctcccattctcaggactcagaagatcagggctaacaacctagtgcccatctaccatgcccccttgaagtacagaaaatattcaggcggtatcttagtgtctccacctttggataaagtatttttgctttaaacaaattagaggtgatttgcatcctctgtctccctcaccatattattcactgttgtcatttgagaattaaattgacaagcgtatttttttttttttttttttttttttttttgcttttcagaaagtgtgtagtgtcatggaaggaactatgtggtagctaggctgatactataatatttcgcagcctttagtttgtggcaggatgctacataatatacagacgctcattgtgtggtttaatgtgtagcttcatgtgtattaataaaaatatataagaaactcattaagctcctcaattcatggatgattttgccacaaatgaggcaagagtaaaaagtagcaatcaatgtaaagcaaagctactaagtaaatagcttagtaaagataatgaaacaaaaaaaatgtaagggagtccatgcaaaaacattcagcaagtgtgagcacagtgaggggaatgtgagtgttacagtcggacctaagtttgagttcaggctgatgacaaatcagctttgacaccatggaccaggtccttaaatttctttgctgcgatgagtatttgttcagattgttttaagccaaatgagacagtgcaaaaaaaggccagacctgtatgggacaccaaatcaatgttagtcctcttctttttaaaaaaaaaaaaaaaaaaacaagtaatcagtttaatgtactctgatattgtttaccactgggattcttcttcatcatttaaggctacagagtccaccagcctagagtccatggagtcagaccaactgtcagctgtaatatgccggagatggagagaaaggacagatggccagagctcaggccaaaactttggattccagtctcttaaagaggcatagcctcttccaaagagggctctctgcagtcaatatcatatcagctacctgtttggcaccaggcattgggtccaggcttcaggatttgctaataaactcccgtcctcatgtggccagacagagaggtagacgtaaattgaattatcacaccaataggtaataacccatgggaagtgttacaaagcaaggaggctgacgccatgggaatgtaagccagggacaccctagctgttctggaggagtaagggaggctcttcttgatatttgggccaagatctgaaggatgaatagcggcagcaaggaagcgtaggtaggaaacccatggttggtaggagggttgtatgtaaaaatacctgcaagaaaggatgtgatgagttggaagaactgaaaaaagatgagtgtaactggataataaggaagaagagggattccttgtaacatgaaatgagtgtgaggaagtgggctgtggccagattacagaaagacttgtcaaagcaaaggtatttgctgtttttcctaagagtgatgagaaaccattgaaaggtatccaatagagggtgacataaatcaataaacattgacaaagacaccctggaagccctatagaaaacagatggtggcaggcagtcatggctgtgcaggaagacccacagggcgccttgcacagtagccctggtgagaagtgacagaagctaatctcaaggagtgttgagggggatggagagaaaaggggacattcaggaagtgaaacaatggatgtgggcaggatatgttgatagagtggctgcggatagaagagaaggtttcatttgaggaagagaatgactcatgagtttctccttccttgatccctgagagaggagccatcctctagacaatatttagagcaaaatgataaacatgcaactgtatttatcatactttctggttgctcaaaaatccttgcctccaatgatgtcaataatattttaattaagttattataaatgtaaaatagttttgccctctctaggaaaggataaagctgggcccctaaaaactggggagtaatatttgacttcagactcagtaccagctttgtatcagacactttcatgtgttattttagttaatctgcaccaagatcctgcaaagtcaccatggtgggctcttattaataacacaaaaaccaggatacggagaggtgcatgctctgctcagggcccggatctggtgtgtcagcaggattcagtatcaggtctcctgaatccaggtccagtgctctttccacagctccttaaagccctccagtcagcctttcacagatgtcccccacctccagcaattctcccctccacctctcccaccagtgcaggtggcatctggatctccctcccatgatcagccaagctttccaccgtgtgagcaggaaaccactagcactagaatctctcaaagtgctggtttaaacataaattcctaaagaatctgattttacccacttccctggatgatccataggcccactgtgataaagctgaatgagttactcctccctgggatatttcatctcaatggaggaaaataattctgttggggtccaaaaatcacaccaaggctaaggcaatacagggccccccaacactcatcaccattctctgtgacctttcccatctctgggacctctccattatactttgttttctgcaatgtttcacttttcaattaataaccaatttccttctacttttgtatttgacagcttctcaaaaagtgatcagacaaaatatgatttttaagcattcagcatgcacagttgaagattagaaggacattggaaaaaattgatgtttatgggaaatgtatgtgtatatttgtatgtgtgtgctatgtctgtggtacatgtacatatgtctgcctacatctgagtgtgtgtgtgtgtgtgtgtgtatgtgcgcatgtgcgtgctgctccagatagacctacaaacatctgtcttcctggcctgtgtacttgggagtggtgaatgagtccaacagccacacagtgaaattcctagcaggtggcaagactcagcctcctgtttggagcttattttattttcctatagctgaacctgggaatacagttcccaaattccacaagacccttggatttccatctccaacccctgtgtctcagtacaacatcactcaaacagtaatgtgcacccgaattctctagaaacaatgttaaaatgggtttcctctgtaggatctagacaggaccgaggagcctgcatttctaaccagctcctgggggatgccaatgctgctggcttggagactgacctttgaatagcaaggtactagaacacacagcacagacattggtcagatgtgtaattgctcggagttcaggctacctactatggaattagttattaaaatcctgcaacattggataactgtttctagctgtcatttgttgagtgcccctctcatctgcctccacagtggactttttttttaatatcacaccttgttattcccatgcaggtcaaccattgaatctaagaatagaaatcctcatgtctgaaggggtggtcttgaagtaggcaatgagggcctgggtggtttccatttcctttgagcaagtatttcattgccttctgccatgcctacctatttgtttttctcacagtaggtttctaccaagtggcatctcacttctaacataaagaacaagcatcagaatgcctccctttgaatgcatatgaggttgttttgtttttagaacccaaacacagccacttgaatctatcatgtaattcaaaggaaacaagcattattccagtcttttcaaactaaggttttgtgtgctttgggtatttcaattaggaagaaagaaggcaggcaagaacgttattgaacatttattctctgatactggaggatgcgctggaattcaagagcctgacttcagaaagtttggcatttgctaactgtgggtctgaccttcgtatgagaacagtgatgaaaactcacgggaatgtcagattttgttacggtatgtgattgggtggataaggctgtatttactaacaacttcctcatgcatatgcatgtgcttaattttcatccacatcattaataagatgattttaaaactggatgaacctctgcataaaacacaaacatttcctattatatattttattcagtctactatgttttcctctgtggggatcaagcatgatatacttctttctcatctctgccttcccagggactcataggaagaaaatgtcttcattcttcacttggtttagattgttctacgcaaaaactcttgtatggacataagccttaacttactccattcggagttgagcagagtcctaattctttgacttgatcttataccattccccactcctaaattagttccaattagttccaagttcatccttacctcagagtctgctattgctattcctgcggtctagaaatcattttccatgtgttttgtatggctatctctttccactttcttgtcattcaagcctcagctgaaacattccctcagcaataaggttttctccaccatttattttgaataggtgtcccctgccacacacacacacacacacacacacacacacacacacacacactttgtcaatcatactctacccagtgatggaaatgttctacatctgtgttgtctaatatggtaactactacctgcatgtggctactgagcactcaaaacgttcctagtttgactggagtactgagttttttcattttaataaatgtaaattgcaatagccatatgtggctagcagctacagtattgggtagtgaagctttcgtattcaaacctgtctcatatccttcatagccctcatctgtgactgaaattatcttgttcatatctttttctcttgtttatcacctgtctttccatgctgggttatcttttctgctaaccactggataccagggtgttcagcgtgatggctgacatgtagtgagtcctcaaataatttttattaaattaactttaagaaaatcccacttaacagcccttcactgtttttagagaccattccaaaggtcttgacttgtgttgatattattgtcctctgaaaagtctgagtcaaactctgattagttttgtaacataaaataccattggattgtctgtttgcataattggttttctgagattcagctccacattctgtattcatcctaatcaatggtgtctccttagtttctgtctttctttccattgtgttaagatggatctgttgtctgcccttcccagtttcagcatatttgaatatttggcaaatgtgaattctgattacctatcctacttgtagcttatgatactggccaagtcttatagaatgtagaatcttaggattcagatccaagatatttgttatctttaggcacagtgtttttttgtttctgttttttttttttttttttttttttggttgagttaaagtcaagtccttggctattttgggaagatgaaaaaccagacctatgttattacataaaattgcctcagagctttattttgattgatttcctttgttagcagtattctcataatagcttaaaaaaaacataaaagtataaaatttcactctctgtgagatctcctttgtgtgcagatattacgaggctctgttcacttcattttttcttattacatgcattattttatctgcaccagaaatcaagtatgtatgtctgtgtgtgaatttgctggtaaaaggatgaagtaatgttaaagaaaaaaatttaaaaattatctacccacacatacctggtttcattttgctcactgccttcaaattctatccatatttgtaggtcatgtatgatgatgctcatgttattttgtgtatttttactcaatattctaagtagatcaataaagtttaaaaattattgtattgtaatatgttgttacacaaacattccttcaactagttcccttccactggatgttcaggcagatgccagtgtaattttattttgagaaataacaatgcagtgaatagttccaaatatgtagtgcaaacttatataggatcaggagtggtataaaaacggaacaaaagtatgagtctttcgtggtttctgttgaattttgccatgcttttgaaaaggattatactggtttacaataccatcaggtggaatgtgactctactgatttataacaagaatgtttgtctttcatttttctaatttgggctcttttttgacaatagtattgataataactgtagcaacaatagcagcagttaatattcttgagacatattatatgatagaccatatttaaatgctttagaaatattgtttatagtggttaaaaaagtgagctctggaggcagacttcccaaggtcaaatctggactccaccatttatcttctctttgctttcattctctcctctgtaaaaagatccaaagggttgttatgacaatcaagtgagataatatagtatagagctaaagtaagcactggataagtgtttgttattattcctaataatgagtgtttttgttaaccccacttacagatgagaaaactgagatccagtgtcttgctcaaggtcacacagataggaaagagttgtactaggattccaaatgcagatgcccttttctgatcaaaatactcctatgcggggaccaacacttatatccaagaggaagtattactcttatcgctgagttaaatcaaggttgaattacgcacagaaaatgtgcgcataaggtccccgtgattcactggaaatgccatgacataattcttcgtttccaagacaaacaaaaaagttgtttttttatgctgccttcttcattgagatctgaaagtagttccctatggaagtgattcatggtgttgtgaaatcctccgaaattgtaaacagcctggtgggcaggaatcccgaggtctcattcaggccccctgcaaattctgagttcctagcctgaggaaagcccccaacaaatactgacctgactttctcctaaaagattgccataaacacttttggttatctcttaatgtacttggttcataactgcttagtcaattatttttattagcataacattccttttaagcataatgatattgggaaaacagaaatgatacaagcgtaatttcttggctatgactgtttatgttttgagtttttttgttttgttttaactttctttgccgatttgatgaattaattgtaaatttcccaagggggatctaaagtgaactgatctttgccttttattctggaatgttcaatttctattctagtcccagtgactatcctctgagaccaaaatttcaatattgccaagggctcataaaattgtcgatataacctactttctctagagaaccttatttgaattttcataatgaattaatatcttctttctcccccaatctctttgctcaaatagctatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggtatgtcacattggcttacctttagcgtaatggcttggaaagaggcacactttgatctttgtggattctagggactgtcttatggctgttccaacttgtcagctcgtatcagcgtcgacttaatacttccctgcgtagaagccaggttggaaagctaaagtgcaaagcttgaccgaggtgttgcaagctacggaaatctctttcattgtctctgaagatcatcctccaaggatgactgccatctaagtctctaaggcatggccgatgttgggcaccatgtaaatatccagcttacctttgtgaaagtccaaggctaaactttgtgctatagcagggctttgatgagaattgggtccccattacaaactcctcagttctttcttttcacagtggccttttaataagaactattttagtaaaataggtaggacttcttcccttcccttagaagatgtgcatgaagaaatcttttgtcttcagtcagaggaccaaaaggaggatgtttgatatctctctctggaaatgcgtaaatgcatgtgcctactgttatagaagtcactcaaggttactatagagctcccgctgtcttttcccatgtttaacctttctatcagggacggttttagaatttagagcttccttttttgccccaatacatacaaattaaagtatcccacagccagcagctgaagtcactcctaagtataatgcttgagaaaatgaaagaataaaacagaaaaattcctcttcggctcactttgattttcagctttaaaatacacttgagtgaaaaaaaacaccatattaagagtatcatattaagagtatcatgatactcctagattatgcccaaataggtaaaatagtgattcgtcagaccagacaggagatgagagcggcttttactatttttcccccttttctgaattgatgggatctatcagtgacatgtagatacatgaggctctggaaatgttgccatggtaaccttcccagacaaccaggtggataattgtatgcaagatgcctaaaacctcccgtcagcttcaaggagctgggtctttatgcactgcatcagatcccccaagggcaagagcgaccctcttccttcccagctttaaatgcgctccgtaaaaatgaaagcaaatgcactgcgtgtgtgctggagggtgtttaggggagtgttggaggcagatggcagaggagcaatgacaggtctggagagaaggagagagggcaggtgaagggaggtcaggtcacttcagggcagacaatccacgtggcccctctctgtgagctgcttttgatggaaagatggcttctggtgagaaacaccctagaatttcggtttgatgtttacagaaatcttcttaaacgagctgatgtgcagaacacatttggagaaccaatgaggaaagcgattaaagaggccaaagtttgagcagaacagaaaaatgattcccaattgctatctgtggtactcgggccccatgagtgagtgactagaattcagatgggctgggaaagtgttctaaatgtaaatgacagtgcttacattcgggatggctgtgagcttgcacatgtctttgtatattatgtgtgtatatgattagacggtgtccaattttcctcccactgtgcctgtccttaaagtttagaaaagaatttcagatacatgtaatattttttgatacatgtatatacatgtaatattttttgaagaaagagttctttttgcacattgaattctttatgcacatgttattttgtgtattttttatgtatgttttttgtgtattttttagatagagttctttatgcacattgaatttcttaaatcacagagttattcagttagagacagttctccagcaaaacataaaccacctcaaatatctatttatgattggtattatcctataaaaatacataaagactcaggtgtctgtatggattcattgttttctttctcagcaccctctgggttggactataaagcacgcagtgaaatagaatcagtcagatttgggatccagaatgtggaaatgttgcaaaagactttcaaacaaaaagccacttagattacttagcaccctgtaagagagttgcaggcaagatggcccccgaagcattcatgaggccagtgggaatctgatgaagaagacggtatcctctttccaacctcttcttcaacttaaatcgtttacaagtaataacaaaccctaactggctataaaaatgatcgtctcttgtatttccattatgctctgctcatctgtggctcataggatcccatgtgttgtagaaattattcgacacccactgggagtaagggtgggggtaggggtggggtttgggtgggggtaggggttggggttgggggctgactctggaaagagttccatgattttccatgctctcacaaataaaagatgggagtcagtgcataacctgccttcaaatcatatgctctttcacctgtcccgctgaattcatggtgaacacagccatcaggtatcatagcactgcgtcgagtacttactgtgtgccagcagccatatatgtacaacatcatttcatccatgatcccacttcctgccctgagaggtggctaccactatccctatcttacagatgagaaaactgaacatcaaagaggctcaggaacttgacaaagttacctggctggggaaaaggcacaatcagtgtctacgtctccagcttcaaaatttggtgaatggttgattacttagctggtaagaggctgccacatctgccttaattctctgcaaattctggccacatctgcactggcatcatgctcaaaagactagtccgggtctgtctacaatagcccgcatttcttcctgggccttgtgtgagctacaagaaacccaagaaccagctgggtggagtggctcaagcctgtaatcccagtactttgggaggctgaggtgtgtggatcttgaggtcaggagttggagaccagcctggacaatgtggtgaaaccccattgctacgaaaaaaacaaaaattagccgggtgcggtggtgggtgcctgtaatcccagctagtcgggaggctgaggcaggagaattgcttgaacccaggaggcggaagttgcagtgagccaagatcacgccactgcactccagcctgggcgacagagaaagactccatctaggaaaaaaatgaaacctaagagccacgtgacccactgggtctgctctcttgtttccatgttttacaccacagactctttgcaggcccagctgggggaagtatttgtgcagttctatcagatgaactgatttagatcctcacagaaaatgactagttcttcggatgaaatagccaggcccattgaatcacctctagggttcaacggtgttaagtgttgaggcctttgtcaccactcatgtcacttttttctgagcctacataaccaaaggcagcttcatggggcacagcctttgtggcctcacacagccaagggaacagaagggtcccatgctcagaagggcctggggcttggtttagcgttctgctgtcaccatgttgaaattcttaataattgttgaacaaggtgtctgcattttcattttacactgagcgtcacaaattatgtggctgttcctgctcacagcattgtagcctagagctgtgtttgacgctgtgctcagctatttaacacggtgtgatattgggcaagttactgaaccttctaggaccctctgcaaatggggatagaatataacagtagctaccttagagaagtatatgtgaggattcagtgagacaacatgcttcacccagtgcttagggaacagtaaatgtacaatgaatgcctttgtattgttaacagtgcaattattatttttattctggaagagtaccctttagcaaaggtaaagcaaagagacacatgagttgtgtgaagacaaattcatcttccagcaaaccacgcgtcattttcatgtccccatgtgttcgaatgccctcggcaccaatctatcacaaaggaaggtcacccatatttatctgtatgtgcagacaggagaccattccggctgctcagcactgaactccggggtattgttttggtgaatcattcctggatgaaggaagatcagcagaacataatggtctttgactttgcagatcgtgagctgttgcttttgcagagccacagacattgatttatgaggcccaagccaaggctctggctgctccttgggggcatacagatctctgtgtgagtttggtgttttctgatggccaagacatggtgttcatgagtagggggtagagggtgagaactcttgaaattcctggagggcactaattccaaggccccatcatgtcttgttggcatcaattcatgggtgttttgccctctggtggtttcctgggcacctttgagaatggctgaccatgaggaatggcatgtcaggctcccacagaagcaggccctgagatgaagattgaggcctgcctgtggtttgcttgagaggtacagggacagataccaggtaaggtgaggtacagaaaaggaagtcagacaacttgaggtgcattattattattattattattattattatcactattgagacggagttttgctcttgttgcccaggctggagtgcaatagtatgatctcagctcactgcaacctgtgcctcctgcattcaagcaattctcctgcctcagcctcccgagtagctgggattacagacacctgccaccacgcccagctaatttttgtatttttagtagagatggggtttcaccacattggccaggctggtcttgaactcctgacctcaggttatccgcccaccttggcctcccaaatgctgggattacaggtgtgagtcactgcacctggcccttgaggtgcattattaaagcagctcccagagtgggtaactgcagctttatcctttttggggagctcaaggaaatgacattaaacacatacgttagagttatctcagctaaggggcaggtagctagaatatctactcccccaagtctgataatgagacataggttcaaagctgtccccaaggatggggggctttaatttccaggcacttgccgccagctgtgcgcaagggaaacctgggatccatcagctccaatatcctgtcctcttgaggcctcggccttccaacaacatcaggagctggctgtaggttgtgttcgctctcctggcttttagccaccccaaatggcagccagggcagctgggagaatggcagccccccaccctggacgggtggggcagctttgagaaagataggtggtgagaggtcacagaaggaaagaattagctcccaaactgcatgactgacaaagatgaatgtggcatttacctaaaggtgcacgttctgtgtcctgaaagatgcacattgcttaggcatgtctgatccttcttcttgaggctgttgaagacaagcagagattagcagttacgtcctcattgtctaacttctgaaagcccagccactttccctccctctctttcctgtcttagtccctttaatttttttttccatccagtatgcttagcaagcatctactctgtgctggcgctattctaagctctgaatgtgcaacactggacctggcaggtgctgcttgttccctcctggtattcatagctgaggagggaggatagcatccaataaatcagaaagaaaattgcggcaagtgctacaacatagttgtatgggaggctcatctcgggaggggccaaacctagtcttgtagtgagataggaggccgctctgaagagatgatgtagggagtttttgtcttttatttttcctccaggatccacctgagttccttttcaagacacagttcctttaatttttaaacacatccagccattccagacataagaaaaagccagccgatcaagtcgcctttgggactaatggctatcctgagagctcagctttgcttggaagttgctattttccaaaacagcttgagctaaataaagatggctgggatagttgatagttgatatttgacacctagctcagccgatggtgttcaggttgttgctatggcctggtagtaaagtcccttttctggttactttttacttgttgcagtaactgtgatgtggcttttcaacccattgactgttaatttttttttgctgatattttcagactttcatgctgtaggttcctccattctcaactgccccaaccaatcctatgtgtttctggaatatcaggcatgtggctatttcttttttttttttttttccttaggtagatatattttttaaaaaataaataaagcaattctgttcttttcaagtgaaagaaaatgcagtcactctccagtgccaccatccagagataaccacagttgacattttagtgagtgcagttctggggttctctcctggcatctctacacagagagatgcaggtgcacagttttacagaatgggagctctatgtgcttttccgtaaatctctctcttcactcctcagggtcctatggacatttttgtaaatcaataaacatcaagcaacatcattgtttcaaacagctagagtctggatctaccatcgtctccttaaccaatttcctatcgatttaagttgttttcacttttctacacttccatcaattctgcagaagagagctcatctcttcccatgtttgtgacaatttctataggatatatttacatgagctggattaatgggatggcggatatgccctgttatgttttgatccctattcaggtgatgcttctaatcagaggattttagtctgtatcttggctaagcttgttcatgcagcaggatacaatagtctttcttttcacacacaaacatactgatggatatttttgtttgtttctccagatgacactcagtatctacaagtttttgtggtcatttcactagctgttttgtagatagtggatggccttgctatggaatccttgctggatattgtggtggaggcagaggaatgcagtggttgagactggcccctttccttaggtcatcactggaattttagtgaagaagtgctgcccagggatggcatcattaacatgctgcagagcccttgagcttggaggagacagcacttgagttatggtacaattcactgtaaatgtgttttatggtcgcctaaaatgtgtttaggtgaccataaaacacgttttatgaaagagttgcataatccaatcagagaccatttcccaaaaggaaaattcacagctaaatggaatgaaaagtattatctgaacttcactagctattgactccacctagtcgttcaagaggaaagcgaatgcttatacattgttagtggaaatgtaaacaaatacaactgtatggaaaggaggatggatagttctcaaaaaacttagaatagaactaccatttaatccagcaatcctgctactactgggcgtctacacaaaggaaaagaagccactgtatcaaaaaaacacctgcactcatggttatcactacgtatattcatcaccacaccatacatacatacacacacacaatggaatactattcagccatataaaagtataaaatcagccgggtgcggtggctcacgcctataatcccagcacttagggagggtgaggcaggtggatcacgaggtcaggagatcgagaccatcctggctaacacggtgaaaccccgtctctactaaaaatacaaaaaattagccaggtgctgtggcaggcacctgtagtcccagctactcaagatgctgaggtgggagaatggcatgaacccgggaggcggagtgtacagtgaaccgagatcgtgacactgcactccagcctgggcgatagagcgagactccgtctcaaaaaaataaataaataaataaagtataaaatcatggctttggcaacaatgtggatgccattatctttggtgaaataactcagaaagtcaaatactgcatgctctcacttataagtcagagctaaatcatgtgtacacatggacatagagtgtggaataatagactttggagactcagaagggtggaagcgtggcaagggtgtaacgtgtgagaaattgcttaatgagtacaatatatgttactcaggtgatagttacactaaaagccaagacgtcagcactctgccacatgtccgtgtaacgaaactgcacttgtactgttaaatctatacaaataaaaaagaaactgaatctttgccaagttgctcctaactatgtctgaaggtcctctggtgatatctcacaccggctcagaaccaagacagtcggctcccttgtcatagccattgggatttccctcctccatatcccaggcccccaccctgatgggcaccattgcacatgtcaggcccgccctgatgggcaccattgcacatgttaggacccttggctgctggctcatgggagctggataccaaagcatctgctgggacaggagagaatgcctgaacccctttattctggtagaagagtatctaaccaaccaacagaactgtatgtttcttctttaatgtgaataactgtgaaaacaactcttttcatttttatttatagctctctctccccctaaattcacacatgcatctctggggctggagatcagctcaagagatggacaccccattgtttcctgaaacactctcctctctaaccatgaagtcttattcctggactagcctatgtatctgcctctcctctgcccatcacccatgctcatatcattcacattagacctttgtattctgggtgaactggggagatgtggcccttgggttcactttgattacttccttgtaaaaataaacgcttaatagccctgcccactaattttttggatatgatattttaggcccaagccgggagtcatccttccatcactctatatttggaagagggaaggatttgtggcatcaaatatttaaaaataaaagtaaaaatattaaaattaattgagtaacttaattaaaataatagtttaaagtggcagcagggcaaaggagcatttgtagcttcagaaatgtagtgatcattctacagtcttttgaaaagataaacctgacaggaatttctagcgaaaatgaaaattggtgacggttgagcagctgcaaagcaaaagtgaaaaagtccttgagttgtcctagcacagaacgtgctcaccagcgccgttggatcctatccctgataccaaaggatccactgtgaatagcccagcaatttttagcactgcagctgagtaaaacagagtggcagatccaaatgtcattaaacatttataatttcggggaaacccttatttcaaatcaattcttcataaccatttcctcagtaaattcattcaacaagtatttatcgggcagtttctatgagtcagataatattataggggctggggatatagcagtgaccaagaccatttagaactctattcttaagacattgccaccttcctgggaggagaaaggtgccaacagaaatggataagccagataatttaagtttcggataaaataaaacaaggtacattgttttattgacataaggtcaagaaaagtcctctctaaagaggtgatgttgaagctgagcccagtgaaataaaggagcctaccaagtaaaggcatggagaaaggatgttccagacgcaggggccaggaagtgcagagacctgaggcaggaatgacctgagggacggtagtaccaggtgagacagggagatgggcaagggcaagggcaagatcgttctgagcatgagtcaacaaactatgggccatgggccaaatgtgtctctctgcctgttgttttttaaataaagttttattagaatacacatgtgccccttcattcatgtattgactatggctgctttcgcaccatattggtagaattgggtagcggggacacagactgtatattccacagaggcaaaagtatgtaatacctgatcctctgcaaataaaaagtttgcagacccctggcttagaactccatacattttgattacattttaaacttagtaggaagcccttgggtggttttaagcgaggaaatagatatgattttactgctgaaaaatgacttgtgctattctgtggagagagaaatagggaaacaaggcatttcaatgttctaggcatgagaaaaccatggcagctacggagatggagagaagagatcacataaaatttttacagcaagtgtgtgacaaatcggaaaattctaaatattgagtcattttatgatgccagcttattataactgatgccatctatgtggaattacaataatactgtaagccttaataggtttataaattttctgcaagtataaaccagaatctaccttcagttctctttctcagcaacacagttaagaccaggagaactgaatggttttctcttcatccttcaacttccaacatttagcagagtcccaggcacaaattatccacccaataaattccactggatgaacaaatggctccaaaggccagaaagcctgaatcccgataaactgttttttaattcaatttttaaataaatggttgtatttattgaaaatgtattcattctttcaacaaatacctttagagtacctgccgtataccaggtatgctgtttaatgaggatggggttggagggggtgaatgcatgaaacagaatggatgctgactctgtagagcttgcagacgaaagaggaagtcagtaaataaagcatcactgttacacaggggaacgtcagttttcaactgctacacaggggagcatctctctaggattaagggagggagatgatgcctgtcccagggtaacacagcagtggtaatcagctgtatatttttctagcactattatgtactggatactggtccaggttccacacctaccttttaaagcagtccttacaaacgtttgacaattgaggaaacagacactcagggaggttaggtgactccgccgtggtcacacagctggtgggtgatgaagctcagatcgaaactcagacctgtatgactctaattcttgtgctttttcatttcatccccatccacaacacccactgtcctttaactatttcacccgtgatgatgttgcaagtaattccaaagttgctaccttaaatgtaagagagcattttcttacacagatgagtgagtttatttattttcatgtgtgtgtgtgtgtgtgtgtgtgtgtgtgtgtgtgtgtgtgtgtgtgtgtgtagatgagaaagagaaagagaaaaccaccaaccttccttagtcattttatagtagcccagcttgccaggtaactccacgcagcccatccttactggtggtaacctcaaataaagccagattctccccctagcggtagtttgagagatgctcaacaactcgaagattcataaagcatgctgagccatccatcagtcaagacaggccacaaatgtcagaaaagattgataatcagcagggagcttgataaagcagcttttactgcagcacccttgctctaagactcccatcccttctgagaacgcagtctagagctgctgcttccatttatctatacaaatacctttgaatcacttcaccttaatatatatatacagtaagatttttttaaagccctgaataatttatgtatagaatcacctcccttcttaaccaaatggaagagattcagtatgctaagttcaatgggaagagggtatataaaatccctttcaagtatatgtcttataaaatataggtcatgaattgagtttttcagtatcaaagaaaaaaagtttaatagacttacagctttcttgctttaattatgggtgcattttttaaaaaccaagtatagtacccaagctattttattattcagaagactggctcttttcaaagaagtgtcaaaagtttggtttggggaattcttgtgttttctttcttgctccagttttccacttttctttagtgtgtcaccatctttatctcctatgatactagtttataaaaggcttctaacatggatgccttcctcttggaagtgggttggggttcgtgtttctatagtcaagctctgtatccttaaaaaaaggcctgcttttcagaatgatggaggacctcgctggcctgtttccctggcccatcacatccagactccagagctgctttgccatctgttcctctccttccttctcatttctgcaattttaccctctatctagctgaagaggttctatgcttgttggctcacactaaagtcataagccagggctagaggggatgacttgaatagtaacatgtgtgtacatatacgtgtgtatgtgtctgtacattcacatacacacacatgaaatcagcttcggtctgtgatgcaccattcaaaaatgtctgcgtagattttcactagctttggaaaccacgtttgatgtggtttaactggaaatattgacccacgcaactaaaactcaggtaacccaagagactactactgctggcagagtcgtgtttgctgatttcagacaccatggagcagtggtccaagtttgaatgattttgttcccaggagacactttgggttccacactggggaagaagagggtacaactggcatcgagcgggccaaggtcaaggactggtaaacatacgtcaatgcatagaacggcctccacagcaaagaatcatttgcctcaaaatgtcagtagtgccaatgtttctccctaaatggagaaaatgtggagttttagttataaagcccaaatgtaaagttggcaggagagatgctacaaattgtaggcattggttggtacctttttatagtgagccacaggaacccattcctctaagcaggatcaatggacatggagctcgttttaacagtgagcattttgcgagtgggagatgttgccaggccctctgctgagggcttcctgtgtgttatctcattgacttgccacagcaggctagaggcggatgctatgatcatctctatgtcccagtgaggaaactgaaacttcaagaagctagaaaacaaactgtccagcagagcagaagcattttcctcaaaatccattctgctgtcctttagtaacagacctcagtataccttagcagcaggtgtccgtatgaagactgtattgctcagcctccctggcagctaaatgtggtgatgtgaggaagtactgaccaacaagctagaagcaggggtctatgttagacttctaggatggattctgaaaggagccacctcacctaggaagagtaccctgtattctcctcctaccacctatttcttttgctgtctggagtagcgatatgatggctagaactcaagcagccaccttgctctgtgacacggcctcaagggtagaaaatatgtgctaggaaggcaggacaaaacacagaataagacctgattctgttgcctgcggaatgccatggcagccctggattgcttctctccagaattattttacataagagaattatgaacttctgtcttatgtaactcagtgttatgttgaattccctgtatttgtagccaaatctaataacagctgaaatatgcagcatcactcaaccagtaaaaattagagcccagactatatgacgttgagtcaagccacgctttttaaccactgtgctttgctgcttgagacataagcccacttacacctctgtatgcctttcatgcaccagttttcctatggtaatcagaaaattgagtctttattggaacaaaaatggtctttgtctcctctgttatcttagagttccttccagaaagcattctaaggcctctttgacattagacatttttattaggttaaaaaaaaccccactgccttatgatgggaactttcttagtgtagttattttgatttcctagtattactgtaatttcagatcacagtctagtactaataatctgaagagattccaataatgcacaccatgatggggctgccatttatgtcagtgtgctggcttcgtgtccacattccaggggccagagaggaaaactttaaagggctctagaaggttttcagagaatattaatttttttcttgccagtgaatcaagttgaagtgcatcatgagaaagtacctgtgagttcatcagggagatcaatgtattctgacaagggtacagcacaagggttgagatggctgattcccatctccaaaagatctggttttcagctatgtttccactgtgattatgagaccttaaacatgttatcttacctctctgggctttgagtaactcttttgatcatgaggctaataacaatgccccaaaaggatggctgtgaaggttctgtgagcaagtagatatcaggctttgagcaccatgaccaacaaaatgccacgtgggtcacaaatactggcagccagcaatggcttcttttcagtggtgctagttcaggagggtcttagtgtcgtcacccagcagcttgcaggagttggaaagactctagagacccatggagctgaattctagtcctggctccttctcttatcagctgtgttaatttgagcctctatttcctctactgaattggtgataatcttctgtggcagcactttgtacgagtttgaattgggcacattcgaaatgattcattatagaaatataaataaaattttatttgtgcacagaattagaaacagtgtgctctccaaattttaaatatttgtcacaaatttgcaatttcagagtggttgtcaggattctctctctcactctttctcagttttaatgagatatcattcatataccatacaatttaccaattcatccatacaaaatttgtcattcggtggtttttaatatattcacagaattgtgcgatcattgccacagtcagttttgaacatttctattatcccagaatggaaccctgtagccattagacgtcgttccttatagtcttaggacaccacacatatactttgtgtttctataaatttgccttgctgggcatttcatagagagagagtacatagtacgtgatcctttctgcctggtttattttacttagcgtgttgttcaggtttcatccatgttctgtgtagcaggtaacagtacctccttcagttctattgccaaagatagggcttccttttaaaataaatttgctctcgccataggaaatatcgctttagcttgtgcagatgaatatgcaccattcttcgtcaagattagtcttgagttatgcaaattctgaattatctgagatattcgacaatgtaccacgtacggaaaatacatctgtgttctgtgtaccttgcagttttgttatgagaattaaatgagataatacacgtagcagcagggctcaatatatgggagggggttcctcaagaaatagagccttctacaattttagttggtttgattgtttcatggtagatctattttttatctgctttttctataatctcaacctttttttttttggatttgggcatacacatgcaggcttattgtatggatatattgtgtgatgctgacgctttgagtatgattgaatctgtcacccaggtagcaccatagtacctaacagttaatttttcaaccctttctcaccagcaccctccgctagtccccagcgtctgttattgccatttttatgtctaagagttccttatgtttagctcccacttataagtgagaatgtgctgtttttggtcttctgttcctgcattaattcaataggataaaggcttccagctgtatccatgttgctacaaaggatatgagttcattcttttctatggctgcatagtattctgtggtgtatgtgtacattttctttatccagttcaccattcatgagtacctaggttgattccatgtctttgctatttgaatagtgctgcaacaaacatatgagtgcatgtgtctttttggtagaacaatttattttattttggatatatacccaggaatgagattgcttgttttaagtgctttgagaaattgccaaactgctttccacagtgcctgaagtaatttacattcccacgaacagtatataagctttcccttttctccacagcctcatcagcatctgttgctttttgactttttaaaatagccattccaactggtgtgacatggtgtctcattgtggtttcagtttgcgtttccctgatgattagtgatcacaatttttcatatgttttttggatacttgtttgtcttcttctgagaagtgtctgttcatgcctttgcccacattttaatagggttatttgtttttcgcttgttgaattatttaagttccttatagattccagatgctggacttccatcagatgcataatttgtgaatattttctcccattcggtttgttgtccatttactctgttgatagtttcctttgctgtgcagatctttagtttaattaaatcccacttgtcaatttttgttttccttgtgattgcttttgagaacttagccataaattatttcccaaggccaatgtccagaatggcgtttcctaggttttcttccaggattcttacagtttgaggttttaaatttgaatatttaatgcatcttgagttaatttttgtatatgatgaaatgtatgggtcatttcattcttctgaatatggctatccaggtatccagaaccatttattgaacagagagtccttttcccattgcttatttgtatcggctttgtggaagagcagatgcctataggtgtgcagctttacttctcagttctttattctgtctcattagtctatgtgtctatttatgtaccgtaccatgctgttttagttaccgtatgcttacagtagagtttaaagtcaggtaatgtgatgcctctggctttgttcattttgcttaggattgctttggctatttggggtattttttggttgtatatgaattttaatagtttttctaattctatcaaaaatgatcttggtagtttgataggaattgcattgaattcatagggagctttgggcagtatctcatctgtttttgtgtttatctcactttaaggaatctccatctatgaaaattccaactgattaaataaaaaattagtcataagtcccctctaacagacctgctcatcaagtgtctccaagatgctgtttaaaaaaatctggtttcttccaaagtgtcaggctttcaggagcccaccagtgattcaagttacataccccttcataaatttccacgcacatccacatattcatgaggcaatctgagacctttacctttgtcagcctgagtacatttctattatggcaatgtcacagccgcgtgtatgagctgtaatgaaagacagcttttgaaaactcctattctaaggtctttcctgacctatttcagcaaaatgtgtaagtgaaagacatttagacaccttttgtctttatctctttttgccctaggcaattaggtgccacaacaaatgacatttttgctccttcagcaagccatcatggctcacctcataggtgggagacaccaggatgaacactttcaaattctttatcccattccatccccccagtgagattgggtattactgtctccatgtttcatgtgaggacacagaagctcagaaaggtcaacacccataatcagagggggaaccatgtaagtctgcctttgcctgacctcaaataccatcttccttcaaggatactgcatttcctctgtctcattgtgggttaattacttcttagtatgcctgcttttcctctatgataaggcacttttatacttattcggcggtctctaacataagcattcagtcctgctccccagccaaggctgtgcatataaataggaaatgttgattttattgcttatgggagatgcaacaggcaagcatcaaaaactgtggtggggtttcagctggaagtgtgcacgttaagaagctgctctaagtcatccctgtccatggggtttttccttacagcatgagacagtccggctatgccttgtcctaattgcaactcaaaggataaggtcaaactacattttaaaaagggcaaacatcaccaggaggaaattttctagagttagaaaaactgtaaccaggaatctagagatgacatttatcttttaaagtatcaatcagagatgcattctgtttcaggcaacaaaatagcaatcagcacagcttaaacatcacaggttgattttcctcgtatttctagaagctgggagatgggtggctgcttcttgtgcttcattgacttgatagttggcatctctgtgagtctttggactttcctttgtggctccaagaaaaagaaaacatataaagcagtatttaaatatgtgtaagcacatatgtgagtatgcatgtgtgcaagtatgtgtgtatacatgcattgtgggctagggaggaaggaatttggaatggatttggggttagcctgtgagtggtcctcacactgtacccaaaagttaagagaccactaaatgaagaagaaaccagcatttcccaagcttttattatgaatttgagaattagttggtggtgagaggcatcactgaaatggtcaattggttaaataagagaaggaatcaaagtgaaactggcttctttactggcagaattttgagagacttcaagatgtgaataggcatgtcagtttccaagatgatgtcacaccagagaatctgttatgagcaggatgttccgtcagcctggcacatgggaggtggcagatcctttggaacggcagctctcagatcctgagctgctaggtatcatgggatgctgagtgggcgtgctcctcctccatagaggagttattaaagccacagagttaaagtaaaatggcccgagagcaagacaatgaatatcagagagggtcacaggacatcaagtggacttgtgaccttgggagtgtaagcacctacagtggacagaggggagtttgtgagcaattttgggataggagccatgacattaatacttcttgaatctcattccctccacactcacccctccaatttagctagctttctctgaaaagccgatactcaaagaataaaatgtttaccgaatgaattaacatgttatataaatgtcaacgcaagaattttggagggtcatttatttcactgcttctcatggggaccaagcatccatctaggttcttggtaggaaattgactatctgggatccttaagatagacataataagtccacatacaaaatggcagacagattttctgcctgtggatctacccagaactgttggtagctgtgttttgggtttccaggtagtctctccctcactttcctgttgactagtaagtgcctggctttgatgtaactgtactgtgcaagatacagagccatgattttcatacatatcacctcatttcagccttgcattatcccgagaaatagataaaggagttctcatttacagataaggacctgaacctagtacacaggaaacttacctaagtctcacaacttcccttcacatcttctctaagaccatgtgaacctgtctatataaaatagagctcaagatggaagaggtgactttaaactcataggtttttaccattggcccagaggaaaaatggagctggaactccattacttggttagtctagggaccagtgaaagtagagtgataatttgggacttttatgaatgtttcttttatagatgtttgtatcagccactgttctctagggaaacagaaacaatgggaagagagtgtgggttggaggaggcagacagaaggaagaagagagagagagattcattgtaagaaattggttcttccaaacaccacatgttctccctcataagtgggagttgaacaatgagaacacatggacacagggaggggaacatcacacactggggctttcaaggggtaggtaagcggcaaaaggagggagagaattaggacaaatacctaaggcatgcggggcttaaaacccaggtgttgggttgataggtgcagcaaaccaccatggcacaggtgtacctatgtaataaacctacacgttctgcacatgtatcccagaacttaaagtaaaatttaaaaaaggatattggttattatgattatggaggctgacatctgcagtcagtagctggagagccaggaaagctgatgtgtggctccagtctgagtctgaagtcctgagaaccagagagctgatggtatcatttccagtctaaacgccagcaggaagggccaatgtattgtttaagtccgaaggctggagtggactgatgttgtagttcaagacaggcctctgactcagctttttggttctgttcagacccgtaagtgagtagatgaggcccaccacattaggaagggtcatttccttttctcagtctaataattcaaatggtaatctcttccagacatgcccttacatccagaataagagttgcccaagtacctggttaccccatggtcagctgagttgactcataaaattaatcatccaactgttgtaggccaaatgttggccccatgatctccacctcctggcattactcctgcagttatgtggcctcacatggcaaaggagactttcttagtgtaattaaggttattaatcagctgaccttaaaacaaggaggttacccgggattatccaggtggacccaggtaatcacatgggccctttaaagcagaagaggaaggcaagagagtgaagaagagagatgcagcagcagagaagagttagagaaatgaggccaaagttagttcagagggttgccaattctgagatcctgaggattcaacctgctgctggcttgcagatggaattgggctgcatgggaagtgtgagaaataaatccattctgccagcaccccaaatgatgctggaaaaggatttttccccccagggactccaataaggaacactgccctgctgaaactgagattttggccttatgagcccctaagcaggaaacctactgtgaaccccacggaggtcatacttctcacccacagatactgttgttgttttaagccacttaatttatgataattttttacaatagcaatagaaaactaatacagaatgtggttacattatcttacataccatttaagagtaaagctgcttttcacaacaaaataacagggatttttttaaaaaagcacacacattcataaactgttgaacagctatcaaaagttcgttttcaaatgaattaccaacttacaattttcaagtattcccaataccaacatcattcttaaattaaaacagcaacggaagcaatctcagggacatgtttagcaacacttcctagtgaagctcccagaattatgaatacttttggtatgcgtgcgatgccactcattaccacgaaccgtcttttgaggaggttgcgctgactgcattaaggagctttacgtgcgagtccccagcccactcagctttcagaagtcacatcgctgcttgccacaattcacctcgctttcccagagtagacatctttcataagatgctgggatttgaagtggaaatcacactgacagaacgacatcatccctgcgattgggataagctaccatcattaaggaagtcacagttgctggtttaaggcttgtacaagcttttcgatattctccagatagtctcctgacacctacacctagaacacatgtgttggaagtaatcctttatgataggtcccttaatgtacttgttttggaatatgaccttctcctgacctgtcttcattgcagaattgctggaaagtctgaaatggggagcacagaaggtcatggtgtggtggttgacacttaggaactctcaaaaaagtgtataaattgccttgatttatcacatactgtgcgtaagttatgctgttctcattcagccaacagtatgtttaatacccaaagccctctttttttttctccttctttgtttttggcatataacagcttattgcagtataattcatagactgtatgattcacccatttaaagtatataattcaatgttttttggtctatttataaagttacacaatcatcgccacaatcaattttagaacatttaatgactcccaaaatgaaattctgggctcattaacgatcatttctcatttcctcgaaaactctttggtactagacaaccaatgatccactttctacctccatggatttgcccattctggacatttcatataaatgcagtcatgcaatatgtggccttttgtgtgtcttctttcactcagcatcatgttttcaggttttattcatgttgtaacatttatcagcacttcatttcattttattgattattaatattgtatgggattatattttattttaagtttttacgttatattttatgacatttatccatttaaaagtccatggacatcgggttgttactactttttggctactatgaataatgctgctctgaacatttttgtgtaagtttcctgtggatatatgttttcatctttttcttaagtatatatctgggaatggaattgctgagttataaagtgactctgtgttaacctttggagaaactggcagactgtgtttcaaagcagctgttccattttacatttccatcagcagtgtatgagggttctaatttctccactttttaccaacacattattattggtcttttattatagcctccttgctaggtgtaaaggagtatctcattgtggttttgatctgatttcctttttcaagattgctttgcctagtctgggttctttgtatttccatataaattttgaaatcaacgtttcaatttctgtgaaaaaagagaaaggcagctggaattttgaaaggcactgttttgaatcaatctgtagatcaactggaagagtattgtcagcttaacaatattgagtcttcccatccatgaatatagaatgcctttccatttatttttgttaatttccttcaacaatgttttatagttttcaatagacaagtcttgcatttattctgttaaatttattcctaagtatatttgatgatattgtaaattgaattattttcttaatttcttatgtggattattcattgttattatatttaatcaattgattcttgtatactgatcttgtgtcctttaaacttgctgggagctctcttttaacatagacattattatgcttattttatgtcttcatttatttgctcaaatctcgtagtagagctactggagcccaacattcatattctgtttgttatacactcataattatacaagtacatgtgcacaagtcaaatattaaacagatacatactgaggtagcattgttccaaatcctcatctatttgagcttacctttctaacgtgtgaactaattatggaaagaatttggttgcttgctgtagctcatgacttaggacgcattttcccctcttcaactgtcttttatttgagccatgattgaattattcaccatgcctagttgttttccttttcctaaacatttaaaaattaactcattttcttttttttctttttttatttcaataggttttttgggaacaggtggtgtttggttacatgagtaagttctttagccgtgatttctgagattttggtgtacccatcacccgagcagtgtccactgtacccaatgtgtagtctcgtatccgttgccatgcccaaccctttccccaagtccccacagtccaatacattattcttatgcctttgcatccttatagcttagctcctacaggtgagtgagaatatatgacattcgattttccattcctgagttacttcacttagaataacagtctgcaattccatccaagtttctgtgaataccattatttcattcttttttatggctgagtagtagtattccatgttatatatatatatatatatatatatatatatatatatatatatatatatatatactaggtttttttaatctgttcattgattgatgggcacttggcctggttccatgttcttgcaattgcaaattgtgctgctataaacatgcatgtgcaagtatctttttcgtataatgacttcttttcctcttagtagatacctagtagcaggattgctggatcaaacagtaggtctacttttagttctttaaggaatctccacactgtttttcacagtggttgtacttgtttacattcccaccaagaatggtcatgatcaaaaaatgaaaaaataatagatgcggggaaaagggaacactttttacactgttggtgggaaaattagctcattttctagtagcagtatatctctccaacaaacaagtcacctgtttttttttcctgaacacaccatctctcatcattcttgatgctaaaatataagcatgtaggtccaaacctgtctctcctcctttcagagtgaccagagagacccttctagtgttttgttttgtttttttgagctggggtctcctgtgttgccagtctagagtacagtagtgcagtcatggctcactgcagcatctagctccaaggctcgggtcatcctcccacctcagcctccccagcagctaggactacaggtgtgcaccaccaggccctgccaatttttttaaatttatttttcgtacagatggaatctcactgtgttgccgaggttggtctcacatccctggcctcaagtgatcctaccacctcagcctcacatagtgttgggattacaggcatgagccaccatgactgtcttcttctagtcttgatgcctctcctctccatctgtagaccccactcctcctaggtcacttcctgtgaccccacaccaacatcctttctctagaaacggccattcccaaactgtgagcctcgtgtttgtattcatgacacatatgtagcatccactgtgaagtcaaaattaaggtgaatggtaaactcaaccacctggcttcatgttgaccttgtccctagactcccattccctgcagctggtcttgctctctactttgaaaacacagttgatgccatctgaaacgatctcctccacttggatctctctgcccgtatttacctgtatctccaatatctcctgctactcaagtatcttctttttattaaaactttcatatcgttggctaggcgcggtggctcacgcctgtaatcccagcactttggaagtctgaggcggacggatcgtgaagtcaggagattgagaccatcctggctaacatggtgaaaccccatctctactaaaaaatagaaaaaattagccgggtgcggtggcgggcggctatagtcgcagctactcgggaggctgaggcaggagaatggtgtgaacccgggaggtggagcttgcagtgagccaaggctgcgccactgcactccagcctgggtaacacagcgagactccatttcaaaaaaaaaaaaaaaaacttccatattttcagttctatcttctttttattcttcctttacctgtacctttattgatttattttaacttttgttttaggttcaggggtacatgtgcaggtttgttatacagggaaattgtgtgtcacaggggtttggtgtacagattatttcatcacccaggtaataagcatggtaccctataggtagtttttttgttctcaccctcttcccaccctccacccttaagtaggtaggccctggtgactgttgatcccttcttcgtgttcttgtgtactcagtgtttagctcccacttataaatgagaacatgtggcaattggttttccatttctttgttactttgcttaggataatggtctccatttccatccatgtcactgcaaaggacatgatcttgttcttttgtatagctgtgtagtattccacattatatatgtaccatatttctttaatccagtctactgttgatgggcatttaggttgaatccctgtctttactactgtgaatagtgctgcagtgaaaaaatgctcaacatcactaatcattagagaaatgcaaataaaatccacaataagataccatctcacaccagtcagaatggctattactaaaaagtcaaaacgaaacaggtgctggcaaggttgcagaaaaaaagggaacatttttacactgctagtgggaatgtaagttagttcagacgctgtggaaagcagtttggtgatttctcagtgaacttaaaactaccattcaacctagcagtctcattgttagatatatacccaaataaatataaatcattctgccataaagatgcctgtacttttaattctattttctgttgactgccccatggcctttctttttaaatcattaccctctccttcctgcatcttcagtcacattctccatcatttcttttgcattagtggagaaacatatccaggtctcccaatcctaatatgagagaatccactatacccctgcctttttgttcttgcttactgcccattataagcccttttcctctttcttggcatacttatactttctgaaaatgcaatgtttattatgtcagccatgtatacatctgctgttgtgaaagataattttaggtggcatagaggtgatcttttataattttaatagctatttattttgatgtacaactaagcaatacctggtacgtttccataatttaaatcatatcattgcttagaagtaagttaaatttcaaaaatcaatttaaagtatattgaaagtagattaatagtggtactgtcaatacttacatatgaatcactgaaatactggaaggctttgcatgtaagaaaagcagaactttaaagacaaacggaactcagagtggatagtacccctgaatggacagtgcttcacgagtcttttctggatgaccctaagaaagttagttgtctacattgcagaaaggctatgaagattagagcaatgtatttaaaggaacaagaacattgtccagaaaaaaaataggtgtttaataaatggtaactaatcatcccccggaccgtatatacagatatatagggatacctttggggaaagtagaatggcccaatatgtaggttattcagttccacgtaagtgggtgttcacgagatgcttcctgatttgaaacatcaccatcatcaacaataacagcattgatgagaggtcatcatgggccaccactgtactacgcctttcagatgtacacctcactcattcccagtttgcaacagctttgtatgggaggttctgtaacatccccactttataggtgagaacactgagtctcagggaggtgaaatattttacacaagattgctcaactagtgacaggtgaagcagagattcaaattccagaagtctgatttcaaagttgtctctcttaaccactgtgttgtatctcaaatcatgacagttctaacttcatgtgtcatggtacttggcataaggacgtttttctccccattcttccccaaattcagtgcaaaaaatatatatgctgagtttttcatgggccaggtctactctattcttagagaaagggtcgggtgcggtggctcatgcctgttatcctagcactttgggaagctgaggcaggtggaccacgaggtcaagagattgagaccatcctggccaacatggtgaaaccccatctctactaaaaatataaaaatttactgggtgtggtggcatgcaactgtagtcccagctactcgggaggctgaagcaggagaatggcttgaatccgggaggcagaggttgcagtgagccgaggtggtgccactgcactccagcctggtgacagagcgagactcggtctaaaaaaaaaaaaaaaaaaaaaaaagacaatgacagagagcgacaactcatctctgcatctctgctttctgtggggaaacttgcaagtaaaggagactgacaagtgatggcgttaaactgtgctaagttgacaaaacacagaatcctcactgcctatgaatatggatctagggaagccagcaatggacctttggcagagtcaagtgaaatctttataggagatgaactgaaatagtttagaaagaatgcattaagatagttttacctaaatagtttatcgtcatatcaataaaattgatcatctctatcaccagttttaaagttggctttgacaacttttccaaagccagagtttgggcatatttgggtatttccataatattgagcaaatgtttaaactatattgaaaacgtttgccgtgcataacagcatcccaataggaagcagacggcatgctcaaactaggacagttgtaggaggacctatttttaaaagggcctagttacaaaggggaattgcaaaggataggagcataaccttgggcagtaagaactgagtaggaacagtgctccacagagagtgcaaagtaagctgatgggttgaagctaaggagcagggaaaagatctagaaggctcccaggcagaaagtgattggtaagctgagtcttgaaggaatcccttctggatagcatgagaagcttgttccggaagaaggaacctatgtacgaagacctgaaagagtaaggcatgatctgagaatacaggtagagggggtgtgacttgggcataggctatggggatggcagggagtagaaagggctggaaaggccaccatgatacaggtgttggagagaggcaggcatcatgcaaagtgtatgtgttaagactattaggaacaaaatatttgtggattaaagatataacacagtggttaagagaggcagctttgaaaccagacttcttggatttgaatctccgctttacctttcactagttgagggatcttcgataaaatacttcacctccttgagactcagtgttctaacctatccctagacctgaggaatgaaggaagagtcactgatctggaaggcgtgagtcccatagagagcctcgtgggaggaacagagaccaccagcatgggatacatccaaccgcaggcaacccgaaagggaaggatccaggggaatgagcatgctgaccttactcaaccaccaccttctgatctccaaacgcaacaggaagtcgaaggtctttctctattcaggccagcctctaaggacagaggggaggcagtggagggtactaaggcgtgctaaagggtcacactaatgatgctccgcaaagagtgcaaactttcttatatgttcttgctgctgttccataaagcaaagactggatccacataacctgatggagcaaagtcttagtccaaccccttagcctgcaaactctggaattttagaaaagtcaatagtgtgccccagacatatttcaatatacctccattttactccaggtaaaaggtttcttgcatccatttaactattgtaaatgaataaccatgtgaccctcaagaagattccaagccaaattccattggtttctaaggtcttaggtttgcttgcttttggcaaagagtgtacttatcttttcatgcatgcctttaaagagaccatattttttctctgataaagtcaattatcagtgtatgtgctgctctgttcacagttttgactaaatagtgcaacatctacgtagaaaacataccccaaacttgagttttcctgggttgtgcattgtacattgtcaaagcgtaaagaacatctgagttggaactcgtacccacttcaggatatgagaagatgcaggtcagtgatttgtttcgaggcggaagaagcttaaagaaagtaccttgcgctgtgtgttcctccattagcatttgttattatgaaagcattagactatctctggatgttttccacacacctgagagtgtgaaagaatgacaggtacctcattaaagatgcataatatctagtctcctgttctcacacagactccaaccactggtatgaatatactgcttccatatgagcctgctgcaagccagccagatcctattcagaatatctcctttctaccacatccaaatgtgggcagcctatatatacagatttgaagtgcaaagggtttgagtcaactttttgataaccgtggggattttccatctcaagaaattccgaaaatgatgtaatgatataatgtagcagaattttaatttagtaggtaggattaagagctgacaaatttcctctctttaagtttctttaattctgtctgtgcaagtcagagcattcggtatattcccaccctcccagctgatatgctaaaattggtttcactgtactactctcaggcatgcaatgagctaggcaaagctgtttagttacttgcgatctgtttacattacatagaaggttggttaattagaaataatcatgtttcttaattaaggaacaaattgatttttaaagaagtgctgaggcccccttgggccacagcagataagggactgagctcatggtttgtggttgtctgtgtgattctctttaaggagggtctgaagtgtacagtgacacagctatcagtggctatggaatcaaatatttgtagattaaaaattgtactcattctgctgacatcttatgagtatctgttgtgtgcagagaaatatgttggaggactctgggaacttgaagataagtaagacaaaatcagatctttaatggagctgagggtggcatggtaaaaacaggcttgtatgttgtatatttagcaaactgtgttaagtcctagaagagagatgggtaaatatcccaggaaaacactgagagcaaagtaagctgatggggtgaggctagggagaaggcaaaagatctagaaggctcccaggcagaaagtgattggtaatctgagtcttgagggaaccccttctggatagcatgagaagcttgttgcaggaagaatgaacctgtatacaaagacctgaaagagtaaggcttgatctgggaatacaggtagaggagatgtgacttgagggtaggctatggggatggcagggagtagaaagggctggaaaggccatgatacaggtgttggagagaggcagacgtcatgcagagtgtatgcattaggactattagggtgagtttaagcagggaaaaaaaattgcatcagctcatttatttaaaggaccaagaggagctttagggatagcagtatctaggtgttccaactgtattgtgaagaatctttcttacttattccttggctctgcttttctctgggatagctttccccaggtgatagcaaacaaaaatggccacctggcattttccctactattttagcaaatgaagctgcccctcgcccttcataaaagtattgttcccatgtaactccctttaaagttttaggtatgcctctgttggcccagtttaagtcatgtgcccatccctgaattagtctctgtatgcacagatgtggaagactcaaaggggcttgtgcctacacctagagccaggtatgggggaaaggtgataccagcccttcctcaacttcaaggactaagagtgaaagaatggtggtcgcttaagggaaaaggagaatgctgatatcaagagcaaggagaacagacgcaggacagaaataaatagatagctagtatgcaaagatgtcaaagtgacagctcttgatgagttttgagtaaaaacgacatggacacattttcattagaaaaaaattattctggctttggagaatgggtaggagagaggaacatctaactcggtgagatgctagcatgatgacaagggcttggtctcaggtggttgtggtagagatggtgagcatgagacatgcatactctagagagagttaggaggtacaaaagatggacttgggggtttctgatacattacaaagggccagaaatctttgagcatcttgtcccctccccttgattctaggtgaggaggggacattgatttgaccaatacaatatgtagaagtgacactctgccacttctttgatccaggccttaagaaatgggttgatttaatttactgtctcttgcaacgttcactctgatagaagccagcaccacataagaagtttggctacctggagactgccctgtgtggagatgctcaagctatatgaaagggccttgaaggatgacatactgtatgaacagagaggtcaaggaggagtgaagcactattcatgggaataaaggagctatatcagaattagactctccaaccctggctgacctcatgagaatctgagatgtaccacccagctgagtccttcctgaatccctaacccacaaaatcataaacacgataaaagtgacaaaatgtttagatgttttcattctacagcactaaataaccagaataagaactgaattaaacataaaaaggagggaggggtttatgttatcagccaatggcaagcaccactgaagtttttaacaaatataagacaaaaggttaaaccacacatctggcccacacccagcccccagttcctaaaaagcctggtccatctcttcctcttcttgccacatctcaaaggctatctctctatgtggatataaattatagatttaggttatagtttcccttcctcctggggtttcctctttgatgggactgtcaaactcttgggtgagctttattgtcagtcacagggtctgtcagttttcccatagtagtattatttcactcatcctttaatgtgcccattggtggtgacaaattttctaacatgcaaccacaggccataaatgtaaaaataaagcaaaagtcattgaattgaaaagcaggagacactttgcaaggctccaaccagtgagcttccatttcttctgcctgataatgactcccacacttatgccatttcttgagaactgtaaccagaaacccatgttttgggagtcaatagaatagatcagagcaaagacaaaggcaagagaagtgagattggtctttgttctggtgttatctggtagaaagaccataacacacagctaaccaataaggtactttgcaaaaattagaaaaaggtgtccccttcaagcagataagttctgagaaagtacccctctggaaagaagcagaccattgaggtcttggcttaatgagtagaagatgaatttgcatgtaaaacaaatatatcccttcttccagagagctgagcaagaggagggcaggctgctctcagtaccctttggacccgctaccatgcatggtggctttgaaaaagccaggcatttgcttcctaagagcacaccttgcagaagcagcatcaccatcatcactacgatttatccagcctttgctctatggtagatgctgtgcaagtgctttcggtctcatcctgaaacaactattgatatagatgccacatagatgacaaaacaacaactgagaatcttgatgccttgccctgaaacacacagactaggagtgggagagctgtaacttacacctgacctttctagctcacatgtggcctcctgttcagcggagagggacttcttggagaggtgccctgagaaaaacacatcccttgaccatgagtttttaacagtatcagctctcatcgggacattattatgttctagttgtctgcaacgataatatatgtgactgttattttgtctcatatctccaataaaggggtccccttcagttggattggccataccttcaggtgggatgcaactgtgagtctgtgtacatggcccagaagcaaatgcagcacagtggagtgattaagactctgatatgatccagttattgctggactggatctctgtttcttattatcatatttgcatgaccttaggcaagatacttgactgctctgagccttagtttcttcctctttaaattgggatgactgtagtttgttataaaaatgctgtagataattcccagacttgtaggtaacacatattattaaacagtagaactgtcgtgaccattaccagaaagattttacaaacaccctaaaatcatcataggattcagctagtgttcttagccttctaagctcacaccattgtctcatgctaaacttgtggtccaccagaaacttaagtgcatatttcttataattatttccaagataggtttctccagtttagaaattgtatatacacatgcatctatatatatatatatacacacacacacacacacacgtgtgtgtataacatatgcttatccttgatgtcatatttacccatgatttttattttaattagctttaccccatgggaagaatacaatgtcttttgtcttcaacctggtttgttggcaattattcttagcctttttaaaatattcaaaatctcataagcatgcattctgcatcttcaccaaagtaataacaactgtatatggtttagaagggcactgactacctctccctcaagtgtcaactaaaaaatattagatacgaagcttgagtcaagaactgtcctgggtgctgttgactcttctacgtccggtgtcttccatggcctatggtacaaagtcactccagaacattggatggatggatgggtggagagacggatgagtggatggatggatggtaaggttattgaatagaatagaattatatatttatgtttacctttgcctaaaaggcaaccatacagtgttttggtgaggttgatcaaccagttatatatttacctaagagtttgatcactcagcccacgttttcccatggtatgcacaacttgatcatgagaaggttttcacaggccttcctgaaatcatgatactatatatttgccaggctcctggtttatcagttacacaacaacagacttgaagaagaaaaccagctcacatctgtgcacaaggagacacacagttgttcattactgcattgtttgaaaaccactacgttgtaaattgcataaatgtgtatcaatgggtgaatggctaataaaaactttaaaaataaatataaaactgccattcaaaggaatgaacgaaatattatataaatatataacccaataatttctataaagattatatgtgtgtgtatatagatatatgtattatatatgtgtgtgtgtatatatatatatatatatagagagagagagagagagagagagagagactgtcccagaacaaggaagccaattttagggcatattccatataatacaatttttaaacaattaataaacatatacataaaatataccatattattctcagaaacaaatatatgcctaagatgattcaaaatggacattggtattcttgcgtgaggatgagagtggttgtcattggtaaaaaggttgaaagtcatagaacaggatatgacggatcaaagatcttaagctttatctgtaatattttatttcttttaataaaataaagacaaagcaaatgtgacaaagtgttaccagttggcaattccagatggtgggtgtgctgattttcatactattgttctttgtgcttttctgtgttttcttaaaattcccaaaatatgaaactgaagaaggaaggtaaccatcattggttgctgactgtcagcccattcattctatttttgctcccagctattttttatttgaagataaaagacgtgacagatacacgtgaaacctttctatctacctacctaatttaggattagacttagctgcatgtaaaagaaaaaaaaatctcaagagtgagacatttctttttatcacataaaagacattcagaggtctgtatagggcagtctggagacgtcatttgggacaaaattctaccattctcagcacgtagattctgccctccaggccacttcatggctcaaggtggctgattggagctccagccttcacctccatattctagaccaacagtaccctcccttcccaaaattacctctgcttacagctcatgggccagaattcatcacatggccatgtaactgcaagggggatagagaatatcatgtttcattagggcacattacccaaggtttttttttttttttcctttaattaaggaaaaagagaagagtgtatattaggaagtaactagcagccctgccacaaaaatgccctcatcctcactgccctccctcccttctcagaggaaggcactctcttagagttagtatataaccttcttgtctatgtttctataattaaataactatgttcctatccatttaaaatacatggttttattgatcttaaagttttaataaattctgcaattattgctttcttgttccaggaaacatgctaagtacttcatgcttattatttcattgtgtcctcaatagatggtaacaactacctatttaatagttgcttgcttttttcacattttagcaaatgtacctttttctaatttctaaagttgatgttccctccttgccatctggagtgagcacatctctttagcctccaccagttcctaactgcctgaaattttcccagaaatcgtggactccccctttccctgccccttcatgtcttcctggatttctgacatctggcttctcctgcctgtgcattaagagttccaaacctctctgacttaagccaacagtgactttcagtgttgtgcgttccctatccatgttcatgattttttagcaccgagatcgcatcagcaagaaccctcaaagccctgggatgcagttcttctggatctcaagtcttgaacacattaaatgataagctctttacagactttctcttcccaattattaagcagcaattacccttcacatcaccttctcccatatcacctctataattccaaccactctcacctaaaaaagctcacctaaacccaccacttgtctatctgagtcaaatcattccaaaccaaagctgcacatgcctgaaattagggattaaaaaaaaaaaagtaccaagaggataaacaccttccttcctttactagatccagggtatttttcaactgaatgcagccattgccaccctatatttggcttttagagacagactgaagtctaacaagttgctccttatacttgaattcacaagtataaaatcatatggatgacttgtgcaccttgctgtcattctgtgcagagctctgcctgtgcactccttccctcacttaccgagggcctagttcatcctccacctctgtggacacaggaacgacgaaaaagtctcccttatgacctaacggcttagagcatgggtcccataatccaatgtgaatgggcttccaccccaactctaccagctacttattgtgtggttgtgagtaagtcacctaccttctcagaacttctgtttcttcatctatagtagaaggatactaattcctccaccatagggatgatttgaggacagcactgactaatagccataaagtacttagcttgctgcctggcacataatgaagacaaaaatgaacattgaccaatactagcatcatctgcatctccaccatttccaccatcatccttaattggttgtgcaaataaatccacaagtacaatttaatcaggtaaattaatggaaatattttattctggggttattttaaatgtacagaaaagttgcacgaacagaacaaagaacttccataccccctcatgctgatccccagctattcacatttcactgcgtacactctatctccctatgtatgtatctatgtgatgtcccttcaaccctcagtgctccatcatatctgcctccccaagtacaccctcctgcataaccaccatgcaaacccacaagtcaagaaatgagcactgaaacaaaacccagtgcatcaatacattgatgcaatgtccaatctccacaccccgttcagggtttttctagccctcctacctttcccttcttaaaaataccttctgcaacagtgagaaatcttcattaacctcagatctgtccagctgtcctagtgatgtctctttttcatatctggcccaggattccatccagttacaccaatggttctcatctggagctgactttgcactcccctctgaccccacccatggtacatttggtaatgtctggagacatttgatcacacaagtgggaattggtattgacatctagggcttagacaccagagatgatgccagacaccgtgcagtgtgcaagacagaccccaagaattatccagtcaaaaatcttgaaagagctaaagtgcagaaaccccgagttacacattgcatttaattgtcacatctttgcagtctgccccagtttggagcatttcctcagtctttccctgactttcatcgtcccaacagtttggaagaatgcagccctacattctgcagtgtgatgctcaacgtggtccatctgatgtttcctcgggaccagtttcaggtcatacgttctggggagaaaaaccacagaaatgatgccatgttatcagtgttccacctgctggggcacacacaaccaaccctgcccaaggctcaggaatgttagcctctttcacctggtcatgtcaacatcctcaggtttccccccaaaaaagtcaccattttcccctttataatcaaatttgcagcaagatattccagatcatcgatcttgtgatatgctgctctcatgagacctcaactcacaagccttgactcacctgccagttcttagctgagcatctgccctgatggtgtggagtgatttcctttttccatggctccttgtacatttatggttggcattctactgcaaggaagactgtttcctcttctcccattagtatattcattcatttattttttatatcagaatggactcatgtggttttaattctttgggttgttttctgttgctgtctttcttttttaatgctgtgcttaaattgtgtcatatttggccagggggagcctggggcttttgataattcctcatttatttttactgcttactttcttatacaatgagatattctgaactcatgttgtaccttcctgcccaaccctggattgagtgacttcctcaaggaaccttggtttcttttcatggagggtggtctttagaaatcagtgtctgggtatttggtgaggttgtggctgctggagtgtcactgctgctaggtcctttcagcagacagagcaatgatacagacacacacatatacatacacatatacatccacacaaatatacgtacatatatatgggtgtacacatatatacacatgggtacatctatatgtactcatttatacatgcttgcacatatgtctacaactactgtatctctctgcattgttcatacattaaatttaaaacacaagttcaaactgatatctccaattccaatctaatatctaagggtttttctagccctcctacctttcgtgtttatcaataccttctgcaacagtgagaaacctattattattctcaatatatctactaattgatttgatgaaatcacatgatgtaaccagcctctcaaccatgccagccatctctgctgactgccacctctgcctgacttcccagagccccatatcccaggctaccagcaggcactggtccttcctttcttccctccaagtcccccaggccagtgaaagaaggaaatagactaccgaggcgaatttatggacagaacaatagggtcaagggttaagccaagaggcttattacaagaggtaatgcaaagaggctttctgcaggaatcaacaccttgagctgccccaagggcatagaagcatcagcaaggttaacaccctgtgggaacacgagcagaaggaatggttctgccaaaggcatggaggaagagagcctggtcactctggcacttgcatgtgggtcagcagcatgggatccgagggtatggagaggggagagtggtgaagaggaggctagacaggtgtgcagggccacatggcaaaaggcctcatgtggatcaatgtggactaatgatgaatctttcctgtctcactcttcaggcatgcgcttggcttttggattctttaagtactctcagataaatccacctgtcctttccaaagtcatttccatctattatatacaagtctcatgagttgtcgtgtgtaacatggtatgtccaacttctaggaaagtattttgtacatagtatatgctcagtaagtattttaaggcaccaatgtatatttttatctcaaataagctctcctggccctctttcaaacaaagatggttggcaaacagcagccagctcccagcacaggtggcccctactgtctctacatttgtatggaaaatgtaatgggtcatgaaattgcatgcattagcatgcggatgcttagacatatatattttttgcaaacatttcatcctataaaagtaagggaccaaagtataaaattctttagaggcatcagctggaggtagtagtcaatgagagagaatcattgtttccattaaatagtaccagtttttgtaaggcaagtaagatcttcatgttaattctaagaaactgtatgcctcattaggcagctaaggcatattatgatttggatgcagaataaccccagtgataaatgaatctcccagcagagtagcttccagattataatttctttctttgcaagattgctataggcaaggtggcctgatcacttttcagaggcccatcttaatagtcagagtaagctcagctatgctgtagtaacaagaaaatcccataatctcagtgtcttaataaattaaaataacttatttataacaaaatgtctaatgcaaatagggctccttcatcttgtagttactctagaacatggggtctctatggtcacctatggcatgggaaaagggattgaggtgacattcagctctttgctcagcccaagaatgaaactcatcacatctgttttcagtccagtgaccaatactagtcatgtggccccagcataactacaggagaggctggagaatatatgggaacctcctcacattcaccaaatggaatctttggtgaattctaaagattcccggcatgtcccactatctccttttggggctgagaaaatgaaagaaaaaactgacaggccaatgtactgactgctctctcacctgggtctgatcccatctgaagctactttgggtggttatcacaatgtagtttatcatagtgctgtggaatatgaactatgaccatagccagccctatattctagaaccagcatctccatttgtagctatgggtgcttggacaaacacttcaatgttctccatctcagtttcctcatctgaaaatagagtaaacaacagtaccaacctcatagggttgtgtggattaagtagttagaaacatgtcgctgttgaggaaacatgagctgctgttgtatttgaaatggtgctgaattcagaatcccatggaaatcttcactatgacaagaattaaccagcccagagccacatggagaaaagatgtgtggccacgatctcttgaccgaatccagcatcagaatccaccagacaaaaccagcatcaggacattggccacaaagggataggcgtcccaggatgctggaatgttgggggcagcgctattattagagacacctggtcactgacccagctttcttcccatggctcaagctgagacttgatagtaaaaactgccttaaatggaagcaactatatttttgatgtatgctcttctaggatgatactaaaagccatatataaaagaggtgttggttcaaaataagtgggatttttcagttccacctatacccggatagtattacccaccctacttgaggactctaggaggcaggtaagctacagtgaaatgtgctacccttgctagttgtggtcacttcatttaaggtaagaggttgtatcttcatttaacttgatgaggaattttccatcatacaattagttttgactgcaagtataagaaaatctaaccatggtggcttaaacagtttgggggatgtttgttggctgctggtattgattcaacatcatgatgatgtcaggggtgtccccactgtgattctcttagccttttctgcaagacagctgcctctgctctagtcatcacttctgtatttaaggaagagataaggggaagaagtaaggtccaccccaccttttccattgcatctagaaagccaaagtttccctgaaacatcatctttagctccctgctgcaagagactttcgcctacattttcttagccagaattgtgttatatgcccatccttagtgacaagggaagtttggaaaattaaatacttgtgttcatagactctattatagaggcaggggaggaaaacaggggccagaaatgagtgttaggtcaaccaagttacaatgtctgccccaggaacttatccaagaatagtatatgtgagaaggaggaggaggaggcaaggtacccattcttatgctcacttgagatgccatatttgatcctccctagcattcctcaacttaagggctgttctttcttctgcaggaagaaggcttaagatgtgaactggaaagttcttattctccactgagaactaattgcctgcagcaggtttcggctcacttctagttgtttactattttccaagtcactgtgattccagaaggtattgggcctcagtggagctcaaaatggatattagctcttgggtgtgtttcatcgatttgggcacaggagggaaattatacacagaggattgtcatcctggacagttaaaaatttaaagtaaatgaactgaacaaacctcctcccttaaatagtgctcagaaatcaaagagctgaaaaaatgtaaatgggattcattaagagctacaaaattatcttcttgtgttgctttgataagtttttcttgcaaatctctagaagtttagctcagggcaagtcttggacatggttgagaatgtctgccttatgaatggcgaagtggacaatggggaccagtgagaagaggctcttaatatgtgaccatcttaggatgccactggctcctacagcagtccccctggcactttccccttgctgtctctttctttgccttggtttgcagtgtttacacagcatgtccaagtgctagtttgagttaattttcattatgctcattttaacacaaaggacttgagtattcaagaatttctgtagtgctgggtttttactttctctgttggcaagaattacctttggttaacctttgtcttatagactcattgggtttcagttatcaggactggggtaaaagacctcctagacatgacacctactctgacagagaccaagaatccggcattgacaccctgaggctgtacttggctggcaggttttttattgttgtttggactgtgcagtgttttataatatttaagaatcacatttctgggctaggcatggtggcttatggctgtgatctcagcactttgggaggcaaaagcaggcttaagtccaggagttggagaccagcctgggcaacatggaataaccctctctctggaaaaaaaaaaaaaaaaaaatgttagccaggcatggtggtaatgcctgtagtcccaactacttgggaggctgaggtgggaggatcgcttgggcccagaaagtcgaggctactttgagtcgtgattgtaccactgcactccagcttggccaacagtaagatcctgtctcaaaaaaatcacatttctggctttttttgatcaacgagatttgatgatattggacaagtgtttggaggtggcaccatgggcaggagctgaggagcagctgcctgtttggatcatggcagctacagtcctcaccacaccctattgccttgcactcttcccatgatgctgatttaccaatctctgcatggccactttaggccctgcgttggtgtaccccatccagattgtctccattgtaaagccatatatttccaagggcacagcaggtgtgtgtggtatgctgagagtccccttctatctctccaccaccctctccatacttgctccccaggatggccatggatacagctacattagcctcacctgggtgcttcttagaaattcagaatctaaagctcagcccagacctactgaatcagaatctgccgtttaataagatccacaggtgatctgtgtgctcataaggtgggagaagcgttggtctaaagcacaattttcaaacttggctgatgataggaatgaccagggcgcttgtgaaaaacccattcccaggcaccaccctaaaaccagtcagagccgacagggaagggctctgagaatccacaggcttaacatgtgccccagtgattctaagacaatggtcaattaaaaagacttggcttgaagacttagttctcaaacgggtatgcatcagaatcactcagattgcttttcattttttaattaaagaaacataatttacaaaaatcacattattgtaagaattttaaaaagtcagatatgcaaaatataaaactataaaattgccatagttgttattttagcgtatcttaacgttttagtgtataagcatttttttaggtgtttgtgtgtgtatattttttaccaaaatgagatcgtaccataacgttattttcaaatctgattttctcagttaacaatctctatctttctataagaataattttcccatttgaccccgaattccaatttacagtgaattgttctgtctaaactaggagccaatccagatggatctggttattccatcctttatgttttttataaacaagcacattcttctcctcctcaatccctttattttattctccacataatgctgccttattgatggactggaccatttattctgcagatagtcccaccttttagacttatctggtcacttccttatggtgtcacatagcttgttgctctgtcctggggtgcctttgtttattctctttaatgcattttccaagactcccctcaaactccaatgaattaaagttttcagagtttggggcctgggaatctgaagtggttccactttgccaggtgagtctgagtttgagaggaaaggtgtcctagatcattcagcagcagcagaagagttggcccttaaatctacgaagaacattgccctgtgcatctgcatgcagacagggtctgataacatcaaagctgggagtctctccaacgctttaactaatgggatctgagctcggctgtttatttatagtcattcagtgataagaaagtcaacttggttggaaggagcttctgtcctaggcttgcagctggggccttagctacccttgtaattttcccagaaaaaaaaatgcacatctctttgagtcctgggccatgtgtaaatcagtggtaatacaagaaacatggagcaccccagaaaatcttcagaccctgagtttggagctgaggaactcagaaacactcaatttcatcgaagccccttcatacagctttgaatgcatacattatggggtctgtggctcagaggtaccagtgctcagagcagtatctgctttcctagtatggcctgtgggcagtggtctcagcatgcagcatcactgaacagaaccctgcatatgccataatttacgtagatactatggaggtggaaccatgtatggttaagtcccggggccctggagcagtagatcttaaccttattggacacagtatcccatttctatttacaaatacttttttttttttccatgagaacaaccacagggacttttaacttgcctaaagataatgtgtgattttgagatgtgattagggattatcattcccacagtgatcctactatcaacaggaactgctgtttctattatcaacaagaatatgcctccaagccaggagtcctgctgatcccactgtctccccaccccaacagccatggcccgagatcagattgtctccatggattctagtgctcagggaagttaagaaaactcaattcacggtgctcagttcaaccttagacatgcatcagaatcactcacattgctgtttaattttttaattaaataaaaatatttattcagccgaggtagctgaagcaggagaaggaagagcctcaactcaggggaagatttgctgtcaccccctgacactgagcagaggccagtcaaatccactggagctgacctctttgatgtcaggctcagcagaggcctggctcttagcaggccagcttcctgtgcttgggattgcttgtcttagctttcagaggatttaattgctgattcaaaccatacaaagtacaacgaacagtatctactggtgggttgaacaaatgggttccaatgactcaggcccgagtgacctctgctgcctctaacctccttcaccatctgctgcccagggggtcctgagaggccaataagtatctgccaagatgctctttagtatccttctgtgacattcataagatgttaacctgcctacacacttttttttttttttgagacagcgtcttacccgtcgcccaggatggactgcaataacatgatcttggcttactgcaacctctgcctcccgggttcaaatgattctcctgcctcagcctcccgagtagctgggattacaggtgcctaccaccacacccagctaatttttgtatttttcgtagagacggggtttcaccatgttggcccggctggtctcgaactcccgacctcgtgatccgcccgcctcagcctcccaaagtgctgggattacaggcatgagccaccgtgccagccacacatttaaaataatgataatagtaagccccaattatactataaaggaacaactaatttagaataggaggtctaggtaaatatgcaaatgcaaatactctggcgcaacccccctggaaaacataatgaagtggtcccgccagagtatcctcacacagggtcaccaccaacacattgcatcagctgccatgcagacgaacacaggtctgttttgcattgtcacccaagtgacattcagtattgccattggttaggcaattttccagaattggtgagattctgaaccaaacaaaaaacaagatcacctcttttgacacagggtctgcattgtggtgatgtgtggaatatgttcatctgtacgaaaatatttggggtttgagtgtaaaatcgagttgggttctagactcagataaacaagattttttttctcccccacccaaagactgtttatcagggtcattcgaaatgtatgtggggcaactctatgtagtcaggagctccatgcatcgcggggtgtctaacacctaattgtcacctcccactaaatgccagtaacacccccgattattgtgacactcaaaaatcgccccctcgcacttcgaaagcacacccctatacacactgatcttctgttaaccctgccttgaatgacttcggtagcctgaattcccatcctggccccactgcctcatagcttcgtggccctgggcaagcccacaacccccaaacctcagtttcctcatctgtgatatgggtgcatggaggaggttaaataacagctccaatcttaaagcctccttagcgccgtgcctcacgagctgtaagtactaaatgaatgctggctattatatataacttatattgtatattatttatgattgttcctaaaattatcactaataagtgcttcacagcaatgagctaagattctgagtgctatttcatggattttagagaaataattagattctagaacctcaattatcatcgtaatgactcccctgatagagttccaaaactgtttctttgtgaccactcacagtaagaacatcacacgaatgaatattccacctgtcttaggtgtgcacacagaaggtactgacggttctctctgagcagttccaagccctcatctgggaccacgtcttcccaagaccaagccctaagtcgtgatataaaacaagaaaagacgctgggagtacagtcagcttcaaagacagaaccagcgcacgaggcagaatcacagtgtcagagcttctgtaattacacgctaaattatgcggtgccatctttaaattatgtaggaaatagaaaaaggaaaatctcggtggaggatggaggtagcttctagaaggaggtgggcctgagccgcccctgaagaatgttgggaatctgggtcaggcaagaggctggaggagagaggtgaagagctggaaggaagttgggaggggagaggcccaggggagggcatagatggagggtgatggggtgtgggtgcccaggcctgggaattcagacctgccaatagccctttcaagggccagagacagttccctgccagaataaatacatagataaatactatttaaagcaaaaacaaagtgtcaccaatatctagataaagtgtccccaaggatacatctggtgctattccgtgagaccatgtcacccagagctggtgctaaactgatgccaaggggtgcccatggaaatgccacctttgggtgggcagaggcatttggctctgcactggtttttatggtgtgggaaaggaagcattctcgtgggaatattgttcttgcctccaggaagggctgtgggaacgtgcagttactgcagagggacatttctgagcatacatgcttgtttatgatgatggatgactggctcaggagagagctaaaatgatcctttccctagagatgtgaggagaagccagcccagaatttctgtcacaatctgctgcccgagtccagtgactcagaaacaaagttcatctttactgacgtgccatggctgccaggaaccagggcagctgctaagccaccaatccccagcccacagttttgtgcggaggagacatagacatatatgttattgcaattatggctctactgaaagaatgaatgaatttaatcgaatcaatcattcattcaattcagttgaatcattcattcattgaattgaatcattcattcaatgaatgaatcccctggtcaaggaaccaggctcagcccacaatgtatgcatttattcattcattcatttaacaagcaatgccaggcttctggcctcagggagtacatgttcaccccctagtggagggagacacacagtaaacatagaatacattaggcaatgagaactgtagagagaagcaagcatgaagaggaacatagaatactatgcagccataaaaaagaacaagatcatgtcctgtgcaggaacatggatggacctggaggtcattatccttagcaaactaaggcaggaacagaaatccaaataccgcctgttctcgtaagtgggagctaaatgatgagaacacatggacacagaaggcaacaatgaacactgggtcctacttgagggtggaggttgggaggagggagaggagcagaaaaaaataactattggttactaggcttagcactttggtgaggaaataatctgtacatgaaacccccatgacacaagtttacctatatagcaaaactgcacatgtacccctgaacctaaaagttttaaaaaaaaaaaacaaaaaagagtgaacagtactgaagtgagagtggcaggggtgcggttttcaattgcgtgctcaaggaaagctgcttgtctgggaaagcaatatttgaacacagcctgaaagaggcgagagagtgagccacgtggataactggaggtacagcaggccagacagaggcaacagcacatgcaaagtccctgaggcaggcacacgtgtggtgtactggaggaattgtaaggatgtgggatggatgaaataaagtgagaaggggagcagaagcagggggagcagatcacatccaactgtgcaggcgtagtaaagaacccagcgtttactcacaaggaatggtgagccgccaaggttttgagcagaagcgtgacatgacctgacttgcattttataggacctcccttgctagtgtctggaagagatcaaagtggatgagaacaaaagcaaggcagccattgaggagggtgggacagttacataggtggattgagccagactggtagcaatggagggatgagaaatggttagtatccgcaggggtttgaaagggctgactgatttgctgatggatggtgtgtgtggttcaagagaaagaaaagtcaaggaagggccaggcacagtggctcatgcctgtaatcccaacactctgggaggccaagacaggcggatcacctgtggtcaggtgtttgaaaccagcctggccaacatggtgaaatcccgtctctactaaaaatgcaaaaatttgctgggcatggtggtgggcacctgtaatcccaggtacttgggagcctgagacaagagaattgcctgaacccaggaggcagaggttgcagtgagccaagatcgtgccattgcactccagcctggacgacagagcgagactccatctcaaaaaaaaaaaaaaaaaatagctgggtgtggtggcatgtgcctgtaatcccagctacttgggaggctgaggcaggagaatcactggaacctaggaggcggaggttgcagtgagccaagactgtgccactgcactctagcctgggagacagagtgagactctgtctcaaaaaaaaaaaaagtcaaggaagatcaaatactcaaggctcctagtgatcatcaattagacatccgagttcttctgggaggtcctgtttgccagtggtcatcctgtcatttccatcagtgatgtctggaaggtttgataccaagaagttacctcctttcaaagtggcttcttcttccagctactaggtttgacctcctggaggccaggagtgcaaggtacaactattactcttccagaagaggctctccccaaccctcccacattgaagggttgacattgaagtgttgaagttttccttcagcctggtcattgctcaaaggtggtagaatatagatgtaggtcagtagtgatagcaggctacagccagccggtggtcaccacagggtagatatcacatagtggttgaaactgaaggcggctgaaacctgaattctaattaatttctttgtgaccatgggaagttatttcacctttccgttcttttttttaacttttaagttgaggagtacatgcacaggatgtgtaggtttgttacataggtaaacgtgtgtcaaggggagttgttgtagagattatctcatcacccacacattaagcctaatattcagtagttatttttcctgatcctctccctcctcccatcctccaccctcctggtgtgtgttgttcccctctatatgtccacgtgttctcatcatttagctcccactatgagtgggaacatgtggtatttggttttctgttcctgtgttagtttgctaaggataatggcctccagttctgtccatgtctctgcaaaggacatgatcttattcctttttatggctgcatagtattccgtggtgtatacataccagaatttgtttatccagtctatcgttgatgggcacttaggttgattccgtgcctttgctattgtgtttcaccttgttgaacatcagttttgtgagctataaaatgggggtaatccattctctacctcgtaggattgttcagagtatgataaaacactgtgtctggcacaggaatgtcaatgatcagctattgagtaagcaaagtgaattaatgatctttatatgccatgtgtcatgtaattctatcctctcacttccaggagatttggaaggcagccaggagtccctctttcctctctgttgcctggctgacctccttcctttaaaacccttctcctcttttttgtatcataatgaccttattttgaattatggtggtactttaaattttatgtccctgaagggttaagctctatgttggctttacctgaactctctcatcctcacccaccagcaagatgaaggtagggtggccactgacaggtgacgttcgtgaggtgcatggcttttctgaagataagcagtaattgaaggaggagaatcagatttaaagcctggggctgcaaggatatgagattcatcacaaatgatgatgatgatgatgatgataggaacattaggggaggagcaggagtagggggagactgggagacacaaaacatgtgttaccagactttgtcagtagcatttttcatggtttcacatttttaattctcacaatgaccctttcaggtagcttctatcattgtcccaggttccagttgaggaagctgaggctctatgaaatcagataacttgcccatggttacacagctactagtggtggtgcagaattgggaagccaagcagccttggctaaaaagcctgcagctgtgatctatgtcctcgctctggccctttctcctggctttcctgatctcaccgccgcccccttacccccactccccagcatgtccctcctcggccgtgggcaacccctccttctttggggacacacctctctcaccaagttgtgtttccccaaggcctttgagggtcacagtagtacatttctcactttgattatgaggggatacaccctcttaatctaagacaaaccaccaccaccattatactgaatttaaaccagtcaagaagttcaacccttccagctatggaagccaaggtatgttctcactttgtcttggtgcatttgatttctctgaagataccctcagatgctctaatttgagaaaatactagaaagtgtgcatttacaggtgaccatccctctgctctgttgtgacttttataaggtctagttgttcttgatatgcagactaatctgtaaggaagatgagcatgggggagagaagaaagacgcattattcactggaaaacagcatcgtgtattttagcaaggagagcgtgctggtgttgatctgatatcaccccaatacttaggaggaattgagttagagatacatttgtagcttgaagagttgcttatttgataagttatcggagtgtgtttcaaagacattatgcctatgtgaaagtaaagatggagttgtttatctctgtatctccttgtcctgtttctcccaggacttggcagaactcttgatggcaagaatctaatctttgtcctacttgtaactgcagtgcctggcagtttgccctgtccatattcatagagctaaagaaacatttgttataaatgaagaaatcccccagagagaaagctatagagaactgacctggaacaatttacttacctgctgggagacgctagtcttgccccagatgttcaatgcctgcactggtctatttgcaggtgcaggggaggcttctgctgtcctggggaaaaaatacccatgtcttcagccagccacaattcaattactctagaccagtgtatccgaagcttgagtgtacagcagaatccccaggaggatttgtttaagtactcattgctaggcgtactaccctggtttctaactcagttaggtatattaatttcctagggctgccataacaaatcactgtaatgttgatgtttaaagcaacagaaacttattctctagcttctggaagccagaagccaaaatcaaggtgttgccaaggcatgctccctttaaaggctccaggggaggatccttccttgcctcttccagctcctggtggctccagggattccatggcctcagctgcatcattttcatctctgcctttgtttttacgtggcctcctcctcttctctttctcaaatgtccctctgcctttctgttacaaagacatttgctattggatttaggaccttcctagataatccaggatggtctcatctcatcttgagattcttcattacatctgcaaagacacacccccacttattttccaaataagattcatgcacaggttccagggataaggacatagaggtatcttttagggagccaccattcaattcatggcagtagacctggaatatggggcctgagattatgcttttttgtacttctaacatgttcacagttgatgctaaaagttgctcagaggttggaatatgagagcttggactgctgctccaaagagagagaaaataatacaatgccttctttgaaatagcaccttttcagaagagttcttaaaatagattttatctcatgggattgatttattgtgcccattaagccagatgcatagctcttctactagaattaattttaaagttgctaacccttaattatttgcagagataggacaaaaaatgttggaagcaatttggaaatagtctttatgttcagtccataatggatgctatttacaacaatggctgtttcatattctcatataaatgatgaagctaacactcaaagccatagaccattcaaatgctttatatcctaaaaaggatacaaagaccatcagaccataaattgtgatttttcattgccatggcatgtttcaatagatggtttgtttctgtagaaagaacagttaattctggactcagatcctgaacatgctccttttttggctatgagaatttgggtcttagttttcttgtctaaacagtgtgggtgataatattttgtcctaataattagcaggcttattatgatgatcaattaagagtactttgtaaactgtcaagtgttttgaaatatgttacttctgtaatgacaaggttgaaaataaatataactggagctaattcatagaaatctgtgtactaaagatagatcttaagaaaaattttcgtccaaagtgtatttgcttactgcagccctttcagcttctcccatctgtcagatggcctttctcaaatgtgaccactatgtctctctcccatcccacatggtcttcttcagtgtgaccttgacgatctttcattgagatatggggactttgtctcatcctcttggatctcagtggatcaaggactcactcgtaaccagtagaatgatgtgtgacttctgagatgaggtcataaaaggccatgcagctttctccttgttcgctgggaatcttgcttttggagtccgtctgcttgaaagccaccatgttgtgaggaagcccaaactaaaccacgctagactctgggctccaggagagcacagactcctttgctttgtcctcaccattttaccccccgccgcatttagcacagtgcctcacacaagcaggcattcaaacagctgtgagagtgaagaaacaaaaggaggttgtacccaactcattctaatatgctctcaagtttaaatatgtgatgtaaataggacattataagaacaaacaccaaaaaaccacctatgtgttgcaaaagttaacattattaatcctctagaattgtatggtgcctaatggttacatctgttttcttaatcgttcccttataatgcctgtcttatagtactgccaagaattagaagggaaggagcatgctgaggcctagataattctgatgggtttttttttttcttttttggaaaggatttaacagatattagagaaaacttagagggagtcttgggactccttgatggccacgaaagggatgacttttaaagaaatcgatccagaaatgtctatgtggctgccctttctcttctcgttgtaaattttctcacagtgaacacaggtgttagagatcaagtgtttggctttctggtgctctgatgcaggaagtttgttttctcaggcaggcttctcagctcttgcacagtagcctatgggttgggacggctaccggatggcccaactccaggatggggtcatagtgcggagctctgtgagtggtgccccctagaggaaacttcctgaaggaatgaagcttcctgaactcatgcaatttggcaaccctgggttctccccaatgctttcaagacatagtaggttggagcaaaagtaattgcagtttttgccattgaaagtaatgtcagttacttttgcaccaacctaatacaaaccatcccatatctgtgttctccatcctttcatcctttatcacagtggggttgtgatagatccctgaaaacacaggatcaagtataggtaaatgcaagatggtacatagaatcaagtgtgaaagtgagtcccatcaacccacactctttccatttggcccagttgctgcccttgttgtttagaatggcacgtacctggccttgaaatgcactgaagcctatggggattactttaaaattcggtcctgtaagccagtctgttagtatcattgctcctactaatgatagaaattgctggtgttggccgggtgtggtggctcacaccagtaatccaagcactttggcagacggaggtgaagggatcacttgaggccaggagttcgagccagcctggccaacgtggtgaaaccccgtctgtgcttaaaaaatacaaaaaattggccaaatgcagtggctcacacctataatcccagcactttgggaagccgaggtgggtggatcacctgaggtcaggagttcaagaccagcctggccaatatggccaaagcccgtctctaccaaaaatacaaaaattggtgtggtggtgtgtgcgcctgtaatcccagctactttggggggctgaggcaggagaatcgcttgaacccaggaggcagaggttgcagtaagccgagatcacgccattgcactccagcctgagtgacagagtgagactccatctcaaaaaaaaaaaaagaaaaaagattatataaaaaattaaaaaattagccaggcgtggtaggcgtggtgggaagctgaggtgggagaatcgtttgaacctgggaggcagaggttgcagtgagctgagatcgcatcactgcactccagcctgggtaacagagcaagactccgtctcaaaataaaataaagtaaaataaaataaaaataatctgtggtttttcctcagcatgccctttatgaactgaattatacaaattatatactttaaacctcacaacaacctcatgaagtgtatataccagtaatattcccattttatggacaaaaaaaagagaaaaaaaatagaggcaccaagaggatcttacccaaggatgcgtgactggtaagtagcagagctagaatttgaacccaatctgttaaacagttccctcaacaaagaattatctcattttgtgcttgactctcaagcattcatgtaggtgaaaaacttctttagaattctctgagccaagaacctagctctttgtataaacattttttgtatgattttaatctgcactgaatatattcgtttcagtctcatattcatctggagacccctccagagcttgaggtcttgagaagtcctggggctccagtggccactaaagcaatgacttttcaaaagaaaagaaatgtttcctgagtgtagatgttgctatcttttttctttctcattgtatacttccttgtagagtacataggtgttagaggtcagatctggagggattttgtatccaggaggttaccttgaactttgatgctgtacactagcctagtattattattattgttgttattatcattactcctactattactcctcctcttgctgctgctgctaaagtagcaaaactgtctggctcccggagcgccacctattgaccatatagtttgccacctgtctcagttttgtgccatgcatgagctcatcctcaccaattattggcaagattatagaacaggacacagagtgattcaccttcagtatagctcccactagtgtgttgctcttatcccacaagaacgtgactatccaggattccttaaatccaccaggctctgagccagactgcatttaccaatccacagaaatagtgcagaccaattccttttgtgaaaattaacatatattttgtctatggccttctcttcatcacttgccccagcaagtctctcctcaaaggatagtcagtttggcatgatttatgtatgacgaacccaggtagactaccataactcactgttctcattgataaatcgttgataatatatgccttgtaagttggtgctgtttggatggcatgactaaagtcaagcattagcatagtgcccaacactcaggaatctggcagaaagtcaaaagttacaccgatcagtgtcattattagtatgcaatttcattcttagtcttcttgggatttaattgtattacctaatttatgtaatgagactatattttcttttctgtcccatttctattaaacttagatacgtccccttctccttgcttatggaatcaaatttttaaattaatttgatttgggttctattttctaatcccatcaataaccagctacaatctgcccttcaggaggacgctgcttcttaaagcatgtctgagctcccctagccaccctgatttataatgtgatatttaacaccctcagctgcttctgaagcccaaggggcaaactggttacctagcaaccacatacacacactagctcatggcgcaggttagccccattttgttataatgaaataatacgtcttgtgagaatgaaaagctaaggtacactatatgaggttagtgttttggagaaaaatgggctctttaggacagattagcaaagcaggagttgtgtgggtcaccccctgcttcacagtgactcaccacttcctagaatggaagtcacgaccttgaaatcctgagacttggaggaaatagaggatatgtttgatgtactgaactgtctttaaaaataatgtaaatttagcactttgggaggccgaggcgggtggatcacgaggtcaggagatcgagagcatcctggctaacacggtgaaaccccatctctactaaaaacacaaaaaattagccaggtgtggtcgcgcgcgcctgtagtcccagccactcaggaggctgagacaggagagtggcgtgaacctgggaggcagagcttgcagtgacccgagatggcacaattgcagtccactctgggcgacagagcgagactccgtctcaaaaataataataataataataataatgtaaatgtagaaacctttgggggagtgagcagtccccagtggaagtataatttccaggctatctcacacaagcctgcttggccccaggacatcctgttgtgatggagaacatcataaagctcctccaccaacatggaatccatagagaatattcttacctagatacaaaaagttcagtattctatcatgactttaatataagggaaaaataaaaggaaggtgatttacaataaaagaatgcacacttgaaatgttcgggcatgactacacaagaagatataatgacacagccaaatgtttgcacctatgtgtaataaatcaacttgaatttaggagaagtaagatgattcagaaatgcatttctttttttccagtgtctcttctacagaatattttctgaatcataatcattgcagattaaaaatcccacaaaaaatgttcatacaaggagtcaggctcttggctcagaaaattctgaagaagtttctcgcctccatgaatgcttaaagagtcaaatacaaaatgagataatcctttgttgggggaactgttcacgtttcagaacttttggcatcctttgctccacctgcagagagccaacaaaatccttcactaattttaggaaccaaaaaacaaatttccccacttctcagtacagccttcaatactggtctgtcatttctgcctgaccttgtttcttctcccaacacatctatccatttgttgattcattcactggttatgcttataacgttgtcattatatccttgtctcagttttcttatcagtaagggtaagcagcttcgcagaattttaggaaggattaagtgatgcgtgcaaaatacttagagcccacaagaagaacttgattaatgttgttcttattattgctgtattgaatgtatcctttagtactttctttttgtatagtaccatatggcatagatgtgtgtgcacacaccccctcacacacaaatacacacaccaaatatttcaaaggaatatatagtgaaaattcctcctatgtgcctaaatcttcctcggtacccttccccagaacagccactgtgtcttcccagaaattgtgttaagaaacaaacatgtatatccttttgtgctgtgttttgtagaagtggaagctttctgtgcagccagttttgcattgtgttcctcaccaacaggatctgtcggacgccgtgtatatagttcttcctcattctctttaatggctatgtgatgttgcattttatggatgaaccataatcctcaaaaacattcgttaggttgtgttgataacatagaaatgtctaaagcagtgaacaaagtagcccattatctcaggacccagataaccaagttaacatttttttagcaaaataaaagtagaagatgcagatgataaaagtaaaagcaggtcagtaacagtacagtaagaaaagtagaaatctcctgtcattttctgaagtcccaatccctctagctctcaaaaaaaaaaaaaatcttaacaattctatgtgcattctttcaggaaaaaagcaagatagaatatggatatactagctgtgtaagtagctgtgtaagtagctttgtaggctgaaaaaagcttatcccccatccccctggaagatgtgcaagtactaattcctggggcctgtgaatgttagcttagattgcaaaagggactgtgaaggtgtgattgagttaaggatcttgatttaaagaagttagtctgatacgcccaatgtaaccacaagggtccttataagaggctcaccagtggtcagagaggaaaggtgatgttgtcctgctggctttgaagttggaggaagaggccatgtgccaagagatgccagcagcacctagaagcaggaaaaggtaagggaacctcatgtcactagaaggaatgtagccctttggattcattttagactcccgacctccagaactgtcagagaatacatttgtgttgttttaagccaccaaatctgtgataatctgttacagccgtaggaaggtaatattttagcgaatatttttatttgcataagtaccacactctgtatgtgcactgagttgttctttactaatagtgccatgttatctaatttttcacaggcatattcctttctcccaaattaggtttacaagcaccttggaggcagaggctgtggttggtatcacgttgcattcctcccggctcttctctcagcaggaggaaatatagctgcttagttaaaaataaaaaaggattctgaaggcacacagttcaaagttagaacaggcagccaatgcgtttgatgtccttgagccacatgccctcagcccacctggatctcggctgcagctgcattgggcactcccaccttcttccagcagcttctccccgcttttccaggaccaagaaaattctttgccagcacatagtagccccaaatcaaggaagctaatgtcctcagaggtgacctccagccagtggggacaggggtcagtggatcaatgcccaggcccctgtctatgaaagggcaattctgagatgtgctctctgcaggtccccagtaggactgagctgcggtagcgcccggtggtaaccagcttagccacacagctgtaagaaatagttttctccttccttatctccctcttctgccttctcctacctgcttcctgaatctcccaccatcctcaaaagcacgcctacactcaagtctttgtctcaggctcagcctggaggagcccaagttagaatggaaccccagctctctttctttccccccccgcctctctctctgtctctctcccctttctctttttctctctctctctttctttctttcagtggagtcttgcttcatcgcccaggctggagtgcaatggcacaatcttgtctcactgcaacctctgcctcctgggttccagcgattctcctgccttagcctcccaagtagttgggactacaggcgcacatgccaccacggccagctaatttttgtatttttagtagagatggggtttcaccatattggtcaagctggtcttgaactcctgacctcaggtgatccacccgcctcaacctcccaaagtgctgggattacaggtgtgagctaccacacccagccagctctgcctctttctagctgaggattctgtaacaagccagtcttctaaaactgaattttttttgtctatcaatgaagatagcagaatctacctcaatagagtattgtacagtttgaaagagataatgtatacaaagtatcttatacattgtccatagctactattgttaaaattagtttatgactattacatcatagtaattgctttctaaaaagtaacttaatgaaacacatacatcaaatgcctgatgaaagctgaattttctaaaattggtcttggccttcaaaagatttctcattccttctaccatgtatattcaacagataattttgagcgcctactgtgtgccaggcagccctctgggagcaggaagactgcagtgagcaaagcaaacaaaactcccattttcctatgtcagatgcaagtggactcattcagcacatgctatttgcatcctggaggtatcaaggcaaagaaaacacagtttttgcctccagaggcataatcttacctcctgcccgtttatttgaaatacacacagttgaaatattgttgtaggtttatcgattttctatatgtttattaggctcctgctatatgccaagtactgtggttagcaccatcctcatataaacattatcatcttagcccctgaacttaaggaaatgtccaggctgctaaagcagatctgtgaaaaagctcagcctgctttttttcagctagactactatgactctagctcagaaaaaaaattatttctaatcactggttctaatacaaataaaatgtagtgattcattaatctccttagcctataattgcaaattgagttttctttcaaatatacctaaagaaggtaggtgcccactaaacatttcaggggagttttatttaagctgcaaataaaattagtttactcatttttaatttaattcccaggaggcattttggaaaccttccctcctcatttgacccaaaatcatttttaaaaattattgttctcctaaattgaagccctttccagcattgcgcattagaagtcttaaaactcatctgttttctttttgtaattgacttacaaatgcgtaatcgactcacaaatgtataactgagtatgcatggcattttaaaagggcagagtttccatttgcttcttgatttctttgggggttctcattttcctaagccctcttcccacaacattcccagtcattccttgggtcatctctcaggtgtcaccaccctgctagcatcttaatggagcggctgtgtctcctcccagcagcagtggcaccagaagatttagctgtgttggggacaacgttcagaatcctcatttgctgctaaagatgtacccggtctcattctcctgacacatggatgatgatcttgtgacccgtgtgactatgactgtatcactctgatcatcactagaacaataagtaatctaaataataagaaattctgcatgttccattgacaaaactgggaacactgcacacacatacacatattcacacaaaccatatacagtcacgtgtcactcaacaatgggtataccttctgagaaggtatcattagatgatttgtcattgtgcaaacatcatatagtgcacttacgcaaatctagatggtatattctgctacatgcctatcctgtatgacattgcctcttgcgcctaggctacaaacctgtacggctgttactctattgaatactgtaaacaattataacacaacagtaaatatgtgtgtatctaaacatagaaaagataccataaaaatacagtataaaatatttaaaatggtatccctgtataggaaagctcgattataatctaatgagacaactttcctatatgtggcccatcattgactgatatattgttatccagcaatgactgtacttaagtaactttaatagaagcatgaagaatgtagtagttgtcatttgaaaagggccttgctaaatgtaaccttcagttaaagcaagtcagcctagtggaggatggtggctgctcatgttgtcttatgtggatataaacctatatatccccactaagtgtgaaaagatgtcatgcaccaggaagcatgcaggagacttggtaaggagacagagggatgcagagactaagcccaaggctgggagcacaaggcttccttccttggtccaggtgtttctgcatgggaacagaagattggtgtctgcttttcagtgacgtggctgaatcagagtgagtgagtgggtggtttattgttggtttccacagatgctgatgctgaggcaagaaatcaagtcaaaattggtttattttgggaggtacaggaaacaccagtagaaaagtgaggaaataagacaggggagggaaggcagccaataacgtaaccagccagctgctttcatgagagactggagcatcgtcccaccaggaaacaataaaaaatagtgtaaaaacgcataagcttcagagaaagatatgggagctggggagtggatatgccaatcccattcttgactgattgaaggctgctgctagggacattaatcccccagcactcctgggctaccatgtgccaagcagagctgcctgctgtgcctttggggaaagccctcatgcagcgacacggggcaatggtagttgtctgccttgtgaaggagtaagacccggggctatgactagggtatcagcagagcctgctccaagaatggttaagggtttggtttgggacatgtagagttcaagcaacctgggaggcacctaggtgatgtgactcagacctctgtcaatactggctggagtttcaccatcaatattgatctgttgagtaatctacccattgtatgtgctttatagtgactgaattaccaacatgcatctgcctagcctatttccctcttcaaaatggcatctcccacacatgaaacttcctccttgattatatcaaacaggaccaataaatcattcagcttttccccagaagtgggatgttgagtggtacaatccatgatgtgccatttctcaacaaggcagatgatatttgattcttgggatatcagtaagtctgggttatttaactggctttttttctaaatcctgacttgtgtccagttgcttaaccagatttagaagaagccatgtttacatggaatttctgaattacaagctgagaaatgtttccagaagatattttaaagcctccttaagaaggctagtgggccttatttcctgtgtgaaacaacttttatcaaaatgtatttgacactgggagtgtgggtgaactggtgaaaaggtccctgagagttcgggtccctgagagttgcaagcacaaatcctgttaacaggtaataagattatgagcatagcccatgtagagcgcatggttttatcagctgaagtgaagcaccaagatgccaagttgttaatggaattcagcatctgtgtctttcatgggtctctaaatagacaaggttcaatgctacccaaatttcctgcagaatcaaaaccacgttcgcctttggaatgggtatttatttattgcttttactctggggaaaaaggcttttttactttataacctttttatctcttatacagcaatttccttccatcttctaaaaatgttagaaaataaagcaaatatgaaaattcatgttgcatttctaagcatctgaccacaatctatagatcaagataatgccagactctaatttcagtgtttagcaaggttactggcaaatagcatttgagaaaagagaaaaaatagtatattgaaggcaatacccaccccctatattttgtattaccatcttttgtaagctctggtcatgcaatgctatcataggatatttttccttccttcttttatgtctttttgggtcattttaaatataccccatttatatatgctactcatagaaattagttctttattctccattgaacttttctgaaaagtattataaagaaggttcaatttaattatgttcaagtaactgagtcgttggcaatcagctgccaacattttgattgttttcttgtgggattcagtcctagtattgagtgcccactaacaactgccaaatttagtcatccaaatcaccacgacaataagctccaggtattgaaacatcaagactgaagccaccacttacgatccaatcaacctttttaactgtcagtgcttccagtctttgccgaaatacacagcattaaaattcataagtcaacccatgtccgtgcgtgctttttctctcccatatccagttggtcacttgcttcatgctgatccatccatagcggtcgtggtccacactccagccctcctttacatcctccagacagatagggttctttctatggcttaaaggtgccaacctcattcctgtctcagggacctcacacaattgctcctttagcctgaaacaatcacccactaatctctgcatagctgagaccaccttgttattcaggtcttacctgaaatgtagcttcctcagagaggtcttgtctggttaccccactgaaattagcatccccctttactgtgttccattaaacctcccacttttctttcttttgaagcatttaccatcatccacaagcatccaatgtatatcaccgttgtgtggtttattgttggcttcttcattgctagaccaagagctccatgaaagcatgggccttgtctctcttgttctcagtgaaatcatatgtgctcaatatgggggttagcacatagtcaatgaatattcaaattcattcatttaaatatttaaatatttaaaaaataaatattgagatacactaccattcatttggcacacagcacatgctacttttaattgtgatggctcaaataacctatgatactgcaaagaccatttttatgcccttataggtcatgtagtaccttttgttctctgatatgtccctagtacacattacagtgtttcacacagagtaggcacttaaacataccagctagtggatagtgtgatgatgccaggaagtaatatacaagggtaggaaactaacaagtatggagcatctcatatgtgtactggcatctgacttctcatttagtcctcataacaagtttataaggtagatagtaacatcccacattacagaggaaaaacacgagcttgtaattgcatgataagcgcataaggagcaaatctggaatccaagcctgtgttctctgcagggtgccattgtgctactgacagtgtgctaagtttaggttctctgtggatgtttgtgaaggaggcacagggaggcaaggagagccacaagctcatggctctatggctggaacttcataccattaatgaccacttaagaacgtgctgaatgcacctatgcatgtggaatcatgtacttccttttcacattgtaaatgtgtctacaaaggccaggcatggtagctcactcctgtaatcccagcactttgggaggccaaggctgatggatcacttgaggtcaggagttcgagaccagcttggccaacacggtgaaaccccatctctactaaaaatacaaaaattagtcaggcatggtggcagacgtctgcaggctcagctacttgggatgctgaggcaggagaatcgcttgaacctaggaggcagaggttgcaatgagccaagttcacagcaatgcactccagcctgggtgactgagttagactaggtctcaaaaaataaaaataaaaatgaataaataaataaatgtgtctacaaacagaggtttttgagagtcaggcataagcccccaccttagtgatactgatgcagccacctcgaaatgggaggtgggtcacccatctttatttgtggtccccgaagaaagaagatctcagcggggagaaggtggggtggggcacatcaactccttgcaggtagacactctgacaagaatgtatgcactactcaaaatgtttcttacccatggttcctaatacggtgaagtcatgagcccccttaagacccagtgaaagtggaacaattccacgtgcacataagccatgcatttacgatttcaggacatctttgaacccagggcaagaactgcagctttgggaaattcccagaacagtaaacagtgtaaattctcaaaagggggtttatttcatgttacttccttttttaaagaaatgtaactgtgttgtattaccattagacgtaattgggtgagaaattacttataaacctgtcatcataacatagctattgttttctttgtccaatatattgacattttattccactgtgcacgtagagttctgcatttggctgtttttacttaatacatcatagcatcaaacagtggtaatgccatttcacagtctgtatttaattggaagtgttttagtataatgttattgtaatactcaaatgcaaaggcacggtgatgcagtgaagattggtttctgttttgtctaaaattattgtagaacccattaaattttgtaatgcacattctcttccatctacaggtctcccataaaatagcttcaaatctcacaatcaatgatattttaaagcagcacataagagtatttagctttaatgtgatcattgcctcaggctgtaataaaaacagaatttttccccaattattatcagtcactcctcctccatagtccatcatgataaaaccgagcgactttcattcctcaccaggcaactaatcatccctttgctgagcattcttcataaatggaatggaataaatttcattatgcaatgcggtaatgttccccaactagagatcggggtgtagcaatcttggggaaagttacagtcaagattattaaaatatatgaaacttaaagagaaatagtgtcctaatcatgcagcccataataggctgtgccaaccccacttatcctcaaaacagccctcccttaccttgccggcctcatctaaatgctgctgtctgcagtgcacggtggctcatgcctgtaatctcagcactttgggaggctgaggcgagaggatcacctgaggttgggagttcgagtccagcctggccaacatggtaaaaccccgtctctactaaaactacaaaaaaaatttgctaggtgtggtgggcacacacctgtaatctcagctactagggaggccaaggcagaaaaattgcttgaacctgggaggtgcaggttgcagtaagctgagatcactcaccactgtactccagcctgggcaatagagcgagactccatctcaaaaaaaacaaaaatactcttctctcttgttgtcctttgtaaacttctgaaaattagacaatacttgattcttttacttccctaacaagtacctgcttaccaacctgctatagttttatagaagtactctctgaaaaggtaccaaaaatattctcattcctacatccaatagctgtttttcttatttggttggaattttccatatgaatcaacatgctcaaccattttcttgaggatctttttgtcgtagcagttgttgtttaaaaaacaactttattaatacataattcatatactgtataattcacccatttaaaatgtgcaatttaatcttttaaagtatattcacagggtgatgcaaccaccaccacagtctgattttatatttttagaggaaacaaatatatatgtttatatttaaattttattttattgtgataaggacacttacctgagaccttaatagattttaagtgtacagtagtattgactctaggtacagcattgtatggcagattgctagaaccccttcatcttgtttaattgaaactttatgcctgttgattagtatctctcaagttttccctccccctagaccctgacagacaccaattcagtctttggtttgggttatatgactattttgagtacttcatgtaagtggaaccatgcagtattagtctttctgagactggtttatttcacgtcacataatgtcttcaagattcatccatgttgttgcatattgcagaatatccttcacttgtgaggttgaatcatattttattctatgtatgtgtcatatttatccactcatccatcactgaacatttaggttgtttgtacctcttgtgtattgtgaatagtgctgcagtgaacgtggtagctctccagtaatatcttcaaactatctcttgaagatcctgatttcaatatttttggacaaatacccagaagtgggttgctgggtcatatggtagaaaagttggttttttgaaaagataagcaaaattgacaaacccttagctagactaaggggaaaaaagagagaagattcaaataaataaaattagaaatgaaagagggaacattaccacttataccacagaaataaaaaggttcataagagacccctatgaacagttccctgccaaaaaaaatgaaaaaaaaacctaggtaacctagagaaaaatgagtaaattcctaaaaacatacaacctaccaagattaaatcgtgaagaaatagaaagtccgaacggacccataactcatagggagattgaatcggtaaccacaaattctcaacaaagtaaagcttaagaccagatgtttggcccaccaaacatttaaagaattgatgagaatccttctcaaactcttccgaacagctggagagggagtgacacttccaaactcattttataaagctagtattaccctgacaccaaagccagacaaacaccacaagaaaagaaaacaaaagaccaatatccctgataaatgtagaagcaaaagtccttaacaaaatactagcaaactgaatccagcagcacattaagaggatcacaggtcatgatcaagtgtgcatgggagtcaggaattgttcaacacacagaaatcaatcaatgtgatacaccacattagcagactagaaaataaaaaccacatgattgtctcagatgcagaaaaagtacttgacaaaattcagtgccctttcatgataaaaactctcaaaactaggaatagaaggaaagtacctcaacataataaaggccacatatgaaaagtccatagctaacgtcatactcaacagtgataaaactaaaagcttaccttctaagatcagaaacaagatagggatactcactgtcaccagttctattcaacatagtcctggaagtcctcacaggagcaagtaggcaagaaatagaaacaaaagggatccaaaacaggaagaagtaaaatgtcccggtttgtagacaaaatgatctcacatatagaaaataactgaagaacccattaaaaactattagaattaataaatgaatttagtaaatttgtgggatacaaaatcaacaaacaaaaattagttatgtttctatacactaacactaactgatctaaaaaggaaatcaagaaaacaatccctttacaatagtaccaaaaagaataaaatacacagtcataaacttaactaagacagtgaaagacatgtattctgaaaactacaaaacattgacgaagggaattttaaaagacacaaacagatagagatcttgtatagatggattggaagacttactattgttaaaacatccacattacccaaaattatctacagatttaatgcaatcagaatttcagtggcattttttacagaaataggaaactcagtggagcttcttccttctttttgactctcatgaccctgtcctcagcagattcacctgtgactatatctgtttctctttctgggtcttatctcttcttgtgcctctcatgtttaagtatctcccaatattcagttaataacattttctgttttctgtaggtagaaactgccatgcccacaggtcgagctatgacatgcatactgatgcctcccagaagtaccacttcaatctctgacctccctcctgagcatccagatttgaatttgcatctttctgtgagcatctccaagtagatgtccttcaggcactattcataggttgaaaagagtgcagagcagaaagatgaataaaagcacaaatgctggggtcaaatctctgagattcaaatcctggctctgccactaaatagctatatgtctttaagccacctaattaacctctctgtgcctaaggattctcatcagtaagatggggataaaaatacttgccttataaaattattgaaatggttatgctaaaaaaaatgtgcaaagtctttagaacagtgcccggcacatgttaagtactgtttagctatcagccataattttaaaaatagtgtttttaaaatcagtaatattattgacaaccttttctgaatattgtccaagtgctttacagggattatttcacttatcatgggaatgatcctatgagatagccactgttattattcctactttacagatgaggaaaagagaggttaattagcccaaggacacacagtttccccaagatcaaagagtcagtggtggggccataatttaaaccagggcagtctgacttcagatccacacttttgacctgggcttccctgctcaattacaaataccaaattgactccttatcttctccccagaacagcctccctttccggttttctcccctttccccaagattaccattacagcccctttctttttcacctgtgaattagcaaatgctgcacccagaatctttcctccacctctaccccattctcttcttgctgccctgactagttgaactgtcctctttatcttaacctgtcgtgacaccacctccctggtcaccgtgctcttgccttcttgccttcttgcctttccaatttatcctgctcactgacacctcagttgccatttggaaacgaaaatagaattttcagcttgataacattaaggcagagatgttgcagcaaacaaacacttcagcaggcaagacaaatatgtttcagatattttttagcagctagagaaactccaaagcaacagccagtgatttagaacagaggctcctcttacgaagcagacaggctgtagagatagaattcaaggctcagcagacatgtatctcctgttatataagcaatcagaattctcttttccaattgaacaaatccctctctgctttgatggggaaactgggatgtcagtttccctaaaatgaaaattctatttcacagcaaaatggttccagtcaactggagagagagagaaagagaaatcataactgttttcccctccccagcctagcatcctccccacccccttaacatggaaaactcctatacatcctttaaagcccagggaaaatgtgtcttttctgttgaagccctttgtcaactcttccagacactttctcctttttaatcatgcagtagaacatggcagttaggaaaatgggctctttggaaaatattcagtgttcaaatgctgattttgctattcattagctacatggctgtcagcaagttgcctcgtcttactgtgctacacttttcctcatttgaaaaatggagggcggtctcacctctctttttatatgtgattatttggaggattaaaagggaaaaattatgaaaagcatttagctcagcagctggcacttgtcagtacccagtaactgttaccagctgaattttatagccataaaataaatacaagcatcctagaaaattataatacccataggaagcatgagattttttttccaaattaagaaaaaagatatagtagtcttggagtagtttctcttcctcttaaaggaaaaataaaatgtcagactttcttacattctcataggtcagtaggttgttcctatagctatggggacaatatagtgagggtatgaggcagacttcaagttacaagttagggtttgatccgatgtcttggacatttgcttggatctgtacaaaccaggattctgtccaagaactcctttgatgaggaagtgttgctagaacttggcctatgagctctgcctgctgggaattagttttagcaaagagagagagagagagacagagaatatcatggtgatgagtgctaggacattgtcaaggctcttttaagtgtgaccaccaggggacagcaggaaagacaggagaagacctagagttcaacttggagtactgaaagccttccctttccttcttttctctctgtgaaggttgttttccttctttggggagttgcaggcccatttggtaaatgaagtgtcatatggagaattttcagcagatgcttctcttctgatagggaatggcaaagccccctaaattcatgaaacatatgcaggtgccagccaactttgcactgccttcatgacacctcatctgttttctcaaacagccaagcagcactctgtgcccttagtgaagtaagggggaataggggccaaaagggcagcgtgaagacctaactgttgtcctccctgacagctgtcgttttgtgatgctgctgcttgcttttcatgaaatctgtgaccagctccatccctatcgtgccccctgcctctgtaaccagatttttgagtctacatataggtttactgagatgacatttacttattcattgattctgtctttggaagatgcctcttccacccatacaaggtatgctgaataattggtactcagaagtgtaattagccacacatataagacatcagaactactatatgggaggcccaatgactgatcatgaatatacacagtgagagaaatgtcagtcttgtgtgaattatcttatttaaacccctcagccaccaataagttaccttctacttttacatccttagatcaggagtaagattccaagttctataatgatagccaaccaagacattacagaacaattgccatgctctaccagtagtaatacctgacatttattgagccaataatatctagaccatggctgtagcatatttcctacatagaggggaatttactcaacaccattcttgatcagctgcccaaaccccgcagtattatataaagtgacttccctgacaagttgccccaaggcattcccataagtgtactggcattgtggttatatactatgaaatatatattataaaatgcatttttctctgctcatgttttccagcaggtttaggagtcacctaaaattattgaacatcttgcttccaaacaaaataaactgtattacacattcagctctacataataacaggaatttcttttctctgaatcgtccaatctttttttttttttaaaaaaaagttttgtatgtatgtgtgttctgaatactatatgcatagattttagcttgagagaactgattaactcacattgcatcttgggaggcagattagctaggcatcagttttaaagaattagatttaaatagagggcaaagaatttcccagaaaagatgagcagaataaaaaatataaaagagaaattctcaagatcaggacatagagctaggttccatagatgctacaaattgaaatgaaccttgatcctactctcaaggaactaaatcgagctgtcacaatctctatgaagcaattgtagaggtaattaaaaatatgactgaggtagtcacaattgagagcatcaactaaggtcagtgaaaattggagcaggaggtctggctagacacaaatttgggagattcgaagcagttgaattctcaagcagcgttcagacacagagattaatgctggtcaaaggaaaaattgttcagtaccaaggacagctccctagaaagcttttattcccatagatctctgggcagagaccacaggagtattttggtagctgtgctctctctcgtaatagttcattgcacaagcattctcatgtgataatgtgtgcacatgacagcatcttttacgtaccgattaaattaccagtggtaccattatcattgtattacggttctgcagagggacagagctaataggatatgtgtatatataaaaggatatttatcagagataattcacccacgtgattacaaggtaaagtcccactataggccatctgcaagctggggaacagagaagtccatagtggctcagtccgaatccgagagccccaaaactagggaaaccaacaatgcaaccttcagtctgtggccaaaggcccgagagctcctggcaagtcactggtgaaagtcccagagtccaaaggctgaagaatgtgaagtctgatgttcaagggcaagaggaacaggaggaagcatctagcaggggaaaaagaagtaagacggaagacccagcaagcaaggttatcacaccttcttctgcctgctttgttctagccatgccgacagccagctggatggtgtccacccacaatgagggtgggtctttctctccctgtccacagtaaaagctgtgtaagtggataagattaataagggataatgtgaagggagatgagaacaagggctacatctagaacctaggaggaacactcatattccagtactggaggagaaagtggcataagtctagaacccttccagagaaggagaaaactctcaggaaagtataggattagtgaggtgaagagaagaataaatatccagaagagggttaattgtttaagctatattaagctgcaaataaatgaattccagtactagattaaacaataaataaatgtaattaattcatataaagtgattgaaggtaggcagttaagagtgtttcagcagtgtttcagcagctcatcataatattatgaatcttagctctctacatctttccaattaattatcctctgcatgttgacttcttgtccctgtgtttattgcctgatggttgcaagacggctgatgcaactctagacacatcaagatcatgttgaaatgaaatgagatgagagtgggcaatggagagaagattcatgatcttttcttccatcaggaaagaaaatcctttccagaagttcctatagacttcttatgatttttaattattcaggaccagattacatggccacccctactgttgaggagactaatgaagtatttggcttttccaggctttgttgttagcgtccagtaaggatgcaattggaaatggactttgtggtgaacagccaacaagattggccacagtggaattaacgacatcagtgttctttcagacattgaaatgctttttccataattagttcttttgaataagctgataaaatagtcaagattacccaaagcaccttctcatgaaagcaggaaacaaagttttggcaatccttagccatgatattttggttgctaaaattgatggcatttcttactttttaaaaaactgtcatatgaacaagtgtttagttcatctttttctcatatgaaagttaagttctgacttattcatgttggtctcagtttttaagaatcaatcatacagaaaagttggtagattttgtggatttatagtagaactacttagctaaaaatttgtttatcatttgaaggccatgttcccctttaattagatattctagaacctctggatttttccataatactatttttcgtaagttgtactgtataaaaataattcgttttgaagatgttgtatcattgaactaaaaatcatattaatactcatccaaagaattacacagtcattctctttaataggggaacttaagaaccagaactgtttcctatgatgtttaggagacattcagtgaattttgatcatgatgaactagaacatccaattctaagttggacactggtctcagaaagaatgctggctgcagaggtctttgagataatgaatcatctggtttcttatagtattaatgcttataattagagacagaaaagagtttaatttcttgcacgaattaattaatacttacgataaatgtcttgaaagctctttctggtgtctggttcaaaaattgcagttcttgaggtctgttaattccttctaaaatggaaaagctggtaaaggttgtgacactgctgctaaagtgatctgtgaattagaggacgtttgacttctcctctgacctctaagctcatgtggccatttgcttgcatgacctctcattgagattacccaaagttgccccaactttaaaaggaagataataacagtactttcctcatgagcctgttttgataattacataagatgcttagaaaagtgcctgggacacaatgaacactcagaaatgttgggtaggaacaatggttatgatgatcatgataaaggaggaggaggagaatttggcaattatttcctgagtacccactatatgtaaaacactatgccaaatactaggaatacaaaggtaaattagacatgcaagatttacgttccagaaagcttcatttttgtgttctctaattctgtacatgtctttcttccatttataatgtagatttacatgtaacagcaaactcactggaaatgtgtttccccccattttctgctatattgaccctgtatgtagaaataaccagggtcccacaaaaatctgttttgttttctttattgatgagcacagtttaagaattgtgtaagtcctcagtagcctctaaagtatttcaggcattttcaacatgacatgtcaacactcacccaagagaccatcttttaactaagtcgttattgaaagttctcattttgttcacttcttcagaaaattcaaagaagaaaaaaagcctaaagccactcactcgttgctctttcaatggcatcaccattgtgtgatctgtcttcttctgctagaaggaaattccaggaatccttgatctcgcatcttttaaactgatttcacagagggtatccctgacagcatttaaaaaaaaaaagcaagcaagaaaaacctcaaatgggtagaatttttctaaaagtctgaaataaaagtttataactgattttcaggtttcctattattacctaggcacacctaaatgaatacttgaagaatggggttgtaaatactcccagaggcaactgcagcaatcatgatcatatgtctgttgcagtggaattctttagtataaattattgtatattaaaccctaataaatatgtaggatcaaaacatgtgtttctggttgtggggactgcaagatgtgcaagtccccttgtccctgttctggtggcccttgagcattcctgccaatctttggaacttcagagaatgccagagttgtggggaaagataattcttactttctacccccatttccctccgtcctatggcagtctgggacgtggctgtacactataactaaactttaagacatctacaagtaagaaacgtgaataagaacttcacctgggaaaccagtctagaagagggaaatccaacatggactgaacagtctagaagagggaaatccaacacgtactgaacagtctagaagagggaaatccaacagggactgaaaagtctagaagagggaaatccaaaacgtactgaacagtctagaagagggaaatccaacatggactgaaaagtctagaagagggaaatctaacacgtactgaacagtctagaagggggaaatccaatgtggactgaacagtctagaagaggaaaatccaacatggactggacagtctagaagaggaaaatccaacatggactggacagtctagaagagggaaatccagcatggactgctgtgcaccagcctacatcatagtcacgtggttagcattggttgcatatctgcagtagcctagagtttaatcacacaagcagccttggagctttagttaatttcagttgttcaaactagttggatttatgaaggccttgccatgcccttcatcccccacttttgaagcctctcttgattattttttttaagctgctgtggtaagaggtaattctggatggaatattagttagactgaggcaaactaatataaataatattggactattaattttggaagggtcactaagccccctcaaaaataaaaaggaagaaattacacattttcataaatggttttgcaagaatgaaaaagtaatctttagtcctagacaaatgctcttggaacattattgtataatttctggttcttttctctctcgactgtagttatttcacacacattacagatgaagccactgtatcagtcagagaccaattttaatcccaaggttgattagacaggtagctcttcgcagcttgtgcactctccctttgttctacagccctacactcacacagacaaagatttacacacaagtaaggatttggcctgattcgttagtggaacatcctgatgaacacttggttgcatttaaccttttgctgcaacaaaaagtcccaaggttgccatagtaatgggaaattaaatccacagagctattccttttcccttagtggttctggcatgctatcacaccatagcatgcttacaacctcggtcaagaaagagctgtgatcccaccgtttgtccatcgagttctaagctatggtatttgtaaaaggtcattctgctctcccgacattaacctgaatggaacagctggaacgtaaattggaaggaggagtgatgattctccctttggccatttgatgacttgggaattaaatgggacccaatatgtcatctaacgttagttccagccagtgtttcagccacaggacatctcggaaaggtggtcatttggctcttgcctgaagcaatcgaggaaggagagcccagttctggaattagacaattattgttcttacccttgaaccagccacttacctgctgcgttcccactcttggccaggggccaattaatgaatgaaacaagctccctgcactcaggaggctcacagagaagatgatccagtttatgctaccgcatctccaccataactccccttttagctcattaactccctcaaaaatatccttctgctaattcctctcccttcccctctcttccactgttgcctttggagctttcactttatcctaaacttctttatgtctttagtcatctcctagaacacacatttcctcacctttagagaaacttgactctttcttcaactaatctgcagtgttcaaatatgaatacctttctgtctttccttctttctttctctttttctttcttcctttgtctctttcttcttcctcctttacttcctttctttttttctttctcccttccttccatttattcattcaacaattatttataagggacttaatatgtgcccagcactgttctaggcactacagatacagcattgaaccaccccaattaagcttgcattctactggggagaatgaaaataaaattaaaattaaaatgagatatatagtaaattaaattagaaatgcagtagggtttctttttaagtggaggtggtcctttctcctatcctcccaacttcttaactccaatgtttcaaagctaggaggagaaatcagtattcccagggaccctttggaagaacctttcttctttcaccctctttcatccattccttctctgaagctcatgccatctgattaatcacactatgttcactcctcccagcctctgggtttccaccctaatgcattgagattctagggctctggattctggttcagttttcctgtctcctttcagcatttgagtgatttctgcatccgatttgaagggtcagtttcttggttttcattattccaataatgtttctctccccctcatttgagaagccaactcataagactaaactctagtccttgctaatatgccaactactctaattccaatatttcccaccataaatctcctcctggaccataaccttttgtttctcccaattttctctctcatggaaacaactcccatggaaacaatcacacacacacacacacacacacacacacacacactcatgtggttacctttttgccagttttccagcctcctggactgaacagtctagaagagggatccaacatggactggaagaggggaatccaacatggactgctgtgcaccagcctacatcatagtctgcctacatggtgcttggcatgtagatagaatgagagatgctgaatgatagtcctcattctccctaagcccttagtgattatgagcccctcccacttgtcctaccaaacttaaacttcttattaacatgacccatctcttttctcctctcttgctgttaaggtgtgtggtgatcacagtaatggccccccaaatatgactttgtcctaattctcagaatctataaatatgtttctttcttttttttttttttttttttttttttttttttgaagacggagtctcgcttgctctgtcgcccaggctagagtgcagtggcgtgatctcggctcactgcaagctccgcctcccaggttcacgccattctcctgccttagcctcccaggtagctggtactacaggcgcccgccaccccgcctggctaatattttgtattttgggtagagacggggtttcaccgtggtctctatcttctgacctggtgatccgcctgcctcagcctcccaaagtgctgggattacaggtgtgagccaccgcgcccggcctaaatatgtttcttacatggtcaaagaaaccttctagatgtgattaagttaaggatcttgagatggagacagtgttattgactatctggatagacccaatagaatcagaagtgtccttacaagagggatagaggagggtcagagaaagagatgtggcaatggggacagcagttagagtgatgcagccctgagccaaggaatgtgggtagcctcaagaagctggaaaaggcaagaaacgaattctcttctggagcctcctgaaggtaccagccccactaacaccttgacctaacccccatgagactgatctccaacttctgacctctaaaactataaatcatcagagttgttttaagtcactaagatggtacagttagttactgcagctgcaagagactcatataaaataccagcaccactagataacacagcaagggagtgcagtgattatggtgccttgtgccttcaggattctcctccaccctcggcaggcctggtgctactaagcacctctgcacttatggtctgctgtcctgttccaccattctctttcccagcacatcaagaaccaaccacagagttgacaagaggccacttgtaacaatgtgagcttctgttcccctaatagtattaacaattacattcctgtgactcctttcagggccgtgaagatgttccttggacccaggcaaaggcagaactgctgacagctttggctgctccatgtcacctcacttgtgaatggcgacagaaaagccagggtgatctgtagctgatcctctggtcagttccactggctcaaattaaaattttagagaatcggtctctggtatatttcccctttgcagatgacacagagagggtcatttatgttcataagttggggcgaaagctccactggctagtagcagcatttgaatagggggaaatggcaccttttgactgctcatgtttattatgggaggggaaaaatgagttttattattgaacttcatgtgaccttccatgggatccaagagggattcaatgactgagaaacacaggaaaaacagcaggcagcaaaaacagtgaactagctcaagaaatatgtttttttgtttttaaaaacattggaaacatactacaagtccctaattagtttgacctccatggttagattttttttttttaactccaatattttcctgagttgattttagctttgtttgtttttccattgacaagattcatttttaattgtgttgtcaagttagagaataggattctgcttttgaaaaaagtgcttcgtggcatggagataacaataacttttcataacttgtgatgttttgttaaataacttcctgaacgagccatggtaataagtgctagcccaagaaatcagaactttggtgcttggcatgtagagaggatgagagatgctgaatgaatgagaaataagtagatatactagaaattagtccgtaagacaaggggatggatgagattctgtatcggtttgcgattctcttcttgcctttgttcctttggggaataagctacacatatttatttgttgatgttttatggaaaatctatttggtgcgtgaattctgttgttttcttgtgaagttcattgtttcaaatctccccatcttccagtgcattcaggcactattcttggtttatttgttaaaataactgttgcactgggccaatccattacatttatctttaataaccaactctaggggtttgttcggtcatcactttccctgtcaaggggcacaaatatcttctctcatccgtttcctagggggaagtatcttcttttcttgtcttgataagacagttaccaaaggaagaaagaggaaagccttatcctttgaaagatggcattaattcatgtgcatttggcagtgggagaggatattgcagtctggggtcagctatgacttaagactttctataagactggatctgaacaagccatagcatttacgagaaggtccttttgtgtgttgtgacacagactggtatcccatttatgacaagagtggcccattttctaagattggtccagagcaggacactctttgaccaatctcaaccacctgatttcctcatgaggtacaggggacttatgcaaacctctcctttaatatggaaacctctcctttgatgacccatctttaaggaaagggttagaaccttcagtctggattttattcattatcatgtcccctatgccaggctcagagacttcctgtgattatatttgttgcatgaccattacatatacactaaaagacaatgaagacacacacacacacacacacacactcacacagcattgaagatgacccaaaagagagaaaatgaagcttgagaaaaataaaaataaattacctggtctccagccaaacaacctactcagaatgctgaggggaaggtgaccagttgtggctaatctttccttagaacttgtgctctgcttctgtaacttggcaagcacaggcccttttgtaaaatacctttataatattccactatgacatgaaccacgtttttattttattttattgtggtaagaacacttaacatgagctctaccctcttaacaaatatttttgagtagacaatccattattgtgtacacaagctatctggagcttattcagcttgccaaaagctatctagagctaattcagcttgcctggctgaaaactgatgcccattgattattaattcctcatttcccctcccttcagcccctggcaaccaccattcccctctttgagtctataaattggactgttttaggtacctcatctaagttgatctggtacagacactatgggacacagtatggagtttcctcaaaaaattaaaaatagagctaccatgtgatccagcagtttcccttctgggtatttaaaagaattgatatcaggatcttgaggacgtattagggctcctgtgttcaccacagcagtactcacaactggcaagatgtggaaccagcctaagtgtttcctgacatgcactctcttttccagtttgattaatttacagtgatcatgtttgttgcatgaagattaactatacagtaaaagacaatggagaaatacacacacatactcccacacagcattgaagaggactccaaagacagaaaacagggcataaggaaaatgaataaatgaaaaacctgatttcttggcaaacaacctaattgatgggagctaaagtagttgactcttatttacttccactttattctttaacattacaaataatagactccctgaattgaaagcaaaattaaatgtgattttatcaaacctttattcttctttttgaaatcctgcttttctatgtcttatccatagaatttccaagtctctgcttgagcattttcagtggtaaagaatttacactctcatgaaagagatcatttcactgttggtaggttgaaattgtaagaaagttctttctcaacaaggatctgaaattattcctatagtttcacccagtagtcctgtctctacttaatggtagattccacattccagatttttaaaaaagtttattctgctttcttgtctactttaatctacacaccagttcttttttttttatactttaagttttagggtacatgtgcacattgtgcaggttagttacatatgtatgcatgtgccacactggtgtgctgcacccactaactcgtcatctagcattaggtatatctcccaatgccatccctcccccctccccccacctcacaacagtccccaaagtgtgatgttccccttcctgtgtccatgtgttctcattgttcaattcccacctatgagtgagagtatgcagtgtttggttttttgttcttgcgatagtttactgagaatgatgatttccagtttcatccatgtccctacaaaggacgtgaactcatcattttttatggctgcatagtattccatggtgtatatgtgccacattttcttaatccagtctatcattgttggacatttgggttggttccgagtctttgctattgtgaataatgccgcaataaacatacgtacacaccagttcttataattgttgcatagttggctgcgttgaggagacaaccataggttagagttcttttacgatcctggtcctatctccttatcatttatttcattcattcatccaagcaggagatgatggcagagaggaaacagagcagaagtcattgtgcaaatcatggaggtctttgtaggtcattgtatcagtccgttcttgcatggctataactaactacctgaggatgggtaatttataaaaaattttttaaaaaggcttaattgggtcacagttctgcaggctgtacaggaaacacaatgctggcatcttctggggaggcctcaggaagcttccaatcatgcacgaagagaaaggaggaatgaggtatctcacatggtgagagcaggagcaaaagagagcaagaggggaagtgccacacactttcaaacaaccaggtctcataagaactcactctcatgaggatagcaccaaggggatggcactaaaccattcgcaagaattcacccccatgatctaatcgcctcccgccaggccccacctccaacactggggattactattcactgtgagatttgggtggggtcacagatccaaaccatatccatcattacgtgaacttggaatttttgcagtgatacatacggccattggcagattttgagcagaggaaagagggattcatgttttaatggatccttctggccactttgttgagggatagactggagaaggaggaaggggagaaacagagaaaccaggtagaaggcttctgcaattacccagacccaaggggatagtgtcttggacttcagtggaggcagggttgctgttgagagtggtcagattgtggtatattgccagttgcacagctggaaatttcagattccctgtgacgtgggaatcttttatccacaaggttgtcatgcatttggaataagagaaatgaattaccaacatgagctgctgggacaccatggatccgttcgaggagtatcagtagctgcagtagctccttctagtgctgtgccaggcacagaactcataccatgtcatcctataatctaccccaatggtagttaatatacccctatcacagatgaggaaactgaggccaggctcagaagtaggcttcaagtggaatgtctagcaagtggcagagtggggacctatgcctacttccacgcttgagatgttcttctggggcatggagaacagtggcaaggatcccctcctctcctcaccacagctgctgtaaacagagtgggtgaaacgagcttcaagaaaagcttttagactgaacttgagaagagtgctggcctgggactggagccaccacgtgtcacttcactctgggtggagaaaggtgtagccggctctcaggctcatgcagatgtcatgagcttccccaaagggccccaagaaaattctagaaggcagagttggatggcacaggcagctgggtctctgagatgcatcttgcacacagcctcagagcatccctgatcaggaagtgcaaacaggttgctaggaatattttcctcgatttaaaaatcaccaccacaccataaatgtgtagtgttcaaagaaaacttgcatggtcctgtttgacataacatttatgtttcttcttcatggttagggttgataagaattactttcactttacaaaacagaagccatgggctaaggagtattacttatccatgctgttgcaggaggtctcctactgaactggggtagaactttccagctcccttggctctcttactgtgtcatgcttctggggaatgagaggcacagagaagccatcagcaggtgtttactgagcacctactatgtgccagatactagactagacagaccaagtccccgtcttcctggaacttactggtagagtgttgggaccagaaaggggttgccctgagttctcgtcctggctcttgtgtgaattagtccatgactatttgcttacccaacatctcatagcttcagtttcctcaactgtaaaatgagggaaataagagtgcctctgccttccccttgaggcttgttgagtagttccaatgagtcagcaaaaaatgagaaacacgaaaaagctttgtgacttctaattcagcatttatgtgaatgtgggctatcattcattactgggaaaatgcatgaccagcggataaaccacaatgaccccatgtaaagagcatcattgtttccttggtgcacctactaattttaccaaaggcagctggcctcactccctgtgactgcaagaagttttcatgttcatttttgtgagcttggggatgagggtggtttctcctattgactcaggagtgtaaccaccagaagattcattaccccagcaggaaagaaaggggagccctctcaagtccagttgtgtggacccggtgacaaatgtggcaaacaggctgatgtagattccttgaatgtaccattagctactgccatgtcacattacacttgtttatgcaagaaccgtgcagcagataagagtgtttaaatgcctttattacatggcatcatggtattggtagtagttggtaatgatttttttttcctcagtgcaaagcacactcttaatctaaaaatatgaattatgcttagtggctcgttggaaagtatttcctttgcgttgggggggaatcaatcttttctattacttatttttctttcctttctagcaaggttaatatgcagaacattatctgatggactttattttataaggtgagaggtttcccagaagtgcagtacaaggctcattactccagtgcagaataaattgtccaaagtaatttgaaggggcatcgttaatagcccagtcttctatgtacctaagctgaggtaccaccttgccgctcaggttattgagaattgtccagcatctcaacgaactctgctccagtttcaagatggaccccattagggccaggtcatggtacaacatgggagaatcatagggcttggaattttgagacctgcgttcttgtcctacctgctccatccactggctagatagccttggctctgaacctacttccccatttgtgtgacagagatgacatgcaagatgacttcctcaagggtcatattccctgttgcctctgaaatataaagcagtgtctatctctggcgtggtccagccctgccacctctcttcaccccatctcattccactctcccatgcccactgaagtgccaatgattcaagtccacatgctgaaaaatctaacctagagtccctcctccactccctccatctcaaactcaattaaaaaaagaaaaaacagatccatccagtgtgccacagtgagataccaatcagtaatcatgtacatagcccttcctcttatccctgtcttagagccaatccatgtcccagccctgccgatgtcacccctcaatatgtctgcaatctgttgttttgtctttggttcctctgctgtcgccctaaccaaggatatgccccaatttctctcttggactctttcaacagcctcatacctggcatacctgcacctatttaaaatatatatatatgtgtgtgcgtgtgtgtgtgtgtgtgtgtgtgtgtatgtgtatttaaaataaacccctattttatttatatatataatatataaatatattttatttatatataaaacataggggttttatttatataaataaataaatatatatatatatgtatatatatacacacacacatatatgaaggaacatagggtttggaattcagagagagatatcgagagagtttcgctcctgtttttctctcaggctgaagtgcaacggcacaatctcggcttactgcaacctccacctccccagttcaagtgattctcctgcctcagccacctgagtagctgggattgcaggagcctgctaccatgtccggctaattgtatttttagcagaaacggggtttcgccttgttggccaggcttgtctcaaactcctgacttcaggtgatcaacctgtctcagcctcccaaagggctgggattacaagagtgagccactatgcctggccccctatttgacatatttttaacggtgtaggcaaaatgatcttttttccaaacactgcaatcgtgtcatccccttcaaagccttctgtggctccccgttgccccaaagcaacatctaactctgatgtggtccagccctgctgcctctctgatgtggttcagccctgctgcctctcttcactctgtctcattccactctcccacgcccactgtagtccaccctggtctccctgaacgtgccacgtgctctctccctgatctcagggtctttgttcatactgttctctctgtctgagttgcttttccctgtacctcacatctaagtccagatgactgttgctcagcctccagcttcagctcagctgtctcttcctctgataaatctttgctgtgtccctaggagaggccaagccactctgttactccctctctccgtgttcactagagttgtccttctgcatttcctgctgtctctggttggctgtctgtctccctcattgtattgcagactccgctgtgtgaagagaggaattgtgtggctaacaccaggcctggtacatagtagccactcagtatggggaatgaatgtcttacttttttaattcttcaatttaaaaagctattgagagtttgtccatgatccccaaggatacatttgacaatgtctggagggttgtcatgactcagggatgctagtggcgtctcgcaggtcaaggccaggagtgccgcttcatatcctgtagtgcaaagggcagcacccgtcacaaagaatgatttggttccaaatgtcaccagtggcaaggtggagatgccctgctctagaaactgccaaagaagctgttgccaaataaaaactatagggaacaatgcaacaaatgactcttgatctaaattccatttcattggttgtttcattctggggcaatttcgctacatatgtttcttcatattggagcttataataatgcttatgtcatagtaattctgaaggagttgtcttttttaaaaaaacgtactctctctagaggctggagagggaggatcgcttgagcctgagagttcaaggctgaagtgagttatgacggtaccagtgcctcaagcctgggtgacagagtgagaccctgaatctaattaaaaaaaaaaaattatacaatgaataatgacccaagtactgtgttgtcttcatgccatggacaccttaatgctttcttcaaagcagtatgaggttgttaatctgagaatgaatctgttagccttccctgaactcataaagtttgcttcctctttgaaagaacttagtgccttttaatgcctatgcagccgtgatgtgccaagtaatatgttccatgtgtaatcccagttttctgatagtaaaaagaaaagttggaaacctttggccaactttggtgcctgtggctgggagaccttgcagaggttttcaaggtctgctgtgaatgtatgatttagaccacagctcagttgtgacatttaatccatagagataaatcatcacctgccattggtagggctctttatggataaacaggcctaaaatagttacctgtaaaactccatcagagtctccatcagaaatcaccaccatttttttttaatgtaggagactgggatggtgaaactctttcttgattttggtgcttgagaacaaattaaatcaaagtcaaaacaactaactttcccttggctgtccttgaggcatgcttggtactgttttgtttgggtttttttttcccagtagtaggctggagttcttatggatttgattctgacatcagcctcccaggagaggccatggtgtataatggttaaaagcacagagtccagaaggtgactctcatttatcagctgtgtgaccttgggtgagttacttgacctctctgtgtctcagtttccttctttgttagatcggataatgatagtccttacctcatagaaatattataaatatgaaatgaattaatatccataaagcgtttagaacagggaacgtactcagcttaataatgtacatattcgattaataagataaaggctggccgggtacggtggctcatgcctgtaatctcagcgctttgagaggtcgagtcaggtggatcacctgagatcaggagatcgagaccatcctggctaacacagtgaaaccccgtctctactacaaatacaaaaaattagctgggcgtagtgggacatgcctgtagtcccagctactcgggaggctgaggcaggagaatcacttgaacccaggaggcagaggttgcagtgagccaagatcatgccactgcactccagcctgggagacagagcaagatcctgttccaaaaaaattaaattaaaaaaaataaaggcttcacataatatgcagccaaagtcagaaaaaaaataacattcttgactgcccttttcccatgaaccccagatccacttgatataatatgccctgatgtataatagtttggccaaagggtagaaattaatgtggaattcaacttaggagaaaaagcaaataaagattatttgttccatgtcactccaagatggccagttatcgcccaactctcttccttctgcttcctcaagatctcttccatctgcttccctccatccatcctcctggccactcccatgtgcatgctcctatcctctctgcttcagccacccacccctcaccggtctccctactctcccctgtgctagagtggactctaaagcacacacctgatgatgccactgtcctgctcaaaacccctttcatgacttaagaagcagtgtgcatcgaaatcgcagaccctagattcctttatcaaactgcctacaggagagcctgagggacttgtctgcaaagctattctggagtcagatgaaactggaatatttggtctttggtattcaccatgctccatcaccccaactgcaggaatcatttgcagctcatggacattttggatcacagggtggaagggaactgaagctccccattgttgcctaaacctaatggcaccaggtgtatattgctgacttaccttcctgtaggttgatttaggaattgaagtatgttaaaggaatacatttgagatggcacagacaatagcacctagggcagggcccggtcacagttgtctcttcataacattctaagtcgaggtatgtttattcattgaccaactccctggagtctttatttctagtacagctgctaaattcagtcattcattagtcatgttttaaggacaatggataggagacattatttaaaaagcaataatacaaaataccaagagctattcagctcttttatactagagcctgtatatagtacgttctttcccacaaatccctgtttttaaatattttctccatttcacaattataatcccccaaatgacagaatggttgtctgacaatatttcttctgatgttgaacatattttgtacgtttgagactgtgccagaaagtctatgcagcagtgacattgaaagaacagaacaatctaaactgcagatattcacagagggctgaaaacctacaataactattgggaatgttaatcatttcaaatggaggaattattagaggcagcacatttatcatgcatatcctcatcactagcttagagcacctggcatagtttttaaaggaaagggagaaaaaaaagaaacactataataatgagaaaatatgcaagatttgaagtcaggaaaatgtgggtttaaactgcagcttcttccaatagctatgtgatcttggaaagttacttctccagtctgaacctccatttcttcaactttaaaatcagagtaataatagtaatacctatattctaatgttttattggaaagaacggtgtctggcacatagcaattaacccaagcaatttacatagcaattactcgtgaaaaagaagctattaatactatttattgttattttcccactgctgttgcccttcagccaaagagcaccaggaacacatccgtaattaagaagttgggttgattgctcattgcaatgggagagaatatactatagggaactatgggatgtcttagtaaaagtgtgttagaaaagacatataatttgggcttgcattattagctgctttggcggaagggtcacaaaactgaaccatttctctgaattggttgctattcggaagcatgggtagttctatgaccagtgctaaatctcatctttaggtaggacagcctagggtgaggctacagccgtaattggcaaagaagcagctattgttttagccaggaaaggcgatggcttcggcaatgttcaggtctgtctgtgttcatgcataattacggaatggccttctttatggtctgattgactgtggtcatagagtggccttatctgatgttggtattctctgaaatcatgtttgacaggagaacaccaacatctaattaatgtcccaggccagctcctggaggtcagtggctacttttcttttccccatcatatttattcatatatttagtgagtagagtactgtcaatccttggtgtcctttctctaacaaagtccaaattctatgtaaaaaattctatgtaggtcaacaaaacttagtaacttgggtgtcaaatgtaaagaagaaaagataggctcaaaggagagagtagggctgatgtggtagagggtggacccacggtgtctgtgcaggccagggtagggaggctggctttcattttaaatgacatctgaaaagtttgtcattttaaaaagtttgcttggtcccagtaaggatggagaatggcttgttggggatggagaaaaagggaaaggaggttcaaaaagtgaagtaaagcttttatcatttaaatgtggcagcattagatgtgggtcacagagttgtagacaggcttaggacacggaaaggagtttggttattcatctggcccagttgcctcctttacatgtaggaaaatcagcactgaccaggacagatgaagtggcttgtccacacccaaatatttagttagtgcagagtggagagctccaagtgggggccagagcccagaagactccttcagccttgtgcccccaacactgtggaatgggaactgaatcagtcgtggggaggaggggtctctgcaaacgtggcaggtcacagaagatggacagcaagggccaggcacggtggcttatgcctgtagtcccagagcttcaggaggccaaggcaggcagatctcttgagttgaggtcaggagttcgagaccagcctggccaacatggtgaaaccgtatctctactaaaaatacaaaaattaactgagcatagtggcgcacacccgtcgtcccagctactcaggaggctgcggcaggagaattgcttgaacctgggaggtggaggctacagtgagttgagactgagccaccgcactccagcctgggcagcagattgagacttcatctcaaaaaaaaaaaaaaaaaagcgggggagggagattaatcctggtgcccttctagaactaccacctggcctttcttaattgtccacttggagtgtttgccaagcgaagaaaagatgaacccatgactgtgacctacctggagggtagacattctggagagcttcccctccaacaatgtcccaaatctgtgttcatccctgaacacaaccactgcagttctaggaaaccaactttctaatatatttaaggatgcttgtcaagattttattatctgttctttcatcagagagatgtttacaacagcagaaaaatttaaaaataaaaatgaaatgttttgaataagaaaataattaaattatggcacagccagggtcagtagtcatctggtcgactgtggatggatcttccagagactcctctcgcctgtcatttgttggcactcaatctctacctgttgttcaatactttgagtaccactctggtaatgaaataataagagtgatggaatactgtatatccatttgaaagatgacaattcaattacttgggaaaaacacaatacatttacaattggcaaaatacaagctctagaacatcagcttaatctatatctatgttaaatgtatgtaaaacttatgttcctaccaaatattaacagtgactttccccgattggtagaattagggatggttttaattttcccaatttttggtcagtgatattttcttaatgtttaaaaaggaacattaacagtttttatgataaatgaggaaagtttctttacaacatttttttgcatgccattccttagagttgggcagcttttgcaagctgtgagaagcccagctcctgcttttcctgatacggtttatgactcacagctgccaccaagatgtcagttagctctgtgacagtgaaatgacttcatttccctgaacccggatagaaacggtgtctgggaagagagagagtacctggtggagccctatgagtaaatgtgatgatgattcagctctggaccctatactctactccaaaaggaaatgtttcagggcatcagagggcatgaattcatgaatgtgtatacgaggctttgttcaggatatttttaaatatagaagttcattgatacaacatccctatgaggtagggattattaagagggctttatctataaggaggctgggattgagagggtttgaatgatttggcccaggtcacaccataagagctgggagcgagatgacagagtcttttttgtccacaagcaaaatagccatgcctgtacttgcagtcggaccggaggaacacacaggccaactctgacgcaaagcatggttatcaccatgctcctccaatgccacctgcgtcttagctctgggtttattattcactgagtgccttaatgggcacctatcgtttattttccctgggcctcagttacctcatccgtaaaatgagacaagaaggtatttgaggtagatgaacttcaggatcccatcagccttgacgagtgcaggattctatgtgaatctagatgagatttatccaaggacctccacatcctgcctcccacctccatgagcagctattccaaagctaccagtctggtgattcagccaaagacccatcattaaagagcacaaagacatccttggccagtatctttctggatgctgatgcttttctcctgaattgcatgtcaccttggagaactcagtgatggatgagagagatccagctttgacctggaaaactttcacattgcaagttttttttttctttttctttatagatttatagtcaatacttcagcctttctatgacaagaagcttatatttttctggactagatgtaacaaacgactttccaagtgatcagtgacatcccaagttagggctgcattttgaaattgttctttagaatctctaacttcattgggaacagtgatatcagaatgttaccttaatactctgccagaaaggcatggagaagatgtaaaatgtttataaatgaacatccagtgatgtgcacttggtaatttcattcaaagatgtaaaggaagagatactataagggacatttctgttattttgtcaaatgctattatttactgaaaaataaaatttcaccctatatgcttgaccttcagggacttattttaagatcatatggcttttcctaaacagctgaattatttagtgagattgaactctcaaagactttaaaataaagcccaccaaaataccagccactctgcagtgctacagctgttcagacctcaatctgcatatttcatctcagcagactgaagtttgcaactgaaaaatcgctcagaaaatacttatcaccttccatgccaaacgcagaaaggaatttatttgaagctgagaatgtgatagggtgggtgacttactcccacagtgatgcttagaatggtggatggagttctagctgcgtttttgctgcttcacccctggggaggccacgcctctgagaaagaggctgggaggcccttccgcaacaggtgttcaggtatgagtgaaagaatctaaggagtgagcttggagcactgcacccacagacaggaccatcattaggagcacattctcagtgcgtgttgaatgttacgaaaaggtttgatttatacatttttgacctaaatagaatttaatcaaaatgtctagagaatttttacgggttactagcccctcactttttctgaagtactaaaagcagaatcaggaattcaagattatcatgttgagtataaagcactctagtcttcctaaaggaatcagtgtcagactgggctggtggttcacacctgtaatcccagcacttaggcaggctgaggcaggaggaccacttgagcctgggaatttgaggccagcctgggcaacagagtgcgaagtccctacgaaaaaaaaaaaaaaaaaaaaaaaaaaaaaaatatatatatatatatatatatatatatggagagaaagagagagcgagagcaagccaggcttggtggcatgtgcctgtagtcccagctactcaggaggctgaggtgggaggatcatttgagcccaggaggttgagactgcagtgagccaagactgcaccactgcactccagcctgggcaacagaggaaaccgtttctaaaaaaaaaaaaaaatcaatggtacctcctatagagtcaggtgatggtgttgattatgatgatgatggcaaagacggtggtgaaggtgatggcgatgatcatggtgatgatgatgggctgatgatgactgtgatgatcatcatggcaaagatgacaatagtgaggttgatgatggtgaagataccaatagcaacaatgaagatgtggctgctgatgtgacaaagatgatgatggtgatggtgatgatggcaacagtgatgacaatgatgatgatgataatgatgaccatagtaatgatgatgatgatgacgatgatggtagaggcttacattgattgaacccttgctaggtaacagatatgttaagcacttaagccctgagtgttcattatcttatttaatcttcagcaccatcacatgaagtacatgctgtgattttcccattttaaagatattgaaactgaagtttaaactcggtaaggaacttgctcaaggacaatacttcttaaattttgctatacattagaatcacctggaaagattttttaaaatcttgacccagaggttgagtaatgtgctcaagggcacccacctgatgagtggcagaaccaggctttacaacccagtcactgagcaccagaaccatgtcctctcttgtgaagagccagtcatagtgcccaaggaattttcagggccatcattgctcatgtccctccggtgatgctgtttttaataatagtaactggcgagctggagtataatgttttgggtagcatggcagatctttgtggggcagtgtgctgaaaccagcttaaatctctgactgccgagttaatttatttcattcataatattctgttcgaaatgaaaatattctcatggttggttttgcctgaaggtataaaattccccaaatcagcaaatcagcaaatcagcgctttcctctgatgaagggggagttcacggaagactccaaaaatggaccaaaatgcctctgttcccacgttgcaggtaggaaattaaagctcttaagaaaggatggcattgtttatccatattcagaaaccacagggctgggatttttttcaaatgaggccatgctagttaattaagactttgcctttcagggattatttatattcttaatttttgatatttttcatggcagtggagtctgaataaactcacaggtgtgacctccttccatgccagctactactctctcatttaatcctcatacaacactgacatttgagtaatagttttcccattttgcagctgaggaaactgaggctgcgagagtttataatttataaaagcttttataatttataaaagcttttataatttataaaaggttttataaattataaaaggtttgcatcattttcacctacccgaatcattcttctacaaaagaagaaaagttatttcagaaaagcttcctaagttttccctaaaatgaatttctggcctagaaaatcagatcctgctgtgttcacacttggcctcaatttcctcaggcttctgggtcattaaggaggagctttatcacctggctgcagggtggaggaagccaagattctggaccgatagcctcccacagctgcgttagtattccacaaaggcgcaaccagaagatagcaaggaactttcacacttggctttaatttctctctgcacattttgttagcgataaagaccatcatgttttttctttctccaccttttttgcttttagaattctgaatagatgttttcatcacgtggctaagtaaaactggaatagctgagatttccagaattcagttagaagatctgataagcatctaaaacttgtcctaaggtagggggagaagtgtttagcttggaaatataactcggagttcccagtcttcctcaagtaggtacttggggagatactgaagtaggaggaagatgattcctacaaaccacgccgaacaacagacagttcagagatctttgtgcctcttgactcaaaaaggcaactaaaagatttctaaagcattatccccatccctcccccatcaaacttttttattgggtatagaaaaacatgaggaaggtcaggtgctgtggctcaggtctgtaatcccagcactttgggaggctgaggtgggggggcagattacaggaggtcaggagttcaagaccagcatggccaacgtggtgaaaccccatctctacaaaaaatacagaaattttctaggcatggtggcatgtgcctgtaatcccagctatttaggaggctgaggcaagagaatcgcttgaacccagcaggcagaggttgcggtgagccgagatcatgccactgcactccagcctgggcgacagagtgagactgtctcaaaaaaaaaaaaaaaagaaagaaagaaaaaagaaaaaattagaaagtaccttcactagatttagaagtaagcccttaggcatagatggtcagctgagcctttttaaaaaaggaagttgcttaatgagatcggtttccaccactcagtgttagagttttgtgcctccagttttataaaataatgtaaattattcccagccgcagagaagaaaggacagaaaatgaaaattagcagggtacagaagtccattctgctgaacaatggaagaaaaaccacacagggatttggtaccattaaactctggggcaattttctgctcatttctccatctcctctctttctggtggtaatcaaaggaacgagctccagataggaaagtcttccctgtaattaatttaaacaagttcagtagactccaattatctagtctgctacaacatggagaaatgactgggaaaggaactcctgggcaactggaatgaattccatgatggctttattaaggagtacatgtaacaaatccaaagtctttaagcttatccttttggggggcttttaaaagttatgtctttataataaaataaaagctggggaccatgtttacctctatctcaagtgttaagctgaaccattgatttatttccttagagtgatgcattactgccacctaatggtcatgtacctgcattgaaggggttaagaagtaaggaaatgatttaaatagacttaccaccaccactggtcacccgtcttaaaaaaaaaaaaaaaaaaaaacaaaaaacaccttatagtaaccttttttttttttttttttttttttttttttggtttgtgctggatgcggtggctcacgcctgtaatcccagctctttgggagggcgaggcagatggatcacctgaggtcaggagttcgagaccagcctagtcaacatggtgaaaccccatctctactaaaaatacaaaaattagccgggcgtggtggtgggtgcttctaatcccagctactcaggaggccaaggcaggagatttgcttgaacctgggaggcagatgttgcagcgagctgagatcacgccactgcactccagcctgggctacaagagctagactccatcccaaaaaaacaaagaaaaaaaagtttgatggatgaagcagatgagttactgtggatcaggactgtggaaagcccgccagttagacaagggatgttgccctcacccaaagagcagataaacaccattggtgctgtttgagctgggcggggcagatgataccagatctttagcaagatgagtttcacacctgtgtacaggaagaagcgtgtgaaaacaggtcaagaggatcctgaaataaaccaagtgtgagagtatcaaggtgacaaaagggtaatggaggctggaatgtgaagttagagataatcatttttttaaattatattaaattatattttatattatatatattaaatattgatttattttttataatttataatgatttatattaaatatcgactgtttgccaggcaccatagttaaaatgagatagaccagttctctctctcaagaagctcccacatcaagtagcccttgatgtgattcactctgtggtctgcagaagttgccccacctctctggtccccagtctcctctgttacagggaaaaagattgctctgggagttttcagaagcccctttgactcccaataggaacttgcctggagcaggtacttccaagggaatgagaggaaaagcacagtgtttagctgagataggggtaaatatggtccccatcttttattttattatagagatataacttttaaatgatagctttgtgtaggtgatagtggagctgagtgagctaaagattttttttttaatctcatgatctgagtctagctatctggagtggagcaggaaatgtggtatcactgatatgtaaagaaatcagtaaggaggggctcatttgcagataaaagggaataaaaccagggcaggcatgcagacaccatcatggtagctagacatataaatgcagagatccaagataccaacttcagcttggagggagaaacaagatcaaaggaagagggttcagcagttctgtgcatgacactgggtcagatctcttccctagaacaagatgctcaatggctgtgtgccccagaacaaggtgctcagtgtctctgagcttcatgtcactgttgtgtaaaagcagcactatgataggggcctcttcatagagcagcattgagtatctttggtttaacatgagaagagtgactggccctgtaagcttcagcagatactaactagtatcattatagctcctcctcctcttcatgatgatttatagaattggtcaatttttccagggaaaagcagtagagatgagagtaagaggatgcattcattccatgcctgcaagacagcccagctggggaaggtgaacttcagtggtggggaggagtgaaaggaatagaaaatagagatttggggaggatagggtggactggttccacacctctgagacagcaaagactccaagaagtttctgagcaaaggtcacaggacttgatgatttggaggttactgatgactttcgaaagagcagccagtgaggaatacaggattcttcgtatggagacagattacagaaagaagtcaagtgaagcaacaatatgctcctagataccgaatttccacagcctggcaatcctcaacaaaagggagacctgggctagttttagactcgagaatagatcaagggcaatgtgtgtatgatcagcaggctgcagcttccatattaacctacgttttaaatgtcttacattcctctggacaaaataaatcagcccggatggaattcgttgccacaatgatctataatgatctatgatatgtcttctcatttataatgtcaagcccttggagataggaggccctcaatgtttctttgagacctgagatgagaggatgatcaatgaaagtaaacgaagaggatcatggtaaagatctcatggtaccaagaggaaaacaactgataaacagggctcatggaagtccctgtccgctgggcaaaggagaaacggctcccttacctgatcacacatcttcgtcatgtccttcagggccccagatcctgttctaatgcagagcaggaagatggtgactttttgaaatttctggaaatatcactcggtgaatcaaagcaaattaattctctcttttagtcactctgagcctggatttccagtccttggaatttcgcttctaccaacagttctttcagagtcatttatggttctaaatacacaggatgcagttcccacatcacctcccctcataacaccatgggatgaataatcatggtgaagacaaggatctgtggccaaatgatggtttcaagtccctgttctgcaacttgcctaatgtgtcatcttggacaaatcctttatcctcactgcaccttcgttttgtaaatagggacgttaacgctgggacgtactctgctggtttgttttgaagagaaaatgagctaatgcaagggagagggagctcagaccacagatttgtgcagagaaagtgccgaataagtgacggctgctgtttctgtttttattctgcgaggaactctaatagaagaaaaagagcatttgatgactgaatcaccggtcttcgctagcagggcagaggcagatagttcccccgccccgaccccgggcccagctgctcatcactggggttgcagagttcaatgccgacatcccaactctgacccagcacggtgcctactggggaaggcagatatggataaaccacagcagcgccctgtgattgattctttgccagacggtggagaaagtgcacattcccagatagctcctgcagggaggttgcatgatgcccacaaacccacctgtgaggcccataagcctggatgttctctcttagctgcttaggctctgcccctcaaaagcggaaatgttgagtgtggagtgcagcttgttctatgaatttgaagtacgtggtccctggggttggaccagcaacaagtgactcagtccctctgagactctgtttgctcctctgaaaaatgggtggtgttgtgggggacaattttctacctgatgagctcctcatgaggatctatgtaaagggtagtatctgattcattaccaggattttgtatgctttataggcatgccaaatacagctgtatcttactttattaaatcgaacggaaaaaaatgtgaaaatcaagttgtgtgttaaatttgataaagagggccaggggcggtggcttatgcctgtaatcccagcagtttgggaggccaaggcaggcagatcacgaggtcaggagatcgaggccatcctggctaacatagtgaaaccctgtctctactaaaaatataaaaaattagccaggcatggtggagggcgcctgtagtcccagctccttgggaagctgaggcaggagaatggcgtgaacccgggaggcggagcttgccgtgagccgagatggtgccactgcactccagcctgggagacagagcaagactctgtctcacagagaaaaaaaaattgataaagagagttcatgatgtaaaacagtagttctcagccttgtgtgtgcgtcggcatcccctggagggcttgtgaaaatccatatggctgagccgcacccccagagttaccaattccataggtctgggtagagtctgagaatctggatttttaataagcgcccccagtgatgctgctggtctggggaccacacttggagaaacaccttcttcaaggagtcacatgtttctgaagcaaaggagaatcatttgtctttgtattactctgttctcacgctgctaataaagacatacctgagactgggcaatttataaaggaaagaagtttaatgactcacagttccacatggctggggaggcctcacaatcatggcagaaggcgaaggaggagcaaagttacatcttacatggcagcaggcaagagaaagcatgtacagggaaactcccctttataaaaccatcagatctcatgagacttattccctatcatgagaacagcatggaaaatacctgcccccatgatttagttacctcccaccaggtcccatccacaacctgtggcaattgtgggagctacaattcaagatttgggtggggacacagccaaaccataccactctttttttcttttgtttttgtttttgcttttttgagacaggctcttccgctgtcatccaggctggagtacaggcactatcacaactcactgcagcctcaacttcctgggctcaagagattctcccacctcagcctcctaaatagctgggaccactggtatgcaccaccatgtgcagctaattttttacttttttgtagagacgaggtcccactatattacccaggctggtcttgaactcctggactcaagtgatcctcctatcttggcctcgcaaagtgctggcattacaggcatgtgccacacgatgcccagtccattttatttcgtactgaaatattcttcctcctattttttcttttcaaactgaacatctttatattcgaggttaatttaaaatggagccttcagtgcatctggtatgtgtgtgaattggacccagctcagggattttgctcttctgtttaatctttgcttttcctgtggacccatgagtgtcaggactgatatttctgatttttcctttgtgccaaattgagcctcatctgcccggtcagccctaatgtcacacgcactccccaccgcctgagattacaggacaggagatacatttcgattcaaagttctgaaaatatgattaatctcaagactggagagagaaaagttattggaaatattttcataaaaattaatgtttatagtcaaccttgtgacagtcggtagtatgtcagcaattcaggtaaggttgtgtttgtgttttcttgtgcagaggatttagctgcctataatcagtttcatgaaaccttgctcttacatgactcatttttttcatttattcactcatttgttcagcaagtgtttatattgattacttggtgccaagttctatactaggctgtgaaaacagagacaaatatagacatcctctgttcaggcaatgagagctttgtaataagtttcttgttttttaaggacaaaggcttttatgattttagcatcacgtggctcctcactttctcggttcgttttgtgtttggttgatgttttcgttgttgttttgcttggggatggtacttgtttcctgcccagcaattcttgtaagtaagtaataatatagaataaccagatttgttgggttcctgcaaagacaaacatgatatttaaagaagcttgcaattaaatagagaaaataaacatctaaaaatagatgtacaatgcagtgtgatgaggaacaagagaagtacctcggtgaaagaaataatgtatgtgtttgtgatgtctagagaagtattcgtggatgaagtgatactggaggtgggttttggaaggagaaatctctttctcatattattagtctcagtcagtttcccctccttttgttccaggaacaccagcatttcattagacttagacccactgtaagcaaagggcttaagcacaagtccctgggggagaaactcaactctgccatcttctagctgtgtgcctttggaaatcacttaatttttgagcctatatgatggaatactactcagccctaaaaaggaatgaattgatggcattcacagccacctggatgggattggagactattattccaagtgaagtaactggggaatggaaaaccaaacattgtgtgttctcatctgtgggaactaagcaatgaagatgcaaagacataaggattgtacaatggattttggggattcgggggaaagggtgggtagtgtatgagggataaaagactacaaattgagttcagtgtacactgctcaggtgatggatgcaccaaaatctcacaaattaccactaaagaacttgctcaggtaaccaaataccacctgttccccaaaaacctatggaaacaaaaaaattaaaaataaaatgaaaaacaacattgatcatgaaaaaaacatgaataacattacaccccacacaggattgttgaaagaaacaaaagaaaatattatttaaaaagcacttagcatcgtgtctgacatgttataagcacttaataaaatcatagttgccttagttattataattatcacaatgttgatgggtgtcctacaatacgaagtggacggagtcagggctggggaattgagtctatctgtggggtgtgcgtctgtttaatggtggggttctcagatccttgcatgtacaagggcattgtgaattggctgtatgtgggcaatgttctctgccgtactcccgaacttgtttaaaaaggaaactctttatccaccatgtatctccaccatgtatctgtgagagctgggactctgcagatcacttattggttcacagcctccccaaatcagcctgctctgttcaggggaccatatgtgcctgataatgaccctgcctttgtagtccatggtcaaaagcttgccatgagtctgtagtgccagctcaaatggcatcatgctgtgctcctgccttcccaagcagggtgtgcacgcaggcaccctctgaaggctaggttctagatatcctctcatctttatctttgcaactttatcctggcttctaaggggcatgggtgtttcactgtcactatctgtggaaaaattgattcagtctgcatgttccgtgaaacactaggagattctccaaaagaagcctcagttagcaactgcaagtatgcaaaacaggtatattaaggggtgatgactcacctcagaaaaggaacctctgtttatagaaaagattaaccagaagacgtctttaaattacatccatctctgggcatagcttgtgggtgtctgagaaaatgattgagaagtaaaatctgttttgtgtgcatgatacacattcccaaataagcccaaaagaaatcaaagtgacagtttgatttaccttttttaattcagaaaataccttttcaatattgacactagaaatcagccctaattattcccctctgactttgctactttgtctttccttctcatctgtgtccacttgcttcctattgcattatatattttactttgcatttaatgtatcataagcacatcccagattgctgtatggtccttatcattataatttttaatgactgtgtaatggtccatcaagtagctgagtctaatttatttggccattttcctatggttaaacatctaggccatcgattttctgccatttttagctgtagaaactgtgttttaagaaaccatatgtagaacctaaatatgttctattgattttttttttttgatatagagtcttgctattacacaggcaggattgcagtggcatgatctcagctcactgcaacctccacctcccgggttccagcaattctcttgcctcagcctcctgagtagctgggattacaggcccctgccaccacacctggctaagttttgtatttttttagtagagaatggggtttcaccatgttgaccaggctggtctcgaactcctgacctcaagtgatccacccgcctcagcctcccaaagtgctgagattacaggcatgagtcaccatgcccagctctctattgattatttgtgaatacttcagcttatttaattttcaaagtaatctttaaaatcggagccattgttatcacactttctaagtgaaaattgatgctcagagagattgtagagtttgctcaagtctggatacctagcaggttatagacctgagacatgaacccacgtatctctgactttcagagggtggatttttcatcagtgaacaatacaacttggaccatgtggagtgagacaaggaaactggcaaggcccaagagattcactaaccccctctaaacctgcccctgatgaatggcagatggacattcaaccaatgacagctgtttctgagcatctaaaatgcagggagcctggtgtgatcactggcccacctgaggctctgggggatgagtcgcaggttccatccattgctgccgtgtctctgtttggtttagaagtggctttctccaaggacgtgaatgttcattttagtgcaccttctggattttctcctcttccctagatatttgcttttgtgtattcccacgcaggagcttcagccattgctacacgtggctccttcttgtgctcttctctgcttccagctgcgttttcctcaaaggctttctggtatccgtcaatccctagatctctaagaaccttgagctttgcaatttatccctcttcagaatcctatatgtcagtggcattggcggagtgggtggacacctggacaactgttcctgctttccattcgttttcctttgtcacttaaagtgcagggccagggcagcatctcttctgttagtggcgcagctttccctgtggacaagtctccctttccttctctgtgctagctggaaacaaatcactaattaaatttcatctctcgcagctctggaaaaacgacagactagtgcttccaattaatttcatcaacagtgtggaataagaggcatgttgcatcctgtaaagacagcagggctgaggggaggaggctcccactgctgttaccctgctgtctgtcttcagcgaggctggagttctgagcctttctcacctgcgttccaatatccagccctggcttgcttagagggtgagaagactgcatttcttcatccaccaaacaccagtggggagtcacctgtgtgccaggcaccacgagcctcccactgttgatagaacagcaaacaaggcagacacattccctgctctggagatagtgccagacaaaaataaggatgtcgggatgtggcagttacaggtgtctctgaacatttcactaaatcgaatggaccagggccaacgacctagagacaggaaagggactggttgagcacagtgaggccccgtcttaggtaaagaggatacagaaatagatcaacatggtcccgggctttggaaaaatccaaactggtgagaaagttacctgaggggtcagttgcagtacaacgtgaaagacgtcatgacagtagaatgcacggggaaccctgggttcaggggaggggacttttgccctttgtgggttcagaggcaactgcaaggaagagcagatacttgagccattttcaagagtgtgccagatgggctaatggaaggaagggcatttcagacgctgagaagtccggggcaggctatgtttaggaagcagtgaatgatgtgttgcatcagaaagataccctagggggctgggcgcagggttcatgaccgtaatcccagcactttgggaggccaaggcgggcagatcacctgaggtcaggagttcgagaccagcctggccaatatggcaaaaccccgtctctactaaaaatacaaaaattagccaggcatggtggcacacacctgtaatcccagctactcaggaggctgaggcaggagagtcacttgaacctgggaggcggatgttgcagtgagctgagaagatgccactgcactccagcctgggtgacagagtaagactctgcctaaaataataaaaagaaagatcccctagggcatgtccctgatggagctgaaatgccaggtaagcaagaggcaggttactaggggtctgatatggcttgattttgactttgggcttcatctcagaggcgatggaggatggagtccaagccaaaacacctgggcaccggcccaagctctgccacgtccctggtatgaccttggcgagctccgcagttcctttaatcactgggggtaataagagcactgacaccttacggttgttttggggattagacccaagaatacacatgaaacactcagcacgtgcctgggctttaagcgtttgataaacattacctctaattgttacagcttagtagtgtctgtgttagtattgatcaccatggtgggcagccaggcagggtgggcactgaagggctttgaagtcagaaggacataggatctattctgccttgccatcactcattacatagccccagacacgtcacttacctcccttaccccctctgcttttcaattaaggattgtgtgtgtctgccacccagccccagcttcagcacatggatcctcaataaatcacagatgttgtcgttgtcatcatcatcatctacctctattatcctcaacaacaatgacatccacagtagcaataagcaggaggagcacctaaggcagactctgctttagagagatgagttcagggcttgaggctgaaagacagggaaccagcaggccaggccatgcaagccttgcagctaaaagacagggaaccagcaggccaggccgagccaagccaatagtcactgacccactccgcatccaagatccctgaggcaaaatctgaaaacacacatgttaggaaagacatttgtctctctcccagatttctgatttgacaggtcatggcaccctaaatttgcattttcaaaagctccccagggaattttgcttttccagcaggcgtctgagaaccctcatcggacatacgcagtgatgctggtaaagcctgagcagaaacaaaagagggtcccgggggcagaatgggaggcagctctgggtctcttaagatggccctggtgtgctaagtgcaccagaggtaggaactcacccactgtcgccattacagacagaacgctcctaacagagagcttccaagaaaccccagggctttcctcgtctgctgggacgtctctgtcttcctgtgcctgctcctgctggatccaggatcccaggctggctccaactcaagatctgctgtttctcctgtacttgacacctggttctttgggctgttcctttgttgatctgttattgtttactttttagtcgcctttgaattaccaaactaagtcattcttgtagcaaaatctcaagcacagaaatgactacattaaaatgagccttccacctctcctaattcctccccaacacttcccaacatcatcgccattaacaactgtgtgtagtcctcttatattttcctttccttaaatataactacatatctacagacaggtctttgttttgatatgattttacaaacctatggagttatagaatggagttcatcttataactcatctccccccactacaaaaaatcttgtggtcatctttccatgacaatacaaattcttactattttttcatagctatggtagccttgtaacttatttactgatttccctttttcagccatcttcctgttgttttgcaaacccaggccacccagcaacaatcttctttatatactgtcttttcatactgacacttctcagtcctgttggatgaattcccaatggtgcgattgctcatttctgacattctgtctgctgatcgtgggccacagcaccggttgtctctttctctgactcaacccaagtctgatgagatttcagtttcactgcagcattgcagcaatgagaaaacatcccatcatgcactgcttctagatattgtcaagagaagggtatattattatgcaaaagcagtgtctatttacagatgatgaaacgacaatttttcatggggtttttctttttatttaacatcttaactgtcaattccaacaaacacacttgttttcctctatgactaatctaagaaccaagatggccaacagcacaataccaactttttgtttgtttggtttttaaatatggcaaaattatatatgagcttcccattttacaggtttctaagaacatcttaatgaaaataacagaactcagaaaatccactgtcattttgtccagaaatattttgttagcattgggatgcagcaatgccattgacaagaaacccatgtggaccaccttttaatgcttaatgagcctttcttcctagcatgcattccagtgggagagaggacagaataaacgtgattaaattatcggacagaaacacatgactataaataattgactctcccatgtttcatgagccttaacctcacacttcagaatgtttatttcctttatttcaaaatgtttgtttacttttctccatggactttaattaattttgcctttggcttataaacgggtgaaactaaaaacttttttatttgcatttttatcttgaagcaagctaactaattaaactttgcaatttggtttcactgtgctgtaccagagccataggaaaatggctgacagattcgcagatttgtgaccgtttttctaatgaaggagattttggaaattttgatggtttcatgtaaatgctaaaggtaaaacctgtattaagagtcacttgatcacaggaagaaaaataaccaaatgactcaactgcataaggaggtgaaaggaaggatctagaaactacataccagtaaacgtcccctgagtaccacaaaaagtgtagaatggagtatgagcattgtagttttcaatagtgttactcaactggtagaaaagaggaatgcccaaggcataattcacatagatttcagtctgatatgcaacaggttcttccatgagatgtgagggcttaaaagaaaaggtagagattgaagacgttatcttttaaaagatactcacagcacatttaattgataggggatcagtaacaagattatataaagaacttctaaactcaataagatagcaaaaaaaagtaaaaaataactaagagataaaaacagtcatttcacagaataagaaaaatgactaatgtataaaaaactgttcacactcattggccattgctaaaattccagtaacaattagatgtatttatataattttatgtcttcctgattggtaaatattaagcctagaaatgccaagctttggcaataacaggaaaacagagaccctcgctgactgctgttcagagagtaaatttgtacaacaactttgaagaacagtttgtcattatctaccaaagtggaagatgtgtaacctatccctaagataatctctgcaaggaattctcatttatgcccctgggcacagagacaagaacactcctagaagcatttctagcaatagcaaaataggaaatggcctacatgctcattgatggaagcatagctccgtacccggcagtgtgtacgtctgatgaactgcagcaaggatggtggatctccaggacatgcatatgtggaaaacacagtctgcagaaaaatacaaacagatgatttcatttatatagagttcaaaaaaacaggaaaaactattaggtttagaaacagataagaagtaaaactatgaagcaaaacaatgaataatagatttaaaattgcagatagcctgagtgcagtggcttgcacctgtaaacccagcattttgggaggccgaggcgggaggattgctttagcctaggattttgtccaagatcagcctgggcaacatagcgagatgttgtctctacaaataattaaaaaaaaaaaaaaagttgggcatggcggcccatgcctatggtcctagctgcttgggatgcttaagcctgggcagtcgaggttgctgtgatcactccactgcactccagcctgggtgacagaattagaccttgtctcaaaacacacacacacgcacacacacacacacacacacacacagaacaaacactgcagatagccattttcctaagaggaaaggtagcaggctaagatcatggaggaacacacaggagctgcagtggtatcgtaatgtgatatttcttaagctgggtggtggatacaagtgttgactgtactatttattataccttgctatatgttgtatatgcatgtgtgtatataggtacatatacacatacatgtatatgtacatattcctatttatatataaaatatatagcttttaatggaaaagaggaagtatcagctatgtaacatttatcaggcatgaatcttatctcattcaacatttttatcaataatttattaaaatctggctcatccagagcaggtgagggatgatgatgattgaatcaggttttctgaaaggcatggacaagctccagccatgaactgattatttaatggaacagaggtgaagatgaaatcttccccttgagattcttaaaaaccagttcactaaattgaggtgagacccccgcctttgttaaacagcaattcatgcacaaacaatattggggtcttagttgacaagttcaaaaggagccttctgtacaagtgtctgcccagagagctaatttccactctaggaagagtgatcatcctgcaacagctagcatgcatcaaggtgtatcttgtatagttttctcccagcatcttgatttgaatagagagttgacaaatcaaagcatggtcagagggtggtaactagcaatgtaaaagatcagcttgtaagtttgtagctcatcggaggggaatgtataagagctatagtggaacttcgaggtttccagaagatcgattctggctctgtgtacccaagatctcaccaaagccaaacataccccagaaagcagtggcctgccttgtaaggtatgagctcaggtccctggatgtgtttaggcaaaggctgtacacctccctgtccctacatgtgtgctgaaaggtgggctccatggctccaacatcccttccacttcgtggctctcatgagtctataagagtaacccaagagaagtcaccagcagaaacttggaaatcgttttaacaggggccaagagggaaacatggggcagtgcatgactgacagctgtgctctgtcacttctacatctgccttgcagttcttcaagcagccatgagcccctgcaggcaaacctgtggtctgttcagcaggacctgtctctgctgccttagcccctgggaaagggaagcaatgctgtggctccattttcagcagcgggcaaggaaaagaacttgggttcgagagtttcacaacttgagattgaatctccttctgcctcctttcagttatatagtctcaagtgcttatcttcctttctctgaatttcagtttctagctctttaaacaagggtcagggacagcttactattgcagaaggtggtgagatcaagaaagaaattagaggcaaggtgcagtggcttacgcctgtaatcccagcactttgggaggccaacgcgagcaggagtttgaggtcaggagtttgagaccagcctggccaacatggtgaaaccccatctctattaaaaatacaaaaaaaataaattagccaggtgtgatggcccatgcctgcaacttgctactcaggaggctgaggcagcagaatcacttgaacctggaaggtggaggttgcagtaagtcaagatcatgccactgcactccagcctgggtgacagagtgagattctgcctcagataaaaagaaagaaattggagcacctggtatatattgctttctcaatgcccaaccctgaaacatctctaatactatttgttcacttactcatcaatttgtccaataaaagtttatgtaatacctagatcctaggtacctggtggcctctgagccattgggaatatgcttgtggaaatacaccctcctctcgaggaagctatggtcttgtagctgagactgatcacccaacagacaatggtaaacccagtgtgccaagctctaggcagaggataaaaccacgaagacaagcagaatggaagaggaggaaaatataacactgcctcgggaaggagtgttggggcagactttctagtgtaatgaaagatgagcagaaattatttgagatgaagcaggaacaacctggggcaggggcattgaagattctattgctgaatgaacagcagggaccaaggcccaggcgtcagatagcacagccagctggtgaaagttcaagttaagtgcatcagccaggatgggccagcttatgctgtcatagtaaagtacccaaaatgcagcgattcacaataaaaacagttcatttcttcccattatctctatcctccagggactggctgggggctcggctccatgtcaccctctctctggcattcaggctgacagagtggccactttgcagaacagcggcagtggttgtgcagaggaagatggcataccacactacacacaggctcttgaagctttcacatgaaagtggcatgcaggccaggtgcaatggctcctgcttgtaatcccagcgctttggcaggccacagcaggaggttcacttgagcttaagagttcaagaccagtctgggcaacatagtgagacccccatcattataaaaattttaaaaatttaaccgggcatggtggtgcacacctgtggtcctagaaacttgggaggggctgaggtgggaggaccacttgagcccaggaggtcagggctgcagtgagctatgatcacatctctgcattccggcctaggtaactgagtgagactctgtctccaaaaaaagcaaagaaagtggcttggagcacttcggattctgtttcataggccaggtaagtcacagggccactcgtaaatccaacaggggaagacagtgcagtccttctgtgtggccagaaggagaactagaagtatcagttgacagcactaaggaccaccacttttgtagcaggagaagggggtcgtctggagtgggagagggtgagaaagaaacatcagccagattcggaagctcctttatgctatgttctagggggattttattgttttgttttgttttgttttgagacagagtcttgccttgttatctaggctggagtgcagtggtgtgatctcagctcactgcaacctctaccgtcctggttcaggcagtctcttgagtatctgggattacaggcacacaccactatgtccggctaaattttgctgggcatggtggctcacgcctgtaatcccagcactttgggaggccaaggtgggtggatcatgtgaagtcaggagttcaagaccagcctggccaacatggtgaaaccctgtctttactaaaaatacaaaatgagccgggcgtgatggcacatccctgtaatcccagctactaaggaggctgaagcaggagaatcgcttgaaccgaggaggtggaggttgcagtgagccaagatcgtgccattgcactccagcctgggcaacgagagtgaaactcagtctcaaataaataaataaattttgtagttttagtagagatgggatttcaccacattggccaggctggtcttgaactcctgacctcaggtgatccacccgccttgagctcccaacatgctgggattacagacatgagccaccacacctggccctcctcttattacaaggataccccaaggctggacggaatgcctgccctaatccaccataacctcattttaactaattacatccgaaaagacacattctgagattctgggtagacgtgaatttggggaggaccctagtcaacctagtacagaaagtgataatgtatttttgatggggtttcaccaagttgcccaggtgggtcttgaacgcctgacctcaagtgatctccctgcctcggcctcccaaagtactgagattacaggcatgagccactagattttttactgtatctagcaagggccattgcaggatatcaagtctgggaatgacacagtttctcatttcagaaccattgaattggatacagcctgagtagtattcattcattttttccacaagcatttgggtggtgacagaaggcggcagacaaagtccccccatcacatttggcaaagagggttgcggggattcattaatcaacgagctaaacaaatgaatttgtaatgtttcagatggtgataagttgcaagagtaaaaataaagatgggataacaggagctgacagcctgttagagaaagccagaagtgttaaggtgtgaggagcgaatgggctagacagctacaaaggcgacagaagcaacataactgagtgagcttctagaattacaagagggtccctgagataaaatctatagcaacgcctagggcaggaggctttgataaacatgatttgcatctgagtttggagttggaatagctcttttgaagcactctgtccccatggacatagatgtaacaccaaccctttccaggagagtgggtaacagacaagccactcagccggttttattaagatggaaattttcacaagggctaaaataaagattcaagtcaatggaagccgcctttttaattgataagagcagctcagcagtaaaggaaataggagatgcttgatgcctgtgtcgttctagtgttggggaattatatggaacactcaaagcagacctccccatcagctcagagacaattgatggtctgtgcatgtccttgtgaggctttctgtggggtaggatgagattagaagcaaagttgcctcttttactcttctggtttcattcttcactctggcagtcagcacaattcacaggtgtatcagccgaggaagcatctcacaaactctattctctcttacttccatgccattttggcaccgtgaacttgaaatcactggtggtgttctctttaccctgctggaatcacagacactgcaagttgaaagtcacccagaggcgatctgatgttttccttcctctacagggaggagaagtctcttctgcttttcacagcaggtgtcattcaacctacacacatgtgctgaaccacaggagcttgtggtctctcgaggcaggaccaccccccgcaaccccatggtcaagcagcccctgcagtagccttgttcttccccaagacccatcacccgtcctagctgggagccacgtgacgttacgctgtttccgtttaagcatgaagtcattcaaaagttggaaggtagcacgctcccattttagaactgttgtgccaaaccctattaacctcagtaaggaagacaccaggttcaagaggctgaagaagagacccagagccagcaaaggaggcatggggttttattaggggcttacatccaggcaagagagtctagcggcaataagctggacattagaaccgccttatatacagaaacagtccagcaacagagggctggataagatttcaccttcctatgatccactgtcagcaggctagatgacataagcacacagcctagtggcagtgggctggggaggaaaactgcaaacatcatgcaatttatataacattttcccttaacacactccccctaatgacctccacctggcaaccttcatcaacccaaaactcagggcctcaatgtgtacagctcatgtcccatggaatgaaacggagtggggggctcagatgtttatcatagacaaggaacaaatctcctggtcgacctctcctggattccctagtttggaacacacattcaggtgcatctgccatcctgggtcatcccaagggtatgcttaagtcactgttatcagatgcatttaccctacaggaacaccttcacatcatgttagcccaattcctttctttctttgtatcattgcttccctttaaatctaaaaagaagattaagtcttccatgccaagccaagcccaattactacaatcagtctttatatggcagtaccccaccatctagactgccgactaacttctctcctcctgatagtctctgctttatgtattttccttaaaaaccacaggaaccagctggatccaggactccagccacaatccaagggccagagtagagggttctaaaatttctccataaaatttacttctcgatacaagaaagcaatataagccataatggctgacattccagaaaaacactcttaccaagccccggctctcagtaaactcaaacgcatctctctgctcaaacgttttgtggttccaagagaaaacaaatacaccgtgcacatttttctttctttaaagattggaaagaaatgaagaaaagacttgtcttgtccatgtttttatagaaaaatataaagcatgtctcctctgtgacagatttcttttcctgtaaatccagcaagcccatgaaagagcttatgtgtgagcggatgtcacacattcatcttccccagccactttgctgcgtttctgaaaagataacatagatgcctggagtgcagacatcttgagatttaggagctggcgccttacagctctttgtgaattgagcctagaaaacgtgtctgtttttagctgaccccaagaacagaactggcaaccgcttcgtgcagaggagtcttcctccacggagttggttctcaagaaactgacgctgaaactttctttgggcacgagacacctgtgtgcttctcatatttggacccaatgctgttccttctgccctctgctgtctgtgtcgttcctggctgcagaacacagcccccaagcagagatgctgagtcctcaggacccaacccaccacacaccggctgtgtaaccctgagccagtcacttctgttctcccactaaccaaacaaggacaataatggagtcttcctggggtccgatgtgcacactggtactcagcacagtaccctgggcagcataaacagtccgtttgacagggtgaatcaaggctttctgtcatgaggctttctgtgaggtaggatgaggttagaagcaaagttgcctctttttctcctctggttccattcttcactctggcagtcagcacagttcacaggtgtatcagctgaggaagcatctcacaaactgtcttctctcttgcttccatgcccttttggcaccgtgaacttgaaatcactggcatgatgagatcaagtcctattccttggaccttgtccatgtgatctgatttggaagaagagtctttgcagttgtgatttattgaagggtctggggatgagagtactgtggattatccaggtgggccctgaatgccatcacaggtgttcttagaagaaagaggcaacaggagagaacacaggtgcacagaagcacaggcaaggtgaaggcagggcagagagagatgtggccgccagccaaagaatgtagatagctaccaaagctgcatatggtaaggaagagacctcccctagagtgtccagggagcacagccccgcccacaccttgacttctgacctgaagccttcagaactgtgagagaccaaatatccgaaatcctaagccacccagttcgtggtatttgttacagcatccccaggaaatagatttagtgagtgaagggtgagccatttgcattagcagaacacagaactgaggagacagaaacccagccacacttgtgtgaggcgtagggcaaatctttcctagataataactcaaatcattcagactgctgcctctctgcctctccctttctgtctcttttcaccgcctctccttcccttctttgttcttgatgaagttgagctgcctataaatcatcgtcctgtgtaaagtttttaaaattttattttaagttctgggatacgtgtgcagaatgtgcaggtttcttacataggtaaacgtgtgccatggtggtttgctgaacctatcaacccatcacctaggcattaagccctgcacgcattagcccagtgtaaactttgatctccctttggatgccagctgattctttcttccattgcccgtgggtttctgattgcccaccattgctaaagcgagttgtataggctgcaggaacaggtgcacaggactctacggctttccctggtatatcttttctctgctgaggtcagacttttagatggcaatactttttagttttgctgggccagatgtgtttccaggaggtggaattcagcagaagcagaaagttcaaggccgtggaagatagcagttcaagtggcagctgctaagggcttttcaactcagtgttttttcagcttgacttgcaaatagagcctgaaagttcccaactcttaaaaatgttcagtgtgtccagtcttatagcaggaggaagaatttgaagatggccagtgttgctgtttctcaggccctaatatttctttgtgctcagtgaacgggcaagttatcctgaggaagaaaatatttcagaggcttcagtgctaagtattaatcaaataggtcgggggtcgagcaggccttccacagtcattcatacaggaaaaacatattgaggctggccccaccctatatctcagcggggaataactaaagctattcaagagtcaccttacatccacggtgagccacatttcctgataccagatgctttcagggcaaccttgatcatgggtttttgtctattgcatcttcatgctgcaagaaaattctgtgtgtaagcatctctgtctcccagcaaaatgtggccagtggaaggtccacatgaggccttttcagtctggcatccacagcactagcacagggcctgccacaaaataggcccccataaagactggggttgaataaaatgcattgtttgcaacacgtaggcatgatttcttctttcctgcggtgggggatgggactgacccatcaaagcacatctcatatttgaaatgtatgagattcttggatagtgcaaaatacaatgtgtgcattacacactgaggaggctgctgcagtttctccaaacccctacaggctgggagacttttaagagacccttagacagtgtcacctttgtttatgcagttttcataaatttcttttacttggccgtagtctctgggtgatacttgttgtaacaggcaactattacagtacaagatatcctgcttcagatctgtgcagctctcctgggctcttagttggagtgaatcaaagcccctgcacacacatacacctgtgtgcacactctcgctttgacattcacctatccctctacttcccacctccagaaccctctgctgctggtgtttttctgtgtgtttgttttagatttttgctttttttagagaaaggtgtctcaccatgttgcccaggctagtctcgaactcctgagctcaaacaatccttccgcctcagtctcccaaactgctgggattacagatgtgagcactacacccagccaatctctgctgcttcttgctcatggcaccatccctttggctatcaaaaggtagctctcctggccatccctttgcataggccatagtggaagcttataatttgatcttggttttttcctttagctttgtcctttctgaaattcttcattttagcctagattcctcttataatagagcataacattccagcagtgctcaaggatgattcattgcctcaaagttgccacctctgaaagagtgtaatatgtccaccctactcattggcaggagggagaatctgattcttctaccccttctgctgctccaaatgataatagcagccaccacaaccacaggctcagcagataacacgcctagcccagagctgcacgtcctctgcctctcatttgcccaccacagatacccaataaaatagacaccgctagtatgagcttccttttgtggctgtgatgaattgctacatatttatggtttaaaatgtgcaaatttatctttttacacttgggtcagaagtccaaaatcggtctcattgggttaaagtcaaggtgtaggcaaggctggttccttccagaggctccaggggagaatccactttcttgatttttccagcttctcgggtcacctgcactccttggctcctgacgccttccttggtcttcaaagccagcagtgtggcgtctccagatatctttctttgacttctgcttccctgttcacatctccttctctgactcccatgtctctctcttacaaggaccttgttgggcccacccagataatctaggataagcccctcatctcaagatctttaatgacattgactaagtttcttttaccctgtaagataacatggtaagatattcacagttgttggggattaggatataggaatgtttgggaccattatttttctaaccaccctttttttttttttttttgagacgtagttttactctgtcacccaggctggagtgcagtggtatgatctcagctcactgcaacctccaccctccgggttcaaatgattctccttcctcagcctcctgagtagctaggactacaggtggctgccacagcgcccggctaattttttgtatttttagtacagatagggttttaccatcttggccaggctggtcttgaacttctgacctcgtgatccacccgcctcggcctcccaaagtgctgggattacaggcgtgagccacctcgcctggcctttctaaccacacttttatgcctgcctttgtaactgtgaagcgacttttgcagctcagagaggctgccccatgtgtccagcctccccagtgagtaaactgaaggcagggtttgaagtaggcaggatttgatcttggaacctgggctctaaaccactactacaccatatgctcacccgagcagtgcctaaatacccagcttcttagccaggctctcagcaacttgcaaggaagagtcatattttaattacctcttgagtctcatcgagcacatggaggagaccttgggatattgttgaggcttaatattgagttaaaatggtgattgtctcccttgtacaaatctacttctatttagacaacctaaggttactttggttttaaaaaatatcatttcacactaaccttgctttcattgaagacttctcttctgcttctttatcaaacgtggtgcttctgggccatgcctctcccgtcttttgataacaacaatattctcagagaacacagtgtcctgggctgaatgttacatgtagtcactcacttaatccatgcaccaaccccatcaggtgaaaaccattactgtccccacttagtaccgttatacctcaggctcactgttgtccagagtggagcagctgttcagtggcagagctgggactgaaactggggactctgtctcctgtgggcatgctgctaaccctctgagtattgtgagtctggatgggaggccagtggggatttatgttagacggtgccctgtggttgcaacaaatgaaaaccaacccagactttctttaacaaaggggaattgatgaatagatctctcccctaacaagaggctggagatatgagactggggagagcaggagccatgatgactctggagccctgaggtcggccccgggagctggcttgtagcagaggcagtggagtcagggcaccgccgctcaggggcgggactcacaaccccagatccgagggagcatctagtgcagctctcttaagttgtgtccattggcccttggggtgtggggagcaggtgcctttggtctctcttctgccaggttgtttctaagagaagaacattgcaatctggaaaagcagtattattgtagggtagaaatgaacacatggggaagagcatttaaaaccaaaaatgaaacagattattcatacagagtgtgccagaagctactggatcgaatctccttttgctccttaaatatttattgagcacctactgtgtggctggccctgtttcattcagaggatacgagggtgaatcaaatgtgcattgttaagttttatggatctaagttatcccttgagtggtggcctgatggcttggaagaggtaatacatctgtcagttctgacatccacggtggagagaaatgaatcctgccaaatggaaatgactctccagttccatgggggcacaggtggcctggaaaaagctaccccagtctgtgagcccagacagtccagaaggccccctcttagatctcaatcccagcgcatttaatttcagttttgtgtgaccctaatagagatccttcatcaagttttattcttcataaaagatccatttccatagactcataaagcaactccttctaattcagtgttattttatacatactttcattgctcgcatcaatcacaggcagccgacttcccagccatgaaacaacagcttgcaacatcaccatgttacccaatatgtatttacttatcaagttggagaacacatgtttgcaaaatcagcaacattacagctttactagcaatttgctagcactttcttcccgttgaacacggagtctgaattgtgtggtatttcactatcctggctcatttgtatcttgtaactgcagtagtcaccagcaccctgaaacctcctggagatccttgttgatcatacctggaacttcagccaggtcacttacctaacaggtgtggttctggagtcatcgatcatctgtcctgcactacaactcaaggatataggtcctatatgtccctcgggcttctggacctagcctaaagatgccccagacaagctgtaatgcagggcaaggtcctcaatagccactctgtagggagaattctggaaaattatcctacctgcaaaatgtaatgtgaaatatctgacatgagctgtgtggagctgagtagggaagttgggagaataaaccacacttcctgggtttgcctctcgtctcagccacttaccagctagataactgaggtgatgggcaagcggctttacctccctgggcctcagcttccctctccataaaatgggctaatgacacctgcctcatagggtttgtgggatgattaaatgcttgcaatgccctgagtcatctgctatggtacgaaccctcataaaggttagctccccatcactcctgcaccaacttttgtattcattcaggattatgcttttgtgtgtccctctgagcccatactcagccacttgccagtagtgatgatggagtggttatttgacttccctgagcctgagtctctttcttttaaaatagagatgatctaattaccctggcagggctattagaagaactatttctggtgcacagtccacacatgtatctcctcctccatggaattactgcaaaggtctcctcctcagtgccccctatattttacctgcatctttaagccaactttacacagtcataggtgtcagcccattttacagataaggaaattgagcctctgtaaggttgtgtatgttgctcagatcatgtagccagtaagtaaggtgccagagtctccatctgttcagcttctatcattccaaggattccactctcaaggccccacaccaggccagtagaataaaaatctctgggggagagtctcagacatcaagagaattttaaaatatcttcaatgagcagccagggttgcaaggcatacccccaggccatgtttgctcaacctcattctcatgtacggcccacatctggtgggtcccaccagaaaaaacaagagggtgggggaaatttagcagaagtatttcattaaaaaggaggatgtagcttagaattcagcaaattaaagcagaagccaaggaaatagcagttctctggtgtccaaagcaaggtcaagagctgggagcccgaggaataaactgtgaagccagcacagatctcccagaacagggaacccagagcttagggctggagaaggcactcccagagaaggtccaagcctagagcagtgactgtttgacttctgcccaggtacatcttgcttctcaccccatagggaaacaaccgctggaggagccaagtgttcagtgagccggtgcagttctggggccataatgatgaaaaggaaggcatgtgcattgttgcctgcgcagctgagtataggcactgaggccgagacactgagtgtccaggtgaccccctgtgtttcccaggccttccgccatctggctcctggctcttgaccacgactggctgcgtgatttgcagagcccattgtaaaatgaaaactcagggtcccttgttcaacaacaattaagaatgtcaagagggtgacaacagagcactaaacccagcacagggactgtctgagcaaggggttctgtgcaactgtgcaggtcacacgttcatgaagtccacctgctcttgagcttgccttagacaccaggtctggccgctgaagtgcaggcaagagtgctgtgtgtcgtttctgactgaagcgttcaatgagtcagcatgtgagtttgcaactctctgccgctcctgcagcagtcaggaagctgcatgttcaaggtggcctggctataagatgcaagggtctggatccctaagctgccacttggagagaggatctgccccttgaagtgaacccccaaagtggactgaatttgagtgagaaattaactttatgtgctaagccactgaaatgatagggttggactgttatctcattctagcctagcctaatatagtctatgtggtttttgttgttgttgttactgtttttgagacagggtctctctctgtcacccaggctggagtgcagtggtgtgatctcggctccctgcagccttcgcctctcgtgttcaagcagttctcacacctcagcctccccagtaactaggattacagggacatgccaccacgtttggctaaatttgtttgcatttttagtagagaaagggtttcaccatgttggccaggttggtcttggactcctgacctcgggtgatccacccacctcggcctcccaaagtgatgggattacaggcatgagccaccatgcctggcctatggtctgtgtttttaaagagcaaattgctgcgcctttgcccttaaatagatataaatgatagcgacaataagcccattgttcagaattaacccaggagttcattaatatttagtgtcagttaagtatcaattatttacctgcttcctactccagctttatattaccttaagctgtaaacgaagaaaaatgataaaaactcatcttttatttattcacttattcatgtatttattcacttgtgcatttggcaaatgtttactagactcttaatacatgcaaagcattattctggtgcctttgaacattttcatatttgtcagatatagagcagcatccttgatctctacccactagatgccaatatcacatctcctgccccagttgtaacaaccaaaagtatccccaggcattgccaaatgttccctagaggggctaaaatacccctcattgaaaaccactgctgtaaaaaggactaggcttgccatttaaaaatctcttaaattggctgggcgcagtggctcacacctgtaatcccagcactttgagaggccaaggtgggcagatcactcgaggtcgggagtttgagaccagcctggccaacatggtaaaaccatatctctactaaaaatacaaaaattagcaaggcgtggtggcgcatgcctgcaatccaagctacttggaaggctgaggcatgagaatcacttgaacctgggggacagaggttgctgtgagcccagattacgccactgcactccagcctgcactccagtgacaaagcgagactgtctcaaaaaaaactcttaaattggttaaacaaacaaaaaaaaccacaccgtgtccttttgttgtttttaagagtttatggaaaaatatattggagagttacaattacttcaggctaattcaatataaagagtatttttattattagtttggaatattaaagtttccacttaaaattgattttttgaagtgttttcaggcaacatcatttaattcagcatagagtatcctatgtctttcaaaaagaacttcatgggaatggtagataaaaagattaagtggaatttttaaggggtgtaagaaaaatcttactgtcgaagtctggataaaaggaagaaattaggacagtaaaatgaatcatgatgggggaccccagttttggccatgtgtcacctaatatgtcataaacagttcttcagcttcattaaagaatagcttaccagaaagaagggcagacactggaggctgaactgcagcgaatgaaaacctgaaataatcacaaggtggtcctgttgccatcatctctttatcagtataaaaataaacaacctttgaaaacagatggagacagtcattgctcaacttgtcataacttattacatatttggctgtcaatttgtacttaaaaaaccaactagctccagggaggcaaagcaaagtggagaggagaagcgaagcctgttgcatttcaattcaagcctgtggtaatttcagctgcatggagacacttaggactgtttttaaatgaagtcagcaactgtcccaaaatttaaggcattctcattttaaagagcacagttgtgttcctatgggatggcacttcctcacctcaaacctgtatcaggagtatatatatctcgtgcccgtttagtcagtgctgctctcccacagggtgagatctctctgagccagatcattctcggacagatgatgaatttttctgttccaaacagggaggtgggaggaggaagggcaaaatgtttcccatggatgtaccactttttaaagttgtaatctggagtactcatcaacaacatctaattcgtgcctttgggggaaagaatggctctaccaacagacaaggtcaaaagctggtgggcctcagaccgaagcttgccataacctcttttgtttggccttctagtcccactgagtgatcttttattttttaaatttgaactagtgtctaaaaatccaaattcccaccttttcttaaaaaatcaaaagatggctggacgcggtggctcatacctgtaatcccagcactttgggaggccgagtcgggtggatcacgaggtcaggagatcgagaccatcctgactaacatggtgaaacctcatctctactaaaaatataaaaaattagccaggcttggtggtcccagctgcttgaggcagaagaatggcatgaacccaagaggcggagcttgcagtgagccgagatcacgccactgcactccagcctgggcaacagagcaagactccgtctcaaaaaaaaaaaaaacatcaaaagatctggctagtccagacttgtatttcagacatgcagtaattcctttgagctaaaaggcagctgccgcctgaggcaggaggcacacgctccagtttgccaccaaccccacctctcccggttgccttgagagcgctttactcatgtgaagctacctgtatgggcactgggtgagtaggtgagcttctcactcctggcccagctcccagtctgaccacagagagtcccacctttgaggccagtggaactaggctcctgttagaggactgaccaaaggtcattagcatcttcatcaaaactcacattatcaagcactttctggatcaaatgcacagctggaccaccatatgaaaatgtgggaggggtccttgtgctggtgaataacaacccctggataactgggcaacccagggaagggccgccaaaggagcaagggttacaaagccaaatctcccagaccttgccttaggcctaagcctgcttccttcttctcttttccccaaaattgggctggaatcacctcttttctctgccactctgcagttccatcctcctaccctcagagtacaggggcagggatttctttaacagtcttcacacccagaactgagaaccaacctcccacctggctggccagtagagtcttttgaagatgagaaaaaaaaaaaaaaaaagaaaaaaagaaaaagctgaatgatgagcagtggcctccaattggacatcccctcaaatgaaaataaagccagtccaaatgtaagccagtgggaaaatgagacattatttacaattcatcacatgggtagctttccaggaacacatgccctgccaaacgtgggctgcctctggatccctatcaggttggttggttatctttcatcaactagtcattcgacagtttccctatcaattgctgtctactcaagaatgtccacaagaccagaggaagcggatgcatgcatatgtgcactcaacagaagtatctaggcttgtctaagggaagaaaggaattgtttcctaacaagattttaagtaactcctgtttctgtagatcctgagagtgagtcctagaagcagtgtgtcttaaaccctaagtggttgggtcccacaagctatttccctcgtcatgattgcactcagcagtgggtcctcacagaactgagttctaaattgtgagagtcaatgaaaataacaaacttacatttctcagctgggcgcggtggttcacacctgtaatcccagcactttgacgggcagatcacgagttcaggagatcgagaccatcctggctaacatggtgaaaccccatctctactaaaaatacaaaaaaattagccgggcgtagtggcagacacctgtagtcccagctactcaggaggctgaggcaggagaatggcatgaacccgggaggcggagcttgcagtgagccaagattgcaccactgcactccagcctggtggactgagtgagactccgtctccaaaaaaaaacttacatttctccattacttaccatcatcctggcattggactttatatagattaatttgtgcattctcaaagggggtaatattacttctaagcaagagaaagttggtcattaggagagaggggtttatcacatcagatgtattagatattacaatggcttgtgccctgcaaggggccatagcacataaatagatacacggtattctatagaattaacgttttgtgatggagtgagagggtgtcaagtcgaataaatgtctgaaaatattcttgggggaaggtgttaatggaaacacaagaggctcagagagcattgattcactcaatgcctccaacaacccatgagagaagagccattttgtcaatgaaaagttgaggtggggcgtgatggctcacatctgtaatcccagcactttgggaggacaacgtgggcagatcgcttgactccaggggttcaagaccagcccaggcaacatgacaaaaccccatctctacaaaaattagccaggcatagtggtgcgcacctatagtcccagctaattgggaggctgaggtgggaggatcacttgagcctgggaggtcaaggctgcagtgagctgtgatcataccactgcgctccaacctaggtgacagagggagaccctgtctcaaacaacaacaataaaatttggggcttaactgcccagagaagcccagcaggtgaggccaggttttaaaaatagatagcccaggtcctcagccgggccactggcttgattctgctttggttttgcacaccagggtctctttctttgttactgaggacggttaggagagaactggctcatgtccacctgcttggtcaggaaacaattttagattggtgtgtttggggtggccagttgagtgaatggctgtaggctgtgtcccaggcactacagtcacatttgcaacaattctcacattggcagtctgctgctcatgacgaagagacgtgtctacacctgaaagcaaaacttggcctgcagggtgaccacctcattctggtttgcccaggagtgtcctggaatcccctcagtcctgggagaactatctggttctcatttggaaccaggaggccccaaacccattcaaactaaagaatcttcaatggaaatttagtttccaatgagaatcgttccaactagatattccccaaaatgctagaatttaaaatagcagcttctacatctgtctcacctggctaagcaccctaagctgctgctggtctaaggcttgtcttctgacacaggggcaaacacacaagtaacgttgtgcactacaggatccatgaccacattctccttttgaagcaccactattagatcattcggtcacagaaagcatggtttgattggaattagaactcactgcctcctctggtgagtttgatgcttgacaacgatgtgccattttgtcacatcaaagaggttcacctggtgacatctgccatctctgctcatgtttgctttaacatcacacttctccctggaaagcacactgttgccctaactgtgctatcagaaatccagtgctgaatatagatctgaatgtctatgtctcaatacgtgattcgcttataggaatagcattttgtaaaaaatgagcctgacactttttgatcaggcaaaggaaatgtttagggatggagtcaaagaaatgttaagaacagcataattttgtcactgtcttttggagcatccccatcctcatggccagctgaaaaccccccgtcactctcagatctgcgctctcctttctcaaggggttggccgtgcttgaagtcacaggaaagcaaaacttcaaagctggctttcaaggtcaagaaaccaggcggcacttgctttaatgagagagctgcagtcaggaggaaggggctacctggccacaaggaagcgatcacacttgttaatcagcctgtcaggctggcggccgtgtccttcggcaaaagaaaatgacggcccaacttgagactttcaaccaggaacctgggatgttttcttccccctttggaggagctgctgctagttcatctggctcagggagtgacagggtgattataatttattttgtcactcaggagagtattgtgacgggggaaaagacagaaatgtactgtgtggaagccccaatgcgtgtctgtcatataattaccctttctctgctgtctggaaacacaagacaagcccggataggaagctgcatgagctggtgaaaacaaagtggtggacatggagtccagtgtgtgggactgcataagaggagaggcacaggcatcacccacaggcaattggagcaggtgcactgaggcccacctgctgcatgtcagccctgggcatagcattggtatgtgacccaggaatcccattccagcaaggacctccaaggcgcattgaacagggagctcagaggcagtcgtggaaaatctccaggcacgttgctcagttgttcattcttcttggaagacaaggtactggtggctctggtcagtgtggaatgaggcaacactacagtgaatggcaagaagccaattcaacccaaagaacactgatgaggacctaccgcgtgtcagacactgggcttacaaaatgaacacaacagtctataccctccaagagctcacatctaggaccatgtggcccatcacaaaaagatagacagttctgaaataaagaggttccatcaacagcaaagtttggtgagtgctgcagagagacaccctctcttggagattgatgctgtaagcgtgcttaatagaggcactgaagagtcctctggggaaaccttgctttgcggtgtttgccacgtatttcccaaatctgtttctcgactgaatctatggagccagagttcctcggaaccaatttagagaatgctggtttaggaggtttatccagcctttgcagaacacagaagtaaggaaaccatgatccagcctccaggggaaggtactggcaagagccaagcattgcactcagcagataggttggggttcaaagtaaagcctggtcttagaggccgactagaggaccacgtggagacatggtgtagactacagaatgtgtgtgtgcacgtgtgtgtgtgttgttgtgatatccacagtagaaacccagatctgcacactaagaccatgggcagggtgggagaagggacccggtgagagagagggctgtcctgcgaccctttgtcccacattctttggacaacttaatcctagtctcctgtatctgaggcctttgcctgcactgccataattggctcagaacccaggacagagttggataatgcaaggcttcctctctgaacactaatgtactaggcactgtaccaagttctgaaaataggtcatcccatgaaatcctcacaacaaccaaaggggaatgttgaaaacagggaaaccgaggctcagagagagatgaataatgtggccacggtcacgcagcttgaaaagacttgaacccagatacgtcacctcagagtcgttgtcttcaatgctgcaaacctatttacataactcaggcacaatgcggttccctcagaggcgcgatttcctccagagtaaatccagtgatgcattcgtgtctgggtgaagacaaacacggggcttaagaccgagttcacctgttccctaacaatccattaaaataaaaaccattttctgtgtatgcttgggaatattccaggataattttgtgttacatcatgttatccaacctgtaaacaaaaagatatcctcagtgaatttcctgatgaaaactaaagactcatcaacctgaaaggtcttttttttttttttcttcctctaatcattttaatgcatatgtcagttgcaagccatgatgacttcatttttataccttccatgacttcaattaaaggcagattaaatagggcacaaatccaatcaatcgagcattcattagacattaactaagtgcaaggccctgggtcaagtgtacttaactggagactggtgtggaattgatggggttaaggcctcctcctatgtctttggccacatggagctccctttagcatgtccctgggtaagatcgcaggcctgaaatctgcctctgatttctgatggggatatccttaagtttgcctagatcaggaagtttaatatgtgtcacatttcacatcagtttccatagactgtgagtggctgcctagaccactgttggataacactaattctgtagcatgtcaatgggagacagagtcatgctgttcctgctgtcttccagagacaggggggctgcatgggccaagaatgttcttttctgaagctgaaccttgaagcttgccctgagaccatctcacagggcaaagaagctaggtggataggaagtgcaccttgaagcatgtggccggatggcaccattggtgaaaatagctgagactgcctaacaaatcaatccaaccttgagggtggccagatcttcgttgtttatctgatcaatcaggcctaatgactgatactctgattccagtggtgggggaaaaaaaactggctttgatgattagagaagcattgctatggaaggaaaaggaattctgggtggtggtaaaaccagatgaattctatctttcctttaggcttcagtgttttctttgtatgactattcctgctgctttgttgaatagacatctgcggctttgatctcttccggttaggtcacactttgtgagtccagacagattcaaaatcagaagatgggccttatatttgtagaagactatattgggataaaaagttatggttaggcaggatgccctaatccaaatgtggtagcaatacaattgctattgtcaatcatcaaaaccagcaggcatgtttttgttggtgcttataattatgctctttgtaaattaaattttaattgccaaagcaatacattcaccttgtaaaaataaacaaaatgttatagatgaggccaacatctttcccgatgaccatgccaaatcccaatcccctctcttcttctccagatttaaccaccattaccagggagaagttctccttatagagttgttctatgcacttataaactgtacctgtaaaacatgtgaataaagtattgtggcatgttctgtgtgtaagcatgttcacaaaaatggtatcactatccccctgtgggtaaggaaagttaaaacgtgccacatttcacatcagtttctgtatacttcaagttgctacctagaccactgtttgagaacgctgattccatgacaaggtcaatgggaaacagaaccatgttgttcctgctgccatccaaaggcaagggggctgcatgggccaggaatgttctcttctggtgctgaaccccaaacattcctcaacctaacatttttactaattaatatatcttgaagagtttcccacattagaacccattagatctacagtctttttaagctgctgcaaaatatctcagtgtgagaatactatcattttggcaattcccctgttgatgaacagctaggctgtttccaaatttttcaccttgacagataattcagctagaaatttatttgcacagatcccttgcggacacgtgcagttgtttctgaaagtagatgccaaggaggcgaaggcattgtttttactctttgctgcccaatggtccttgacaatggatataccagtttccctttatatcagctgcatgggagggagacccattatctgacacccttatcaatcattgacataatccaacactccacatgcttgttatagaatcaggtcctatttgtatgactcttgcttgtttgtgagtgaacccaaccatgttaccctcattttatattggaagtccctaaaataacacggctgctacatagtaggtacacattagtgtttgctctcattccctttaactggaatgcctttttgctctgaggtccctttgacttgttcctgcctactctcttcttacgggtcctcatcagacacctttgtgcaaaccccagactagataaggttgttcatctctgtattcataatgccctctctcagtgtgcctgataagtcttattgtttgttatatatttatctcttctactgatttctgagctcctgcacacccaggagcatgcctctttgtactcctgtttccccaacacgcagcccaggcacatggagttggcattgaatcagagctttaaaaatgaaggccatggctagatggaatcttgtaatcccagcacccttggaggccgaggcaggtggatcagctgaggtcaggagttcaagacaagcctggctaaaatggttaaaccccatttataccaaaaatacaaatattaactgggcgtgatgacacacaactgtaatcccagctacttaggaggctgaggcaggagaatcacttgaacctgggaggcggaggttgcagtaagccaagatcacgccgctgcactccggcttgggtgacagagcgagactctgtctaaaaaaatgaatgtccctgtcacaaagccacatccacagtggaatgaaagcccctgaaaataaacagtgtatcaccagagggaaaaattaagcagtcactctgctgaacagcaaagatgttttcttctttatttcaggtcttttcatggaatgaaacagagagggaaaggaggaagaaaagctgaaacatagcaaagcttgggaaatacttttcttttttaatttggaaagtgatgggcacactgctgcactgctattgcccaggtggggaaggggctctggccgttgttgacccattgataaccattccgtgcctttctgtcttgccccggtaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagaggtgagctgaaaagaatacactttctttttcacgagaatagaatgtggctttcatgcaagggatgatgtggggctccagtcagtggttttttttaatactgtaaaggcagaaatgaggtgtttaccatgttttggtggggaaaatctataaagggaaatgggatattatgtgacccaagaaaacacgtgctctaaaaggctaaagcgcctggaactgtttgtattcactcaacctgatgcctatttcctcaacagccacttattctctaggccctggtgattctagactctgcctctggcccctgctttaatgctagaagggagagggaaggacaagggaaggaggggaagggaggagaggtggcttcatccaagatcacacaggctgtccttgttgcagagtcaaatgcccatgactcctttctccaaccctttgctgcaggcatcctgcattcccccttgaacccctctcttcctccatctctgttctcatccctttaggctttctccgtgaaatctcccccgtctcctgggtcacatgtcacaaacaggtgacccctggcccagtcagtccacatgcctgctctttcgttttgcctgcagtgttttacagcttttagaattagttgtcatatcaaaatatttagatttcacgtttctgttttaaaaatgccaatttccagtttttctggacatcagaaatcctggagacatcaggtccactttccacatgtgcactatcggtggtgtgaggtgtgatgctccagtggatccagggtctgctgtcccctttagatgggacatgtgctcccacctcgattacgtttccacgtgcatgggcccctctggtcctgccctttcctgagtttgaggtccaccgtgtagcttaccataagctactttaagtagaagaccctcgcggacctccaaacacagcatccttaaaccaactcgtggattcctacccatccttcactctccatccaccctaaacctgctaccattctggaattccctgctcctgacatcatcccacaggcgtggggccttggagttgtccttgaccttctgtaagaaccatcagctccacgtaactgctgggcttccctcgggggctctgtgcatttccccctcagtgtttttgatgaaataaatccatggttcggagtgttgtttcctctgctttctcctctcttatgtgctatagtttctcaagagattctggattacatcaaccccttctaagaagctgtcctcatccacctgattcttccacagtcttgttcttcctcccatctctgactactcttgcctgtagccatcatatagcagttggcatgtgctaattaggttgtcatttgtctctgaagaagattctctttctcttggtctagacctgaattgtccagtagagtaaccactagtcacatggggttattgcaattttaaagtatattaattgaaatcaagatgtaaaaatcagcttcacagtcacagacacatctcaagtgctcagcagtcatatgtggttggtggctattgtaccggacagtgcagacctagaacacttccatcaccccagaaggttctactgggcaacaatggcctagactgtatgtttcctgacaacagagactgtggtcatatgcatgtttatatttctactgcctagcatggttgaagtacttctaaaaatcctaattatatgtttgttggcatagagggaaaaaaaggaaaaagagttggaaataaaactaagatcttacataagctgtgagaaacagaagctagaaataggtaattattgaaagggagagacagagaaatttgcattgaaactctgattgtcctttggaaaatgtaatcgtttctagttaaagaatagggaagtagaaaaagtaatgagtccattatattcatttcatctcccattctctttccaaccctccctatttttttatttttttattttttttattttattttatgagacagagtcttgctctgtcacccaggttggagtgcagtggcacgatctcagctcactgcaacctccacttcccaggttgaagcaattctcctgtctcagcctcctgagtagctgggaatacaggcgcctgccaccacacctggctaatttttatatttttagtagagatggggtttcactatattggtcaggcttgtcccaaactcctgaccttaggtgatctgcccacctcggcctcccagtgtgctgggattacagggatgagccactgcgcccggccaatgctccctatttttatgactgacatattttcttcttttggaggccagtgatgacttcccaaggctctctattccccacttgacacgtgtgtgcaggtgcacacacacatgccagcttttctatagtccttaatgctcccaaagcttctcacaagatcctttcacaagaaaaagatgaagcatggtgatttctccgtttcagcttctctttgttctgagagaaaatattttataagtctctatttataaatcaaagtgataatgtagtaaattatcccatttttaaagtttattttaggggacaaatgtgtttccagctcatgatcttttcatttgggctttcattaagttgtaataagtatgtaattatggaagttgaattaagcatttctagtcacaaaacatcaacagccccccaaaaaagatcaactcaatttaaccgaaattggaaaatcaatgaaaatgaataaagagtgtcactcttctgtgagggtttccagagttcattgctgatccaggcaacatcagtgcaatccaaaggaaagaaatgtccctaaatttaggcaagctttggctagttccttgtgctgtgataagcttcacttcagcatgtttgctgaggaggtggaacgtgattccaagttcttgtctttgagggtaaaaaacttgcacatcagatgtccagtggagttccccagagtttgcaatgttttcctcccattgagacttggcactttttgtaggattcacatggatgcgatactttcttcagcaggtttgtgagattttattattaatattatttctgaagaccttctgagaaggcctgtcttaggtgtggttttaaagtctacttctcagccagatgggcagaaaaaacatttaatacagacttttgcagcattcatttaagaaagtatcccatttgggaccctgtggactttgagatgattcaagttgattttaaggtttgttaccttgtctcctgtcttcattcgcagtatctcaaattgcgtgttggaacaatgaatatagtgattccagttctgtcacaaactccttcaagagcaggagctgcagaaaccacacacacacacacacacacacacacacacacacacacagctcaccagcacctctggctctcacctgaatgagggacaaagcaaacgtgtgtttcctggcttgttgggagtggatactctggaatcccattgggtgacacgagctaagttgacacaataacaatttttcatctttattttccatttagtcaatttcctttcttaagtgcatctaccaaggaggaccccagcaggaagtgtttaaccaagggagaggcagatgatgcaagatgagtggggaggtggcaggcactgggaattttctgtgaatctgcctacctaatcatcttccctgccttttatagattcactttgtaacaaggcttgtaactgaggatagtcacacagggcagtgtagaaatgatccttactatgttgtcactttggttgttatcctttcttcttcccaccctcctcccttcccaggatgtctcacatggagccatctgaggcaggtgcactcatctaatctgctcctctcctgctccaaggattggcagccactattcttgaaagagtctatggcctatctgcttgcactcaccatagtcaatgctcaaacatgcaatttgtgggatgatgtttggcttgcccatgacctattgccagtacctagcacatgagagatgctcaaagaaatatctgttgagagttgaaaggcgggaaggaagtgaggaagacagcgtgattcacactggcttgaaagcaggtgaactggccatttcttccccttccatatcttaagctccgcattaatagatatcaagtttccccaagacatgtgcgttttccattacacgctcatccatttacttgttcggaaaaccctaccagaatatacgcttctggaagaaagggaccttggatttctgttctctctctctattcccattgccaaatatagcaccagataaataataggcactggataaagatctgttaggttatcagggtggatgagtggatgacctgtgttccttaagtttgtattatctcagaacattctgcaggatccacattctggcatggatatataaacagaggaagttactttattataggtgaaagcttagtcttacccttgtgcaatcatctggtaatctaatttattcactttatgtttaccttctgcaggaactgctttaagaaatagtgtcttggtccactgggtgaataggatggacaggagtatctgtgcctcttgcttaagtgtttggggagatgtttgcggaaaataagagccatatattccagtaaatgaaattaggttcatttggggcacttttttattattttctatagccatacttagccccccatttctggcatctctgtctatgtttttaaactatgtctggctgcactacaaaataaaatcagataaaggtctctaacgtttgataaatgttttatttagttgatcatcttggctgctagactgaaattcatctgctggaatctgccagctttctgaacacagccacaatttgcaactactcagagtaactaatggtcagggttttttttttttttcttttttaatggaaatagtttccaaaatagactcataaaaaagcaatcttaacatttgcattgagaaagtatcattagtctttttaaggggtttgagctgagcacttttctgtctttgtttgaatttgcctttaccttattatctattatcttccagataatctagggaaagtgatagcctgcccgtgaaaatgtacatataatacaagatattagggctgtgaatgtaatttgttttgtattttcagctggtaacgcactttctgaaactttataatgcccaaatttttaggccagatgtaaaaatggagagaatttctttctttctttccatggtaagtgttacataaggacttagtcttagatttatgtgcatttacttgctatgagatattcaagagtccttgaatatgtcagagaagaaaactgaagaatgttagggagaacatcctatgccatctagccaacgaatttggatgtgtagctgcaagcccaaagagaactatgtatttggtcaaaatgacccatgttaaaatattgtcacgtagcatgcatctccagaaacatactaaagacatctgtgaaaatgatgatatcaaatcaagctgccagaaaagaacaatggtaaaaaaggatagcatttcctccagtgccttcaatgaaagatagaggtagtagtcatactcttaggaaaataaatgtttttaggcctttctgatttaatgctaatacttttctcattatcatcatgtttaaaacattggcagtaattacacacaattcaatcatgctgtcaggaatattatcttgctttgttttggtgggtgggaccagaatgattcagatagtagcatcctcacaatttcttcgagctatttactcataaatatttctgttggggtaattttccccattttttttatcacttgctgctgtgaaaattgagatggaaaaagtagatgtaaataaattgccttattatttttaaaataatgcattatcctttcaaatgaaacacagctaaccaccctatgctaattgcacttgctccgttgtttcagcaaataaagtagaataggacattcaaaaggcagaatgctaagtcctggggtctgaaatttagttccatgagtgcaggcctcctgctgatggcaatggggattggtgggagggttagagatggggaaggccagggtctttatcttgtggcctcatttgctcctccactctggataaattctagaagaagaccttgatgagtctcaggactccactggtaaccgtaaccacttcccccatccctcttagtgtgacctatcaatccattaaagctaagaccgtggctagtctcttagtatgaccgcaatttagttgaaacctggcttcagagaaatgggccaagggcatagactacctgtgttttttgttgttgttgttgttgtttttggttttttgtttgtttgtcagttgtgagacctctctaaacctcgatttcttcatctgccacagtgagaataatcacaatcccaatctcattggcttattgaaaaaattcaaataagatgtgccaagtactagcgtgatacttatctataagcactctgtaaatattagttggtattagatgtttccatgattgacaatgagactgaagaagcagaaagaagttggagtttctcctacaggacgtacatttacactttgcccacacggcagagactatggcaagtttctttaaattgaatgaaagacagagctaatccagcctacaaaattcagcaataaaagctagtaaataagtattgagcaccacaaatgtctgctgaactcatggtgctggatatcaggacgcaaagattgagctgcctgcattggaggtaaagcagatatgtcgacagcacacgcatgcaaagatgtgctgttcaaaccgaaccttgatggctgtgtggaaacctggagtgcggaagcagaaggaagggcatcgtggggaaaggagtggcatggacaaaggcatggcatattcacatgctacttaaagactccagagatgaggctgtggtatagagagataccagaaaagggcagggagtttgaacaagattgcaaaaggcttctaatgtcattcaaacgattatagctatatcctactgtaaatgggaaaccaccattatttaaacattaaacacagctctgttcaacacagcattcacagagctgtgacttggacagaaaatgagttaagctaaaggagagatcgtcagtggcaaagttcaggcgttttggagacaggttgagactgacaagttggttctcgacatttctagcctgatggagataagagctgaggagctaccacttgaatctaaattctgagcttgttaaatagattaataaacctcagtccgtaggtattttctttcttctgttcttgggcttcttaaagtatcagacaatcagtagttactgggcacatgttgaatcaagagacacttaactttatcatgaagaaagattcatctttttagatttaacaaatgtttaattctctaagatatttcttttctttttggtattttatatggtaaagataatttgcagagtgatgatgaatttagagtacttctcttttttgtcattttaaatttcttcattttattttatatgaagtaccctaaaaagctaaagaatgttttcatttttggaaaaagttcttttcgagagctgtttatttttctttatcagccaaaaagtatgattactatgttaatgcaggttttgcttcatcaagagattttccagttattgaacttaaataacattgttctaaaccccaaatcctctaaattcctgttgtcagtgaaagaggtaccttctaatttggaaagaatatctagttcagttctgatttcaaaccagcagagaaaaataagaaaaatgttgctcctgccatatggagaatgaccatcatttaaggaaagaaaagttggttgagagtttttgggaagtaactgttttgtacttcctttaatgtactcagtgtccagagcaggaactgggtggttagaacagctgcaatatgattccactggaaagcagtttgcagagaggcaatcaaaagctgcaacacttagattaaggcaaactaatgatagaccatttcaagacatgatgacatctcaaaatgcctgggatccacatttctttcacttttgttttaagaggtatctcatttgctgtgccttttcataggataaaagcttgttgatcgtattatttagttgaacactttggggttctaaaagccgtgatcaaccttattggacatatggcactatgatgtcacattcaacaatgaaaggcacttcaagttataggatcatctattgcattggaggtcaggaaactttttttttaaagggccaaatagtaaatcgtatagactttcttggccaacaggcaaacttgaagatattattatcaacagaaagagtcaaactctataaaatttgaagagatttattacttcattctgaaccaaatatgagtgaccatggccactgactcagccctcaggagaccctgagaacatatgcccaaggtggtcgggccacaaataagttttatacattttagggggacataagccattaatcaatacttgtaaaatgtacaatggttcggtctggaaaggcaggacaactggaggagggtgtgtttccaggttataggtggattcaaatattttgtttggcaattggttgaaagagtttaaagacctggaatcaatagaaaggaaatgtctagcttaagataaggggttgtggagactgaggttcttactatgtagacgaagcctccaggtagcaggcttcagagagactagatggtaaatgtttcttgtcagactttaaaaggtatcagactcttagttaattctctcttggatcaagaaaaaggcatgagaaggggaaaagggattttctacaaaatatagtttttttcccccataagagacagctttgcaggactatttcaagatagggcaaagaaacatatttggggttaaaatatttttatttccttccttatctgtcatgtgatgttattgccagagtcaggctggaaagtaagccacattatgtagggttaaatgaaagccctcttttgagactttttggcttgtagagcatgattccccagatgtcttagataggaatttgggcaagtgaagaaaaaaggtcagagtttagtcctcattatgcaggtacttatataaccattaacagacaaacagagagccaaatcatgagtgaactcccattcacaattgcttcaaagagaataaaatgcctaggaatccaactgacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcagtgccatccccatcaagctaccaatgactttcttcacagaattggaaaaaactactttaaagtaagtatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctagccatatgtagaaagctgaaactggatcccttccttacaccttatacaaaaatcaattcaagatggattaaagacttaaacgttagacctaaaaaccataaaaaccctagaagaaaacctaggctttaccattcaggacataggcatgggcaaggacttcatgtctaaaacaccaaaagcaatggcaacaaaagacaaaattgacaaatgggatctaattaaacgaaagagcttctgcacagcaaaagaaactaccatcagagtgaacaggcgacctacaaaatggggaaaattttcgcaacatactcatctgacaaagggctaatatccagaatctacaatgaactcaaacaaatttacaagaaaaaaacaaacaaccccatcaaaaagtgggcgaaggacatgaacagacacttctcaaaagaagacgtttatgcagccaaaaaacacatgaaaaaatgctcatcatcactggccatcagagaaatgcaaatcaaaaccacaatgagataccatctcacaccagttagaatggcgatcattcaaatgtcaggaaacaacaggtgctggagaggatgtggagaaataggaacgcttttacactgttggtgggactgtaaagtagttcaaccattgtggaagtcagtgtggcgtttcctcagggatctagaactggaagtaccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcgtttgtagggacatggatgaaattggaagtcatcattctcagtaaactatcacaagaacaaaaaaccaaacaccgcatattctcactcataggtgggaactgaacagtgaaatcacatggacacaggaaggggaatatcacactctggggactgttgtggggtggggggagggggaagggatagcattgggagaaatacataatgctagatgacgagttggtgggtgcagcgcaccagcatggcacatgtatacatatgtaactaacctgcacaatgtgcacatgtaccctaaaactttaataaaaaaaaaagtgaccattaaaaattataaaaagcattttaaagctcatgcgtcatcaaaacatagacagcaggctggatttgaccaacgggccatagttggccagcactggtctattagatcattggccacaatgctcagataggagcagttttatgtactgactgcagcatgttatcatatgtctatatctgaagtccactctcaaaatattaactcacacttattaatcatcaccttgaagtttgattatagggacagaaactaatcatgggtgatgggtctgatttcacattttgacagcatagttcatttctcccaccattaagaaacaggcaacctcagacagacacttggtaattaaatctagctcaaaatttggttacagtaatttttaaaaagcagtccaacagaaaaagagtaaacgaaaaagtgccatctagacattgactaaatattggagggaaccatcttggaatggctactttcattatgttagagccctgataggtgagaggagagggggcaaggggagacggagatgggaacagaagatttcccagatgaggggcactccctggagctgagtcttggagccagatggacttgttcacaccagcatggagtgaaataaggagaatcagaggacctgggctcataccctgtctctagaggctccaaaggagtccctgaggtaaaactgagattattctagagccacctggaaacaaaaagacactctggaccaggcttgggacattttcctgaaggtttcttccacctctcattgccctttctgtcattcctgaatttgagaatggggctgtgataacaaagaaactgaaagaacagtgtcaccatgtgtcttacatatcaccatgtgtcagtccctagaaaacgtactttatatggcatttgactttgataggaatctaatgaggtcagtaaagtgccctggttacagagatagagacctcaatgtcactaagatttaaacccctatcagcccatctccaaagcccatgcattttttctcccactatacaaatcaatattattgatatttatatgtgtggtaagcttgcagaataaatagattttgaactttctttttaacacagaaaagcaaaatacagtgaagttttggtggaactttcattctcatcaggccataggcttcagtgccgcattatcatatgggccaggtgggctttttccaggttactgagcccagtggcttctatagctcggttttaggaggctatggagaacagactctctcctgcccttggggggaaatgcaaatcaatacaggtcatttgttgagtattttgtcaataagaatcaaatggctttttaaagtacccctagtgttttttgatgcagaagtttcttgtgatcaaatacgtgtgcaaagatccagcaacaagggtttttgttggatctttgtttaaagcaccaaatgaaatggccaaccagtgggggtttgttcagtaaattatggtatattcctacactggtattctattaaatcatgtaaaatgatgtggcaaaatgtttaataatatagaaagatgttcaccatgtatcagcaggtggtttgcaaaatactccttaagctgtgatacttctttgtttatacacgtagagcatcttggtccaaggtacaaaaggatttgtgtgatgttttaggagtggtcctgttgggactatggttgattttaacttttccacagtgcagtgtctgagatgaccgtcttcagatctgggttgcttgagtctgaactttaacttcacctttcaccagccttgtgctagagaaacatcattagcttgaacaaccagtaaccataattatgatttgcatgtcataaaacattcttctctcatatcattgttaatgctccctgagaattcccttatcataatatggagaacaaatcccttttggttaaaactatgccttggtttcttcaactgtaaatcacagtaatgcctctctcaaagggctgtcatgaagagcaaatgaattaatacagcacatgcttaggagggtaatagctgagcatgagctattgctgttatctgtattttctagtttgggtgcagtggccacatgttatttttgtaatttagaaaaccaattctgttaatctttttttttgagacgaagtctcgctattattgctcaagctgtagtgcaatggcacgatctcagctcactgcaatctccacctcccgggttcaagcaattcttctgcttcagcctcccaagtagctgggattacaggcgcctgccaccacgcgcagctaatttttgtatttttagtagagatggggtttcaccatgttggccaggctggtcttgaactcatgacttcaggcgatccgcccacctcggcctcccaaagccctgggattacaggtgtgagccactgcacccggcccaattctgttaatcattttaaaaagcagttgtatcagtggtcgtaaggcaagagaaaggttaggatataacaccatgatgggtcaagcaacactatcacatttgaattcagacactagtttctttcttctccttcttcttcttcttcttcttcttcttcttcttcttcttcttcttcttcttcttcttcttctccttctccttctccttctccttctcctcctcctcctcctcctcctcctcctcctcctccttcttccttcttccttcttctttcttcttcttcttcttcctcttctcctccccctcctcttctcctccccctcctcctccccctccttctccccctcctccgcctcctcctccccctccttctccccttcctccctcctcctccccctccccctcctcctccctcctcctccccctcctcctccctctccctcctcctccctctccctcctcctccctcctcctctttttttttttgagatggcgtctcactctgtcacccaggctggagtgcaatggcacgatcttggcttaccacaacctcagactcctggattcaagcaattctcgcacctcagcctcctgagtagctgggattacaggaaaggcacccaccatcttgcccggctaatttttgttttatttttgtggagacggggtttcaccatgttggccaggctggtctcaaactcctgacctcaggcgatccacccgcctcggcctcccaaagtattgggattgcaggcataagccaccacaaccggcctagagactggtttctatatgagccagtttatttgttgaccaaacagagggagttgtgccaggaatcatggcctccgttaatgtttttaagattgcaggggaagcattccaaatgttttcaaaggtgtattaaggtaagtcttgtcaaaacattcccacttgaaataataagcattcttatttctttaagtaacagagacatagcaatggctttcctggctaaacgtgatcatcacagacacactgaccagctgtttatctttgcttccacaaattccaacaggcaacttaatagacattttgtggttatatgtttctaagacagccatgggaaatgaatttatttctacctttgtgaagaacagctatagaaatgaccattgaaattcagtgaatggcatttctgcttatgggccttaaaactgggaaccaaaattaaattcttttaggtattttctctcccgtgtcttctaaattgttgtgtgggctgatttttctccatgaaagactctcagagtcctaaattcaggttttctgtctccttgggctctagcattctggaataagcaagagtcaagagattctccattcttatttcctctgcatgttagaatatctaataggtgtgagacagtttatgttgtgctcagcattggacagccaccatgtaaacaattacggcgttttttcatccaggcattacattaggtccataacactcacaggagctctgtaaggctgaaattgccacatccattctactaggagggttatggagttcccaagggctgacctgcctttcctgagtcacccactggagagccagggcattggatttgacctcatagccgctgctctatccactcccttgggctattaaagaaaagcacgggacatattgatggaaaaaatctgacagatgtctcaaggacaactttatcttttatcagactcatttcagggatttctgtattcattgctcctggacttttcacatatttggggagcttgattgagtttccctcagctcttccattagaaagcccatgtggtacagtggctcagagcttgggcttaggaattcacaaatgtgaatctgtgaatctgagctctgcatcttattacttgtgtggccttgggcaagtcacctcacctacctgagcctaggtttctttggctgtaaaatggaactcatagcacggcctgtgtggaagacagaataatggctcctccccttcaaagaagtcctcatcctaattcccagaacttgtaaatatgttaccttacagggcaaatgggactttgtagaagtgattaagtcaaatatattgagattggaagattattctgaattatccagatgggcctgatataatcacagggtcttaataagggggaggtgggaatggctgggttggagatttaaagatgctctagtgctggctttgaagatggagcaagggcccaccatgcaagggctgtggacagagcttctggcatctaaaacaaaaaaggaaaaaaaaaggcaaggagagaaattcagaaggattgcagctctgcccacaccttgattttagcccactgagacccactttggactcctgtcctgaagtgtaagagaataaagtcacatggttaagtcactaaggacatggcagtttgttacagcagcaataggaaatggatgtaaccttttttatatggtttgtgggcttgaaagagatgacgtgttaaatacagtagcttttgaccttgaaagagacgatgtgtgaaatacattagttttgggggcttgaaagagatgacaggtgaagtacattaactcttgggcatgaaatacattagcttcatggccgttagcattggccatgaagagctcttgaccaatagtagctggtgttaccaataataaaataatggtgagacttgagatgacacaggagtgttctaacagaggcacagtccacttgaccagatctttctcaggcatctccatcgacagtggggtctccctagaaggctgggtggctgccatcccacccaaccagcctgcctgagttggtaaaagtgcatgaaagtgttcctctcagggggtggccttccattggccctcacaagggcacagcggagctcgttggttatgcttcagttacataaatccagccttacaaaggctacacagagagaggggctccttgcctcctagatctgtaccttgtaggtgctcaatacacattggtaagaatgttcacatcatcaggtaagcaaggggtataaagtgaggccttgaatcgctcacgtagattcaagtagtgttgagaaactaagaagtggtgaattgtacccttttttcccctcccaaattagaactcctaagaaatacaggacaactggagaccaaaccgtaggtttcattacctatgaagctgattaggaaagccttgagtttgtacccaaataaatttgctaatacttttacctaaattagagagattcggatggggtgggataacaacacgccacatctacctgggtggagcccatctcaggatgcctctgcccaggaggaggggcagtgagaaggaggccggaaggggaagagaaacaggagagggaaaggaggaaaggagacatagctagggagatgccactcagcaatcagaaacctccattccttttcctggggtggagtggaggaaaagggaaggggcagggaggctcctagcccacaagccacttttgtgcaataggaaaagatgcttgaccagtgacgatgagcttttttccaaatgttttttggccacagaagtgtcttgagaagtttctgttcatatccttcgcctgctttttaatggggttgtttgttttttttcttgtaaatttgtttaagttccttgtaaattctagatataagacctttgccagatgggtagattgcaaaaattttctcccattctataggttgcctgttcattctgatgatagtttcttttgctgtgcagaagctctttagtttaattagatccccatagtcaattttggcttttgttgcaattgcttttggtgttttagttggggggtggggggcaagggaagggacagcattaggacagatgcccaatgcatgtggggcttaaaacctaaaatatgggttgatgggtgcagcaaaccaccatggcacatgtatacctatgtaacaaacctgcacagtctgcatatgtatcccagaagttaaggtaaaatttaaaaaaaggaaataaaagatgcccgttcctctgaatggacatagcccatgccaagggtaaggcttggtgagtggaacaggctggattttaatcctcaggttgctgcacccttggtgaagcacagggcactagagaagagtgttcacaacctccagcccctccacaaagaagcctgattctggaaagacagaggttccaacctcacccttacttctcttctgaagatctgctgtgcatgaagcattttggaggtatttcttcagctcagaacacagcaactttcctatgaaagagagcacaaagggttaatgccaccagaagacactcagcctgtccagtgtcgctaccactgggacgggcaatgggaggcatctgaggctttgctgacaacttcttctgctgtgagggtggaaagcaggccagatctttatgacctggactccacgttttgggattctagcaagatgggacccactccgggtgctgtgcccattctcagtgccagtggggctgatatggggtcatggcaggtagcgggagataacagcctcatcctcaacactagacatccagacagagtggctcaggccctgtaagcaactggtgttagggcagataatgagattttctggtgtctgcttggtgacaagagtagtggcttcaaggaatttttttaaaaaataacatttgtttatagttgtgttttttaaagtagaaaatatattcatacgagcaagtaattagtgtcctgccaggtaagtctcatggtgacatgtcaacgtaattattttttaaagtctgcctcaaataaagcatcaaaatttcctgctttaaatctcctttctctgtaaaaatggttaagaggagtgaaaagagaggatgggaggggtctgagagcattgatgcctcatcatagtcagccagctgtggcaccacctctgtctttgcctgtcactctcatacaaaggatgtgcataggaaatgtgatcctacccatcctcaaattctagatttggacttgaatttggtgctcttatttccacattaagttaaaatctagcctccagatccccaggcttcccctcccattgtacccagaagaaacaagaattgtttctcagttctaactgtcataatgcctagcgggcgttagcctacaacgaaggataattcaatctatcctcaccttagtgtacgctggacaacactaggactcagaagtgctttgctcttgatcttgaaaggccagtggaaatccatgcagattcctcccccaggaccctcccagccagcctgataatgaattcatgggaaacagcctacatgtgagcaccaaagggaacacatttagtaaactctgccaaaggagcacagttcttgtaaagctgatgaggtttgtgattaatccttttttttttttttttttttttttttttgagaaggagtttttgctcttgttgcccaggctggagtgcaatggtggaatctcggctcgccacaatctccacctcccaggttcaagcgattctcctgcctcagcctccggagtagctgggattacaggcatgcgcctccacgcccggctaattttttatttttagtagagacggtgtttctccatgttggttaggctggtcttgaactcctgacctcaggtgatccacctgccttggcctcccaaaatgcctaacccagtttaaagagatccaggaagcagattgtgagctgcagatatgatgtgattattaaaagcagcctccattgccaacattgcaaacgcatcagcatgttccttccttcaacattccataacgtggtggtggtattcccaccttaccccgggagaagctgagagtcacagggagtatttactttccaagttcacacattcagggaatgggtagaagtggaattcacacccaggtcagtgtaagaccaaagaggctgtcagaatggtttgctgttccactcatggcaaacaggatttgaagttgttccagtccaagggagaccatcaggccatgcaggaataaaaaggccaaggggaggaaagaagatgctgtcttcattaaggcctgaaggaaaaggctggtcagagtgaagagtatagacaagctcctctgtatcctctcaaagatttggagccactgatctctctgggggttggggaatggggcagttcctgggaaagggacttattggtgggaatccagttctgctatgaatgctcctgactcctgcactcaaatcccaacagatgaaagggaggagagactgacagatgcagtgccttcctttatgtaacctccttgatccaaactacagtctgacccatgctttctggctttatattgtaccactacgttcctaactcaccctcgttccaatggcatcagcattttctcttccctcaaagataatgcacttctgacttttgcatattatggtagccagcccccaggagggctcccagtgattctcacctcatggtacccatgctcctgcgtggtcccctcccacatcgaataggaatgacttgtgtagccaaataggacatggcagaaatgactttgtgtgaattctgagccttgtttattcttgtcctttcttgctacaggcaaagccaaatgccgtgttgtagggaagctcaagtagcttcatggagaaatccacatggcaaggaactgaggccacctactaatagccagcatcaattctttagccgtatgtgtgagccaccttggaagtagaccttctagcccccatcaagcttttagataactgtagcctcaccaacatcctgactgaactacacagctgagcagcttccatatctccaagccacaaacactgtgtgcaatcataaatgtttttagttgctttaaagcactaagtttggggtaattttattcagcattagataactaatacacatagtctgtttcaccagctaaaattgctgctcatttctctgttaccccccaaacctggtgtgagcagcccctcctctgtggactttttctggtcttctttgcatgactcaatccctctttcttcattttctcacacagattgtttagcattctattaatgccactgtcacaaggaaaagcaatatttttattacagtctctctcctctgtcgattctaggcttcttgagaaagtttgtaatgtatgcattcttcaaagaggtattgttattaatagaggctcagaagatggctgaatgaatgaagagtgtgtgttagaacctggggaaatttaaaccaaatacatttaaagccagtgacattttcaaagcatatttggctagaaagactaagttctttaaagtagtttagaagcagtattaatggtacacagtctttgtcccattcttaacagtacaataatgataattggttgctactctggaaacaaattaaagagcccaggaaacgtttccaaaggtgactggaatgcttaactgagctagactgttaatatctaatgctagccttcctgtgggcatagcaccctgaattgcctgatctcatctaatggcacatgctcagacatccttggttttaaataaaaattgtcttatcacttagtttaaaaatgttttgcttagtaaaaaatttatgagggcaggtgcggtggctcatgcttgtaatcccagcactctggaaggccgaggcaggcagatcatgggctcaggagttcgatgccagcctggccaacatagtaaaacccgtctctactaaagatacaaaaattagcagtccgtggtggcgggcgcctgtaattccagctactcaggaggctgaagcaggagagtcgcttgaaaccgggaggcagagggtgcagtgagccgagatcgcgccactgcactccagcttgggcaacaagagcaacattcggtcgaaagaaagaaagagagaaagagaagaaggaaggaaggaaggaaggaaggaaggaaggaaggaaggaaagaaggaaggaaaaggaaggaagggaggaaggaaagggaaggggaggggaggggaggcgaggggaggggaggagaggggaggaaagggaagggaagggaatacatttaataaatgtggagtctgccaaatcaggtcggcagtttacttctcctgtccccggttcaataactcacttactggggttctggaggatagcagtgagaagatggggtaaaaaattagagagaagttttgcgttgccccatggctgcttctgtagtgtagtccgtgcatccgcccttcgatgcttgggttggatcatagagcagtgactgttgatggctcacccagatccccaggaacccaccactcccatacaggctttcaacctgttaatccctgcagctgcctgcctggactttcctctgaccatgggagtgtgctcagtcttactgcccagggaacagccatcagcctttgagtggcaagagttggtagattaccatcccttcttgacccttggaataggacaacttcgagatatgttctcccgagtctcccagatgaccccagtgagtttgaacaccagttgtccacagagataatctgcccattgccacctgtgtattgactcttttacatattctgtctcacttctctttctccctcacttgtgcttcttaagattgtatcctgaataagctatttgcactcaaataggcagagagctagctggatccattattctctcttgtcttctatattttagatatcttgtaacaggcacaaggtaccgtgtagagctgaggtgtaatgacccagctgatctgtttgtactttctcatgctgctaatgggtacctggagttgagaatttatgcataggtgtgtacatgccatcacagctctgtgtgcatgagtgcctgtggggtctgcatagcatgcacacatcacagaaaccctctgccctcccttctcattcctctatttgaagccaagtttccataatccctctactcaacccccttcttccccagcccccaggggcttcccatacttagggtcaccctttcttacctcagagtttcaaagatgtaagagctgatgcccaccttgatggtattcacaaagtatagcagggaggcggccatggaaatgactctttacagcaggatgatatgtggaacatgccatggccagggaagtaactttgtctcaaggggatcaggaagatgcccaggtatgggataacttgagcaaaagatttttgagcactgatctgcagattttactctctgtaaagggccagatagtaagtattttaggctttgtgggccatatggtggctgctgcaactgtgcagctttacttttttgtagcacaaaagcaagcatagataccacataaatgaatgagcatggctgtgttccaataaaactttatttacaaaagcagatggtgggccagatttgtcccattagctgtggtttgctgacctctgatttaaagagtgggaagtagatttctggaaagggagaaaggaagactatttctagcagagagaagaaaacatataaaggcaaagagtgggaaaccagagggaataagacaaatttgatttaccaaaaagtcctttttggtggtagtaaaaaatactaataataaaaactaagttttattaaagccttattatgagtcaagcattgggctaaatattttgtggattctcatttaattattactctctctgagtttggaggaccttgttttcctcatggcacacacgaggagtaaattaagctcagagagggtagatgactggctcaaggtcacacagctaccagctggccaggtggcaagaccccggacagaggattgggagcatggtattgtagccagcgtacctccttgtgtctatcattagccctgctttaatggactttttcagaagtgtttttgcttgtgttttacaagtggaatgtgattccttgactcagcccagtagccctgtgaatggatggctgaaacgagtctgacggctttttctcctggggccattttgtaagaaataaaagcaaaacagtgagatatttaaattcttcagggatattattttcgagtggataaagtgaagaacattttttattcatattagaagtgatagttggatgtgtgtaatttttttgctctccgagatggagagagaacacagcacagatcttagaatgtaaaatatgaatttagatgacattttgagaaaactgataaacaccaccattccacaattggacttaacttgcctgtgaaaatccttctgcagcccacaaaatgatagagataggtggactacgtctaatggatattaaaaatacacaacacaccaatgaaggaataattttcttttgcaaagttttcatttctcaaaatgctaccaggaaaagagagataccttgacagctgacagtaaccctgggaataaggatatgttagaagagaagggctgcagtagttgtgaaatcctacctggaatctacccctggacaggagacccagggatcaagactcaaagctgatgctctcaacaccaatgtttcatctccagtgtaccacgaggtccttgtccacctacttctagatagagccaaactgtctaagccaaagggggtttgggtttctttcaccacccacctgtgcacatgattagtttgaaaaagtatgtcttaaagaaaaataaatgcagacaactaagtgagaacagttacatgtactaaaggtctttcagaaaatcagtaatgtaggtcagtgcatttcaggatttggaatttcacacaaaatttacccttgaaaactttagactgagagaagactaccatgcctattctgtcatgtaaggacatctaaagaagaactgcacacattggtattaccatcttcccacacacatacacggacacgcacgcatgcacacgtgtgtgcacacacagacacgcacacacatgcacgcatgcacacacacatgcacacatgcacgcatgcacacacatgcacatgtgcacacatgcacgcacatgcacacacgctcacacacacagaatggttcgtggccgggtgcggtggctcacacctgtgatcccaacactttgggaggcctacaagggcagatcaactgaaatcaggagttttagaccagcctggccaacatgacaaaaccacatctctactaaaaatacaaaatttagccaggtgtagtggcaggtgcctgtaaccccatctactcgggaggctgaagcaggaagattgcttgaaccagggaggccaaggttgcagtgagctgagatcacgccactgcacagcagcctgggggacagagtgagattccatctcaaaaaaaaaaaaaagtttcatactttcactcacatatacactcacacactcgcacatacacctacacatacactcatacattcccatagaaacaagtgagttataatctcagagtgaacaaaattgagtaaattttaccatacaaacatatttattatgcttgtctcactaaaaagcagtaaaaattctgatatgagcatcacacaggttaatgtaagatagtaagaagaagaaaaaagtataattatcctagaagtcctattgaagaatgaaatcgcaaaataaaaatggaaggggcaaaggtaggatccttagaatgcttacaatgggaatctgaatgtttaatgagaaataagcccgacacccatagcacataaggactcaggctttgggatctctcccttcctagctttgaggcctgggcatgttatttaacctctcataccctcgaaaggggctcataaaagcaatcactgcatggggcttttgcttggtgaatagttccagcacatggttagtcctcagtaagtgttagctaatagcattagaaactagcttttttaaaaaataaaggaaggggccaggcgcggtggctcacgcctgtaattccagcactttgggaggccgaggcgggcggatcacgaggtctggaggtggagaccatcctggctaacacggtgaaactccatctgtcctaaaaatacaaaaaattagccagacatggtggcgggtgcctgtagtcccagctactcgggagtttgaggcaggagaatggcgtgaacccgggaggcgaagcttgcagtgagcggagattgcaccactgcactctagcctggcggacagagtgaaactccgtctcaaaataaataaataaataaataaataaataaataaataaataaataaataaaataaaaataaaggaagggctgggcgtggtggctcatgcctgtaatcccagcactttgggaggccgaggtgggtggatcacgaggtcaggagtttgagaccagcctggccaatatgatgaaaccgatctctactaaaaatacaaaaattagccaggtgtggtggcatgcgcctgtagtcccagctgctcaggaggctgacacagaagaatcatttgaacccaggaggtggaggttgcagtgagctgagatcatgccactgcactccagccttggcaacagagtgagactccgtctcaataataataataataatataataataataatagtaataaagaaagtacatggggaaggaatatgttctacatgagctttcacaggggcaccgatctagaccagtgtggactagaagtagccacatcccctgagatcctgtcggtaaaacacattctcgggcctccccacaaacctcttgatttggaaccctgggaggtggcacccaataacctgtgttttcaacaaaccctctagatgatgccaagccacactaaaatttgagaacctctgatcaagccctgcaagctttttaaccctggtcctgggcagtcagctaaatccaggaagtatttcgcagattgggaataaataaaagaagaaaaaaaaaaaggcataagtgtctttgggttgaatctcattttaagccccagaattaggcttgtgaaaacaattcaagaattgtcttcgagcctataatgcctgctagtcccatgagaaaaagattttgaaacaaaataagttgaggttggatttgctttttttccaagcttcaaagcatcaaacaaagatccatgttcacatctgaatatctgagttcacatctgagtcagccgctgactcagcccctgaccacagagtgatgaacagagaggcaggcatcatgggacctgaaatggcattttctccaaaatattagaacgtccttagatcccttagatcaatggtgatcgtgggcctggaaaacttctccaaaaagtgcaaacttctcctgtagttagcatattagtttgttctcatgctgctataaagacttaccctagactgaataatttataaaggaaagaggtttaattgactcacacacagttctttgtggttgggaaggcctcaggagacttacaatcatggcagaagggaaagtcaaccgtccttcttcacagggtggcagcaaggagaagtgctgagcaatgcgcagggatagccccttataaaaccgtgagatctcttgaaaactcattcactatcatgagaacagcatgagggtaactgccaccgtgatccaattacctctcaccaggcccctccaacaacacatggggattatgggaactacaattcaagatgagatttgggtggggacacggccaaaccttaacagttgggttcaaagacaaatgccaccataataggccgcagatcacctttattgccagcctctctagtccccaagtagctgataaaaacatagacaaaaattatagagaatgaaggaaaaaaagtaaggggttattttgagagcaaagtttgcctcatctgtccaatagagactgtcttgtatgttaaaagttcatcatcaggagctgaaagaattgaaagtaaaatgaaactatcttgtgtgcctcgtaggaatacaacctggacgtagtgtccattactaattaaagccaatgtgtattgtactttcacagtgagacaggccctgctctttgttctctatatttatttacatgcacttaatcctcacaattactccatgcaataaatcccattatcactttctgtactaggttgactagggtcctccccaaattcatgtctacccagaacctcagaatgtgtcttttcagatgtaattagctaagatgaggttatgctggattagggtaggccctacgtccagtatgccttggagtatcctcataagaagaggagggccgggttcggtggctcatgcctgtaatcccagcactttgggatgccaaggcaggtggatcacctgagttcagaagtttgagaccagcctggccaacctggtgaaacccaatctccactaaaaatacaaaaaattagccgggcatggtggtgctcacctgcagtctaagctactcaggaggctgaggcatgggaattgcttgaacctgggaggtggaggttgcagtaagccaagatcataccactgcactccggcctgggcaacagagtgagactccatctcaaaattaaaaagagaagaagaggagagagacagagacacacagaagatccaggagagaaggccaagtaaagttggaggcagagagtgggatgatgagtctataaaccaagaaataccacgggtcaccagcaaacaactagaagctaggatagaggccgggaacagatgttccctcagaacttccagaaggaaggactcttgtagatgtcttcttttgtgcttttggcctccaggactattagagtaaatttctgttgttttgagcccctccggtttgtgacgtgtagttactgcagctcctggacactgagatgcccctgtttcttgatggcgaaatggagactgaaagatcatgtcttacccaggtgcacacagccagcttttggaggtttagggtcagaggcagcttcgggggtaggaatctagaatctggtttcctcatcttgtgctgtgtcgtaggtctgctgggttcaggttctggagacgtcattccatgtttctgagctctcttttctcccctgcagatgtaagaactctgtacttgaggactcatgcctcagctgggtggtgggattggattccttttaaggtctctccaaaccaaccctgagcctctttgattagaattctagaagctttgaaaccaccactacaaaattcatttgcacgacatttctcttttaagcattacacttctctctgcagtaactttgaagttactgtcgttttatgcactcacgaagagttaacaagcaataataaacagtcaagactgcttttcatttcacatatctgcatgtgttcagtcttttccgtgacacaattgaaggagcttctgtaatcaggagagaaactttatatcatgctgtaatttcccttgatacaagctagaaaaagatactggtttagattcactggggtgattgactagaaaattgccccagctgtcaaagtttccagtgttaaaaagcagtgtaaaatttctcaaatgcttagaatttctagatgtcacaacagagatgttaccaaaatatgagaatcaagttttttataagcaggacaaaaatacattatttttctcaagttctcaatatttggttgaattcatgaagaaatttttaaaacacaccaagcaaagcgttcattttgtttagaaataaaattaataagttgttttttgatattgtattaatgtgtcctgccacattaaaagattgcctatatatttataaatttaatctttatataggaattaaacagacaagccagaaaaagaaaagaaatgataagctgatatttgggtataatattatcttgttatccatgttctttgtattagctgaattatttccatttctgctccaaccaagaaaatcaattcaaacattgttcctcgtgatttattcaaaaattcgcttttccaagtttccgtctaagagcatgtggtgggttcttatcttcatcataaaagtgtataacataaagagatgtcctcagatagctcatggcatttgttagctcaggggggttgtagaaagtttcctgtaagcgttttacactcaaagttttctttatagtgccaaagaatgagaagcaaaagcaattcagcactggaaccgtttggggagtgtggctccattctgaggttctcttctcatcagagtgggggcaccctataattttgagaccttgagccaggctttcatgtcatctctctttatgaacactccactagtttctagcctataaaaatagtgtcaacattacagtaagctaagtataaggcagaatcaagaagccaaggatctgattttatttcagagttctgaaatggaactaagtgttacagaaagcaatttgtgggaaacaattctctacagtatgacttatagactgcttcaaaggagaggtgtcttctcttcctagacctgggattttaatgtgagagctcccttatcatgttgaggagaatggctgtctgaattgttctccctcttatttataaaggcaatgatcagaagataatttgtaagtacctactctcttccaggcacagtatttaaaatgaatatatagtaaaaaagccagctgcctcccctgtcatcatggaatttataacttagtagagaagatgtcaaaaagatattgcaaatgatctgagtgttttttacaatggcattgttgtgtacaacaggtggattcccaccttgttggggaaagcaaggagtgctccctggaggaagtggtatttattttgagacctggaaattgttagccaggaaaggagataaagtggcgggagtgagagcaaaaatattgtcaccagagaaatcagtgagtgtaagaaattgctggtgtagttaaaaactgaaaaaagtctggatacattgactgtcgtgttttcccagttgtaggtcttgtaattctggcaaagggaaatatgaagtgaattcctggaatctcttgctgatcccagagagactacagttctagcataaaaggaagctcaacagggtgactgtaagaggttccagagcagcaggtcatactcagcttagaagtgcttgcaagacagtttaaggatgtagactgtctaaaagaggctcataaagagattatcaatctaaaagcaaacttgaaatattaatcagggctagattaggttatgctgcagtaacaagttaacccccaaattttagtaggcatagcgcaacaaagtttctttcttgctcaagctgtgattccaacatgggtctgctggggagctctgttccacgtagtcattaagggatccaggctgacagaggctctgccagcttgcagcatgtggagcactggcctcctttgtgcctgtggcagaagaacaaagagttacagtatcaaaagcagcccttaaatgcttcaaccatccctttggctagaactagtcatgtggccccacctacctgaagggagggtgagaaatgtgagggaacacgtgggcaatcaccaggaagttcctttgtttgttgcagtgacagtctggaaaacaatgtgaactggttgacaagcttaaaaatggatctaagggcaaaaatgctaaaggagagaaagaattgttgacagtgtataagaagatgattaggaacaaagtgagatgggcagtttggaggctctttttttagctttaatggtaatagaatacacgtggcactctcactaaatgcaaggcattgggctttatgtagattgtcccatttaattttcacagcaactctgaggtcgatattattatcgttctcattttacagataagaaaactgagccctggggtgatgaagtgactaaccccagtgatattgtctggctctgtgtccccacccaaatctcaccttgaattgtagttgtcataatctccacatgtcataggagggacctggtgggaggtaattttatcatgggggtggttaacctcatgctgttctcatgataatgagtgagatatcatgagatgtgatggtcttttgttttgtttttttgagatggagtcttgttctctcacccaggctggagtgcagtggcgtgatcttggctcactgcagctctgcctcccaggttcatgccattctcctgcctcagcctcccaagtagctgggactacaggcacatgccaccacacgtggctaatttttttgtattttttagtagagacggggtttcatcgtgttagccaggatggtctcgatctcctgaccttgtgatccacccgcctcggcctcccaaagtgctgagattacaggtgtgagccaccgcgcccggccaagatgtgatgggtttttttttgttttttgttttttgtttttttttgagacggagtctggctctgtctcccaggctggagtgcagtggtgcaatgttggctcactgcaagctccgcctcccgggttcacggcattctcctgcctcagccttccgagtagctgggactacaggcacctgccactacacccggctaatttttgtatttttagtagagacagggtttcaccatgttagccaggatggtctcgatctcctgacctcgtgatctgcccgcctcagcctcccaaagtgctgggattacaggtttgagccaccgagcccggccgatgtgatggttttataaagggcttttccctgttttgctcagcacttcttgctgctgccatgtgaagaaggatgtgttggcttcccctttcaccatgattgtacgtttcctgaagcctctgcattcatgctgaactgtcaattaaacttcttttctttataaattacccagtctctggtatgtctttattagtagcttgagaacggactaatataccagactctacagtttgtaacgtaggcactaggattcacagatcctaggcacctggttctcagattcgctaaactttaccattgttctttgtccgtagcctggaagcttagaatctggaaggatagagaatagagttttatagggactgggacacactggaaatttgaggaattttagttaggttaggaggcagttcctacatataggtggaaggagaaataccaggagtcttgtcttgtctcagcctaacaagatgacttctgagaatatgatcaggcctgtttccgccctagcattggagtccagtgatatccaagggcctttatcaggaaaactgcaacatatgaacacaacacagcctctgttttggagtccccagaagacagctgattggtttaagtaatagtctagggacaaagaaagaactaatacttcaatgaaaaagaaacaaatacttcaatgaaaatgaatttcatatcgcacttctacattccttatttgagggtatttgagcaaactaacagaggaagaaaattagccactttaactataataccttgagtattagactaatccagttataagtttacagaccctttgatcagaagtcagagaagttgcctaggaaatgagttaaacctatttctaaaatgtccaaaattagctgttcaaagaaatcttttttatagagcctaaaatattctaggcaagagataatgaaggatgctctagggcaatggtgcggggagaggaaagaaaggtgcctcaatacaagcagcatggcaaaggtacaatcctcccagtgtgaatggtggggggaacaaggggaactgaaaaacatgcatgaggacgttagctttgaatgggtttcttagagctgggggacaaaggaagagtcgcagatgatcagaaaggagatgtgaaatcttctgcttgctatgttgagtttgaaaaataaatgaaaaaatttcaggtaaaaacagcaaatcatagcaaataaagatctcatattcaggaaaagggctaggcctgggtaacttcatgatataaatgttcaccattgctaaaacttaaaggactgacaatatcaagtgctgacaagtatgtagaacaactaggagtcttgcaatgtttttcaaaatggtagccccagtcttgaaacaatacatatgacttctaatgacagaataagtcaatgactagaggtaaacagtgatgaaaaagaatgaatatggttgacactcacaggctctaagtggagcaaaagaagccaagtgtacaaaaaagtacattttgtatgattccatcgtttatgaagttcaagaaaaaacaaaaaggatttatggtgatagagatcagaatagtgactaccttgcagagatggcagttaggagaggacataggaaagcctgctggagactgggaatgttctctcagtctgggtattagttacatggatatatacttaagtgggctgcagggtttgctctgagggagcaaacacagcttgggctgtgtttggccttgaatattgtgaataatatgtttaggcaaaaatcctctgtgtctcgacgtcattgcatggatccactctatggttggccttagagccaggttcttgtttgcatataattttgcggaagtgtttatgtttgccgctcaattgccaattttgattacagcttctcagcctggaaaattgtcctggaagggcttaatggaacacttgcaggaatgtggcatcatcaattttagagccagaacaggacgtggctagcttttcagctggccgggaagagcctggagagtgctgagggacaccagccagggacaggcacaggatccaccacatggctctggcctcagttctgcccagctcaaaatcttcatccaagttttatttaaaaatcctttgaagggagagcaatgggctgccccaccaagagaagtgttcacaggaagtgcctctcctcaggtttcaaccatcgcctcccaaacttcaattttttaaatttcacctttgtaatgtctgctatttctaacatctgttctaatatatacttcatgtgctttttaaagcaacatgctctcttttacttcagtaaacatatttaggtaagacataccccatcaccacagtgccacagtaaatggaaaaccagcactttgctaacacgttttaaatttaaattattgcatgtactgccttgcgtgttagctctcagtaattatttttcatcctcttaggtttcttccagctttaaggctttattattttaagttataaagtaatcggccaccctgtatgactgtgaggtccttcaagagagaaggtactctttgctctttgaaatttaggaaaaaaaaaaagaatggaaaaaccaataatggaaaaaaaattgtatttttatgctaatagagtagtagcggccaggtgacctttagcaggttccttaatagtgtgtcaccaccaacacagtgtaaacaccaatacggtgtcaacaacagcaataaaatgcagtttaaagacagcttatcccagggtatgctatgagaattggatgagaatattgttaaatcccttgtgagttttaaagggatgtaaaagtcttagaaatattgatgtgatcattggcaaatgcagatggatattagagaaatcaatctaaattgtatatgtagacaccagccacccccggaaaagaacatgagtgggtaattcttccacctatgggttttcccatgggatgcaacctgggtgcatggaaccagccctggcttcagagttagaggggcctggctagtgctggttctgccactgaccttgacctgagtgaccttgaaaaagaaatctaacctcttgcattttcaataacttcacctataatacagggcaaatcatcctactatatgaggtcgttgaagtttaaatgaaagagtgtagagtctgcccttgaaacacgttgttatttttcaagcgattttctgaagctagagcccctcatgtgagggatggagagatgaatccatcagctgttaaatgcctgcattcgggtgccaggccaccttccttcctaggtaaggtctgcaaatccagttctcccctgctgcgcagagtgcaggtccagctctctgcccaccgggtgctgtctgtttagaggagccagctctggcttgcgctttaatgtcatgtttaatgcctgctctgctgcagcctccacatgtttattgaatctttatggaaaggccataacagctgcttcgggtccattataatggatcacgtcaaaatgtagcctgccattgttttaaagtcatgtattattcacttgatggagtgtatacgtccatcttatgtcaatttgtgttatggactgtcaaaattaacatgagtatatgaggtaaggcatattggggaagaaagttccacagcgcaatatgcaaccgtggagtttctaatcttaataattcagtgggtgccaacaagacgtggtctctattacagacttgaagctggtaatacttcatttttaaaaatgtaaccatttttgagttacaggaaaacaaaaatggtctgtggccaataaatgtctagttttataccgttctataaatgaaagtaataaagcacagcaaagttgccgagcgcagtgggttcttaaacacctgcagcgtcatttctcatcagcaggtgggcggcagagttcacatccctgggccctgtcggggtctggccatctccaggtggtgacaggtggcatcagactggcctgaattcagccttggggctgtgcattctcctggggcttattacagaggctctgacctccacctataggttcaattcccctccaccccaaggacttaaagaatttttccagacactttatgactcaccacctagtggctcttcccagtgtgactccagctagccacaccaagtccctttcagactcatgaccttagcaggtgctgttccctctgcctagaactttcttcctttatgtcctcacctggctgaattatactcacccttcagttctgctgaaatgtcacttctccaaagaagcatttctggacccccggcctccctattccaccctcctctggtaccccttttataggtgcttcttcctcatgcacctgtccaggttgtatctaaattagtaataaaagtttgatgtcatcctctctacccacaaataatgagtgcaggatccatgtctatggcgtccaccctgtagctgtagcacttagcattgtgcctgtcatgtccataataggtgctcagctagcatttttgaataaataaatgagtgcatggatggaagaaagcaaggttgtctggcagactgtcttggttgaacatgatttcctattcatgatgacctagcccatgctcttcaatcctgatagcttttttagattttttaagcccaaggctctgtcttgtcatatgtaccctacccttttcattatccttgaagagaaactcacctcccaccctggaatccactggagcagcctgtaccctgccaaccagtgccccccacaccaggactctctgccacgtgtgtgtactcaccaagtgctcctccatttcccattcctgagttggatctactccagggtcactcccttgcttcatggtagacccttgatgtcagttccctggcagctggcttgggctcttcctagcgctcagattccacctcagtgggcatgtccggttgcacatcccagaagtatatatcttccccattctgtggcatggttgcaaggacaacattgaacattgggaaaaggaggcaagaacgacaacagtccccatttcaaacacttcagtccctcgttatgcagctcctagaagtatccattgttctgggaaagatgaagcatccagaacctgtgtcaggactctagaatgaagattcaccttctctgcaccagcccagatggagagcgtcctgggcaaccaaagtccccaggagtatttgcacctctcaaccaagattcttagatcacagctcttaatcacttaccctgcagtccacccacaggagatgagctttatttcagttgtgtaaattagtgaaacagaaccccgaagagctgaaatgtcctcatatctgtcacgaccttaccatgcactagatttgtttccacagataagcttgtgggtttgcacgacaaccaagagaatttgcagttaagagaataaataatgcattattagaagaataaatcagcatgcagtgtacatgagtaatatattcataccaggcccagtgaaggagtagacacttatttagtgtgtttatgcagacatagatttaaaaatgtataaccacattattatgggttctttacaattgtaggagcaggaagttcacacaggtcttccagcctgtctagcaggtggactgagagtcatgaatttcatgtctttttcttttttctttttttttttttttttttttttttgagatgaagtcttacactgttgcccaggctggactgcagtggcgcgctctcggcttactgcaagctccgcctcctgggttcacgccattctcctgcctcagcctcccaagtagctgggactacaggcacctgccaccacacccagctaattttttgtacttttagtagagatggggtttcaccatgttagccaggatggtctcgatctcctgacctggtgatccgcccgcctcggccttccaaagtgctgggattacaggtgtgagccacctcgcccggccaaattgcatgtcttaacaccccctcttactagctgagaggtcttggcaaacctgtagcactgagagtgtcaagtttatccatctttaaatggggccaccatctaacacagaaaagccacagggatcagagaagaaatcatatgagtgggttccgtgggctgtaaatcctgaatgcgcatgagatgggaaggtcagtagaccaatgattttctcatcatagattcttgctgtgtcaacttggacaaaaaacttaattttcggggacgctgattctttttctctgtaaggagaagttattggtctgatgcacacagtggaatcaaacggcaatttacttgtaatgaaaacctctctctcccggtgtccttatagcaaccccagggacagactccagttggctctatctgtgcctcatgtccatcctttgaaccaaccacgggccagtagaatgtagtactcggattgaccaggcacctgaagtctaagacagcttccatcagtttcctgataactggcatttactgagcactttgtctgcactagatcctgtgtgtcatgcacactgacttatttaaccttctggacaacaacgtaaaataagctttagtacaaagagaagttctataacttgcctgtggtcacatggttaaaaagtggtgaagctggaatttgtaaacaggtttcttggactcctaagcctaatttgtaaatgctatgttatactgacttggttgcagtattggtgggagagggcatcctaaacagcacctgcttgttgccaagcccttgtggatttaagctcagttccttccccagaccttgtcgtgtgaacctccattctgacttcacatccatagtaggcaagataatggccctcccaaaggtgtccatgctttagtgccccagaagctgggactatgttgcctacctgagggacattgcagatgtgattaaggagtccttgagtcggggagatgattctgagttatcttggtggatccactctaatccaatgagtccttaaaatgaaagaattttttctggctcagagaaaatgtgaagactgaagaagagaacgggacagattgcagcataaaaacaactttgtccagcactgctggctttgaagacagaggaggggccacaaaccaaggaacatgggcagtcccaagaagctggaaaaagtgaagaaatggagtttcccctggagcctctggaaaggagtgcagcccttccagtagctagatgttagcccagcatcctgtgttggacttctgatctgcagaactataaaatttacagatgtgttaagacaccgtgctgtcgtaatttgttacagtagcaatatgaaagggatgtaacattcaaggcagaaccaaaaacaccaggaaatgctgcagccaccaccttcgaaccagcttcaaaggtcagccagtcatcagagtcagaagttttgttttgtgggggcggtggtggttattgttttgttttgtttttttcctctttattctgaaaagtgccagctctcaagctggggcaaaaatagctttgtgttgtagcctcaatcaatagtccgcaacctttttggcaccagaaaccagtttcatggaagacaatttttccagtgggattggaggaggatggtttccggatgaaactgttccacctaagaccatcaggcattagttctttagattctcataaggagcatgcaagctagatcccttgcatgcacagttcacaataggttttgcactcctatcaggatgtactgccattgctgatctgacaggataccgagctcagatggtaatgctcgcttgctagcccactgctcacctcctgctgtgtggcccaattcctaacagcgtacagactagttctggtccgtggcccgggggctggcggctcctggcttaaatgatgaaatttgctgccactgtttaaacactgactctttcacttccccagcccagcctgtacaatcttctgctttaccttctttaccttagccctttgtcccagtttgggaacagtgaaactgctggcaatcccagtaattgtcttgaagcaggcaggcagacagaatgggaattcaggccagggatggtggctcgtgcccgtaatcccagcactttgggaggccaaggcgggcagatcatgtgaggttgggagtttgagaccagcctggccaacatggtgaaaccccgtctatactaaaactacaaaaattaggcaggcgtggtggtgcgcacctgtaatcccagctatttaggaggctgaggcaggagatcacttgaacccatgaggcggaggctgctgtaagccgagattatgccactgccctgcagcctgggcaacagagcaagactctgtctcaaaaaaaaaaaattgttttaattaaagaataatttaaggctgggcgtgctggctcacacctgtaatctcagtgctttgggaggctgaggcaggcagatcacgaggtcgggagatggagaccatcctagccaacacggtgaaaccccatctctactaaaaatacaaaaaattagctgggcatggtggcaggtgcctgtagtcccagctacttgggaggctgaggcaggagaatggcgtgaacccaggaggcagagcttgcagtgagccgagatctggccactgcactccagcctgggcgacaaagcgagaccccatctcaaaaaaaaaaaaattaaaaattaagaatgggaattcagatacaaaaagagttgtcttctgcgttaaccgcagcacagggagagaaaaactacatctacccacagcattatagaaacggcccagggcaactacatccgtttgatggcattatagagatggcccagggcaacctgagtctgctttttcatttgtaagttagtgatgatatatacacctgacccaggtgctacgaaaggacccagtaagcaaatgctgagacaacacccagtctaggacttggcatcaaataagcaaccctataaatgccagcacctattacggttgttgttgtcatttgggtgataatggcactcaccaaattaaagacttttgagatcactggtatccatatcacactgtaaagtagaaagaagtctatattttctcagtaccactttaatgttaatttattacttaagtaccaacaaaacttcaaacaatattagagccagaggaaatattagagatcttcctcgaatgagttcggtgactttctaagggcacgcagggagtttatcgggaaggccagggctagacaatccaagttcccacagagctgataatgagccagaagtgggccccctacacacaggcatacctacttagccccatctgtatatcccaaactcacacagcctctttaataatcctcttaatagcagtgataactaaacatattcagctttaatcacacttgcacgcatgccttcttccttaaatctaagtaatatccctgcagctattccaaaaggaacactataactggctatttgccataataaggatgaggaaattttggttgatcacattttaaatgggaaactgtatttagagagattttaaactgcaaaattaaaaatgcaaacgtgaaattatttttccattaagtcttctccttggggaaatctcttcctctgttgcagttgggcggtctggatgggctggttacccttgtgtggggtgtatagtgaaacatcaactcccatgaggctcattctcaggggttgagataatagtagtccctagtggggtcgtctaagagcccttgggagggcacttatcttcatgtatatattacataaatcttatttcaaaagggatttctactataaatattagatcatctgtctctaaattctccaactgtttccatctatctctaaatttcccaactatctccatctatctctaaattctctgacagtgctgagatgtaacgaacagcattaaaacactaagcactgaaaaagagttatcatgctgaacacagtgttgtttttattctaatttctaaatccatgtctcgtttagcattggttgtagtcaagagagagactgttcaatcccagtctccccatgccttttttctttgttcattatggtgaagggatcatggctatataactgtttaattagcaggagtcaccttgagaaatgtcaccagggtggtcctgctcagttactaatggggtagttatatataaattgcttggtccacctgactgaaatatagtggattcagtttagggagtatgaaaatctcagattagaagagaagatggaggtcattccacccaaaccccctccccatgaatacctctgtcttttttttttttttttctttttcattgtagatctaggcgagcttgcttcttcaggaagttaagccccattgttaggcatctctgaagtacaagcagtacatagtatttatggttggaggtcagactctgaagtccagtgtacgtggattggaatcctagctttgcagtgtacaagctaattggatgacatatattaaacttattaacaggctttgtcttttgcccagaaattttacttctgaaaactagcctaaaaaataataaaaccttaatatttgagtttatatgtataaggatgtttgttgaagcattgttttttgtaggtacaaaaaataaaaggttagatctccattcacactacactgtactacatccattctaggaaatactatatggctttaaaaaataactgataatatctatgatttactagcccagagcaatgtacacagcttacataaagaaatgtgcatgccatttttttgtgaaaaaaatcataaaaattccctgtgtgtgtttttataggattctgtaaggatagtaaaagacatggatgatctgtactactgttttctgagtaatataaatggaaatagagattttaatacaagcacaaaggaaaattatgcataacagaattttatctattaaacgaccacataaaagaaaaatacaatattgatattgattttaaaaaagatgaaaataaatgtcaacatattgaacatttggtcaggtgattatggagcgctaatgtttttcttacatttctgttattttcatatgtatttgtaataaaataacgttattaaaatcacttataaaggaaaattagaaactacagtcctagttaagtaggagtgcaaaagaacttgtgaaatggggtcgggtaagaatctagtgacttctctggagttgcaagcagagggtgcctgatgcagacactgagctggacatgaagcatgttctctgaagattattgtctgtcttccttctaaacccatggctctgcgtacctgttcctgctggcccttgaagaggttcatatatttgaaatgagcattttgggggtgttcagcttggtgctattcatgataatttgtaataggttaaatgctttcaattaaagcttaagtcagtgaagctctcagttgagaaatatcagaaaattgagtgcactgtaaagtcagtctctgtaggtctccatagcttgaattttgtggagtcaccactgagctgaccttgtgctgagttttatgattctcatattagacaccttcttacacattcagatggcatttccagctggctgtctaaagttgcttcgtagtcacggaatcaggaccccagaacagagagccaaaattgagcactgtttcctgagagcactgtggctctgtccttgaggacagatttggcctgtgttaagttgttgatgagcaattgttaggattaatggtctctgtgagtctactccttctataacccagcacccaggctttcacatcaaccacgcaccaaccatcacagcagctgttttcaatctgcccatcatcttaaccacacacacaaggctgcagaattcatctcattaacttccttattttgtaatggaagactgaggttcacagagggacagtgactttcccaagtcactcaactggtcctgacaaagaaggactagcctatggcaatctcagattgccacctctatgttgaaatgacatttaccagtaactagccccttggcagagaggaacccatcaggcaggcggtctgtgcatggtgggtcagaggcagagctgtgcattcacacagactggattcaaatatcggttccttcatgttttagctttgtgactttcgctgggtcctttgatgtctccactcctccatttcctgtcctctaaagggggaatgctggcagtgtgttttcatgggatagttacgagcattaaataactttcttccggtaaagttcttggtgttgtttctgacatctaataagcaatcaaatgttacaactgccaccaccatggtagcacatcctcttctgggtaacacctatgttaaatcaacgtacatggcttgactcaggtgatatctgtaatcttgactttgtctgtttacatgtaactaggcctctggtctctgccatcctataaatccattcagcctttcagcctcagtttctcctggtagagcctggcatggcctgaaggcagcacagtataatagaaataggaaggtgtgtgtgatagactaaaagatggctcccccagacacccaagtcctgatcctggtacctatgactatgttaccttacacagcaacagagactttgctggtgtgattaagtcaaggatcttgagatgaggggtgaggggcttataaagcggagtttccctgcacaagccctcttctcttctctgccgccatgtgagacatgcctttcactttccaccatgattgtgaggcctctcagccagatatgctcaattatctaagttgtccctaaatgtaattacaaatgtccctacaagagggaggcgagtggtattgactgaagaagagggaggaggcaatgtgatgtggccactaacccagaaatgaattcagtctctagaagcaaaaaaggcaaaatatacattctctcccggagcctttggaagcagtgtggccctgcggccaccttaattttagcacagtgaaatggattttggactcctggcctccaaaactgtaagagagtaactttgtgttatttcaacctaacagtttgtggtaatttgttagggcagtcacaagaagctctgatatggtttagctgtgtccccactcaaatctcatctttaattttagctcccacaattcccatgtgttatgggaggcacccggtgggaggtaattgaatcatgggggcaggtctttcctgtgctatgcttgtgatagtgaggaagtctcatgagatctgatggttttataaaggggagtttccttgcacaagagctcttctcttgtctgctgccatgtgagatgtgcctttcacctgctgccatgattgtgaagcctcctcaaccacaagggactgtgagtccattaaacctctttcttttgcatattgcccagtctcaggtatgtgtttatcaacagtgtgaaaacagactagtacaagctcatacagtgtagaagtcactcctcaaaggtgacttctgtcaccaccctcaccccaagattagaagagttcccattgcaccttgaaattcattttcaaagcattcattgcacttgggactattagtttaatgcccagcacctggaaccagtgcttggaacatgggagtcccttaataaaatgttactggataaatgaatatttgtcttcccagagagacagtgagcttcctagaagccacatgcgggctctttgctgctgcatccagagtgcctagctcagcgctagtgcatggtagcttctccataaatatttgctgaatgaataaatggctgcttgtctcctcaagtagcctatcagctccacattcgccatgtcagtttcttcctctgcaatctctgcagtggcttgcaccatgcctggtgccttgtaagttctttgcaagcaatcattggccatctgcctgagtagtcacgctggtccggacttgagcgatcctctccctctgtccctttgcactagagcagttgtcccattaagccatgtgaaccctaccggtgtgtgttatgagccatgcgttgtgccaacatcccggcagacggaattcagcagtgccacgggagagagccagcggcctcccctgcatctgagcagcgtggcttgttagttcccagtccttcagccaccagctgtttctaacacaaactcgtggtgacagagctctctgtaggagaagctaactacaattgtcagtctgcagagcatcaggcatctctaaaaggattccaattattgttctgttctgcctgctcctattacagtctacctcaacatcagctcttattcagggagaggagagcgagatgctaactctgtctccactcactcttatgccagaggaccagcagatgccagcagctggtgtcacgctggagaagggtaaacataggtaaacttcccctcaatgcgacggctcacttttcattggtgtgtattgcacttaaatgtgctcggaaaatctcaactcagcgtgactcgcaacctcaccactgagcggaagataaatactgagatgcccagaggtgagtcatttttacagggcattccccaaagacaagatgggaggtgcctcccacactcttcacctcctcctctgtgggcagcaggtccctgcctgaagccgacagacaggaagtcggatctgtgtaggtagagttggcaggtttctcagctctcataatagctcatgggcattgcagtaaggacccagcacaaggaggtggtggaatggcacggcccacggcttccttagttgtggaagttgtgaggatttaagtataatttacattatcttttttttttttttttttttgagatggagtctcactctgtcacccaggctggagtgcagtggcacgatctcagctcactgcaacctccacctcctgggttcaggtgattctcttgcctcaccctcctgagtagctgggattacaggtgtgcaccaccacgcccagctaatttttgcatttttagtagagatgggatttcgccatgttgcccaggctagtctcaaactcctgaccccaagtgatccgcccacctcagcctcccgagctgctgggattacaggcatgagccacagtgcctggcacgttaatctattttaaaaatctagttggacttatttttaaacttgtttgtcaaggcaaaattcacatgacataaaaattaaccattttaaagtgaacaattcagtgccatttagtggatggacagtgttgtataaggcaccacctctatctatattctcatcgcccccaaatgaaaaccgcatacctgttaagtagttgctccccatcctccatcccccatgccctttgtaatcatctactttctgtctttaaggatttacctattctggatgctccatacaaatgaaatatgcaaagaggagcgcattaggaaggtggtctgttcatggtggttcagaggcagagctgtggatcctcacagcctggattcaaataccagtcccttcatttttcagctttgtgatcttggctaggttctttgacctcttcatttttccttttcctgttctacaaagggaaaatgctggcagtgcattttcatggggccgttacaagcattaaataaccttcttcaggtaaagttcttgctgttgaatctgacatcaaataagccatcaaatgttacaaccactacctcctcttcctggctagcacctatgtgaaatgaatgtacatggcttgactcaggtgatgcctgtcttttgtggccttttgcgattggcccctgtcacttagcacaatgttgtaaggtacgtcatagtgtttactgatccatatgatagcagaggtcagcacttcttttcatagctgaatagtattccactgtatggataggccacattttgtttgcctatcctttcactgatggacatttgagctgcttctacttcctcactattatgagcaatgctgctatgagcatgcatttgcaaacagttattcttatttaaatgtgaattagcagtgcgtatacacacccaaaattgggtcatcaaagccatgattttattgataatgatcaaggatttcttctttacacaaattcattagagcacaaatgtcaatgtctaggacaattttataggacaatctgaagaaagcaacagctcagctggaatgtggatatggttgaagtcattagtttaatcatatctgcagagtttcttttgccatataaggtaacactcacaggtcctgggaattattaggatcaggatattgttggggtcctttttcagtctgccatatacactgtggcctgaaggttcattaagagttaactgggagaccagagcataaggggtgctccaggcagagggcacagcatgtgcagaggccctggggcaagaggcagcctggtatgtgcaagaagaaaagagatgcacggctggaaagagacacaggcttttattggccaaattaaggacttgggtcagcatccaaaggacaaagagataccactaaagaatctcaaaaaaaggagtgataagttgattggcattttagtagatgctgtggccacattgtagatgggcaaagtagagggaaataattgtggattcagaagaagttaggaagctgttgcaatagttctggtgagaggtggccaaggcaaaggttagtgtgtgaccgtgaggaccaaaggaagaggacagtcacaggcatctgtgacttacagctgaccagctctgctttgctacttcattcgttgattccacaagtgcgtattgagatctcaacatggggaaggtgttatgcatggtgctgggaatgaaatgctgagccaactgtgcagtcctggacaggttaattaacatttaggcctcagtttccccaagatatgataatgttcattttttttggagtgtcatgaatattaagtgagtgaatggaaggaaagagcttaggacagtgcttgacacagaggaagtatttggagcagcaagcaagagaaaaagaaggaacgaaggaaaggaaggaagggagggagggagggaaggaaggaaggagagaggaagagaaagagaaacaaagaaaagaaaaggaaaaaaaggaaagaaggaaagaaggaaggaaaggaaggaaggaaggaagaaaagaaaagaaaagaaaagaaagaaacccatggacacccacagaaacaaccaccctggctttggccctcctctctctagagtagtcattgaaaaattcacccaggacaacatttgcatgaacacccaggaaatgggtggcatatggcatttggcattatgaggcattgagaaatcctttccgtaatatccactgagtatatactgtgagccaaaactatgatagcggctatgggggaaaaatgagtaaaaaccaacagtcattgtcttcatagagcttacaatgtagttggggggaccaatattagtcaaataagcatagtaagaaagatagtacaaggtaagagggggaagaccatgttgcaagagagtctttggtgggctgagttgacctgaccacggtagtcatggaaggtctccttgtggacgtgatccttggggtgaatcaagaggatgaggtggtgttaactgagcaagaatgggtagaaagaacatcacagggagagagaaaagggtgagcaaaggtcctgtggccagtgggaatgcagtgagtgtgggtgtagataaggctggagaggccaccaagagctgaacacccatggaaccttgtagaacaggctgatgggttttgtctttatactaatggaaatgggaaatccttaaagtatattaagttatatggagatatatacagagatgcatctttggaaagatgattctggtttgagtgttaaggggagatggagaaggagataagagaaatgtccactaggggactaccatattggttcaaacaagagacagcaattaggtggtagagatggggagaaggtgccacttcgagggctgtttaggagagaaaatcaacagcagcactagtgataaattgagcagaagaggtaatggagggtcaggtggccaggataacaccagcatttcttgactggtgcaatcgaaattgaaatggggatgttgcggatggaggtaactcatgccacaggtgtttcatcttctcagtaaagcagaagcctggctcatttgctgaaaaagagtgcattgagaactaaggcagaattttaaggacgtacaaacatttttgaatggcagctgtggggattcgagcaacaagaatgacttgcagaagtgatgacttaattgaaatcaaattgaaatacatagaaaccacagatttggagtaggcatttcatttgatatgtctcaaaggcccagcaggatgctctatctacaaagaaggtacagaataagtatttgttgagcaagtagataaaaccaaagagcgattttgcatgactttcctgagccaactgggacaatgaattggctgatctatgcacaaaaatttgtcctgctatatttctttccatggcaatccctgtgtagaactttaggctgcaacctaaaggtgaaatgcacttaatttggcttgaataatttacttggattcttccttatcaacaagacttgaatatataatgtatttgaatttgaatttggtagttatatgattgtttaattcttggggattggaatatgagggagataggaagaaaaggaaaaggaaccatttgctcacactctggcagatctaaagaaggtttcattactgtagggcttctcagaactttcagtaccctaagacagaagcttcttagacattatttgttctacaggaaaaaaaaagtgttgcaaagaatagctacatatagttattatctaatatagtggcattctatggaaagaaataaatctatattagattaccttgaatttgagaatatcacattttagccccttggaaggaattgtactctggaattatatctttggaatatctgatcaggccattataccaatcttcccatgtttcctaccatatttctaaaagaatattattttataccataactatattcaacatagtgcctatttctctattgccttcctaggaatttaattttgttgtctaaatgggggaagtctgtttcctttcccagttacggcccaaataataaatgttgatgttaccgtgctataaaaatatgtcctctataaattgctttgcttgtcattaagatgtttcctaaacaagttgaatatgcgctatgtttttgccagacacttgaagcaatcttaaattacctgctgtgtctacacatattcagaaggccataatagaaatgtgccgagtggctcaggagaaaatcatttataaagattagaggaggacttgggaagctctgcctcttgttgcttggattgtgcacaaatacatttatttctgggtatgtttaggttatttcttttcagatttattttggtttacaccgtttcccaagcattagtcatcactgtcccctgaagcagtcacactatactcatctccgtagatgatcaatcagaatcttgagagtgaaatgaccagttaagacagaccaacaatttgttgatctagtggaggcggaaaaaatgcagtctgaattgaaatgacttttatgagatttcacccaggtggttgtttctaaatttatactcaaaatatagagtgaaacttgagagaacatttgcaagaaggaatgtgatcctaaaataataggatgtccttgttgggtgagttgaggaagtatgatagagccatagaggaaaagggtagattggcatcgacttagtagcgctgacgatcatttttatcagggatgtggatgtaggcacagaaagaaaggcatagctcttagattagcagaagagacaaggttggaaggaataattgtccagttagaatgcataatctgtttttaaagacatattaaactggaataacccatgtacaagtatttatccagcttggatacctggaagtggaattcctggttgaaaggtatattaatataaaattttgtaaaaaaatatatgttagataatgcttagtcatccttcgcaaatatcatgccaatctacatttcaactaccagggcacacacttgaacccatataaacagtggtctattctgaggacttttcagaacttttattaaaccaagattcattgtaaatctttgagggagtcatctggcatacaaagtgttttcgaaactttgattttaaaggaactcatactaacatcttgagaatctagtatccttagaacagtggtccccaacctttcttggcaccagggaccggttttgtggaagacaatttttctgtgggcaagggtgggggatggtttcaggatgaaactattgcacctcagatcatcaggcattagttagattctcataaggaacatgcaacctagatccctcacacgtgcagttcacagtagggttcacgcttctatgagaatctaatgccatggctgatctgacaggaggcggagctcaggtggtcatgctcactcacttgccactcccctcctgctgtgcgactcggttcctaacaggccatggaccagcactggtgtgtagccagggggctggagacccctgccttagaacacaattcaagaaatgctagtccacatgaaagtgaaaggctgaaaacttgcagaaaaggaaaaccgaaacattgaaagagggaaaatctgacaggagaaggcacagagatgagcatgagggccatttgttgaagtgttggtaacagcgataatgataattctagctgatattttcagagcattttctacgtgtcactcatggagtcctcacaagaacttcacgaaataggtactgtaattattcccatttcatagatgaagcaattgcagcatagggagatgaagtaccttgtccaaggtcatgcgaataggttagacttattcactctgtgtggccccagaggaggaatggttctagaaagaaatattttagcttaatatttgaagaagggctccagcagtcagaaactgggcatcatctattagggatatctccctgagggagaatttgagcgtgattaattccctgacattccattggtggaactcattctttgactttagataaaattctcttgcttctgaatctctgctaatttaggtggtttgtcctggacaagactgatttttaaaattctttatgttattgtcaataaattttttttttttttttttgagatggagtctcactctgtcaccaggctggagttcagtggatccatctaggctaacttcaatctccgcctcccaggttgaagccactctcctgcttcagcctcccgagtagctggtgttggaggccgaaagattgagggtcgtgatcaactcagtataccactggaggctatatgagtaagcgccaaactggtcttcataaatgcagaatgttggcagaccgacaaactgcgtctgctgccccgaaggagtgctgaagacagtcacccccgatgcgcagtgtttcttgtgattaggtacatctgaagcctgttagtaataatataaacctgtgttcagttaagcagctgaccagtcattaccacctcctccttgctctttctacccaataaatacaaagggctctagaagctcaggggtgcctttgctcactagaagcagggagctctcttcttcttccccagacccttcctttaaaacagtttcttttgtcttaagtttccatttctacgtttgtccctttgttcagtctcgtaatgacactctcaagtagtaacagtagtaactgtcctaatgacatctcaagtagtaactgttgtcatgatggtctcaagtagtaacagtagtaactgttgtagtgactggtctcaagtagtaattgcggcagtcagccacagctggaattacaggcatgcaccaccacacccagctaatttttgtatttttagtagagatgggttttcaccatgttggccaggatggtcttgatctcccaacctcaaatgatccgcccgcctcagcctcccaaagtgctgggattataggcgtgagccactgcacctggcctattgtcaataaaatatttttatatccatgatgccagtttgtttggtaaatgtgactacagagcccagggtgaaaagatgtagaaattgtcttgggatcatcttgacgtctcctggttggagtattcatgttcactcccgctcaatccccaggtcatatggcagtctaatctcagactctcagcccagctgccacctccagcctctggcctacactagtgcccagtggtgagcaaagatgttgggaagaaatctggatgcatctaaccctgctgcctgttgagtatcaggaagctgcccaacactcttccttagaaaggttttaacatgtcataatattgaggcattgaaaatctaaatgaattcttctgattgttccagagaagctatggaaatatgatcacttcattatcctttaccaaatgttcattgcatgtcttcagtccctcacattcccaccagctcctctcttctttgcctgaccaaccttactcatcctttgaggcatgtggcagagatcgtgtgttcactaaactctgtttgttttcactcttggccatagttagacttaattttccaaagttccttgcagttaggcagggccatgaaacagacaatggaatttggtagaagtcatcaaaccactccttcctctcctcaccttctttccccatccacaagctgaaccaaggactccaaaggtctagaggaaggcacagcccaagatggaaggacctgaatccctgactcccccaagacattgagcaaagtggaagaaattcatggttggtttttaagctctttagaaacagtggtttatttgttgcagcagttaatgttgctctgcctaacataagactctgctctaccacatcaggtttcttcatgggtaaagtaaggtcttctcctatgagaatgtatagagccctagacagagcttgcatcatagctttagaatgcaagccccatgggacagaggctgtgtctttcttatccatcattgtacccattccctagcaagtgtccagcatttggaagcaagtcaataaatactagctattattgctattagtattaatgtgttagcgttgtctgacccttgctccttacagtgtaggccatgggccaccatggcatcaccccagagcttgctagaaatgcagagcctcaggcctcatgctagtcttattgaattagcatctgcattttaacaagactctcaggtgaggccattcctgctgaggtgcacatactaatatttgaaagacatcactctagaccagcagttctgagccttggttgcaccttagagtcaccctatcagaattcctatcagaatctggttttgtttttgttttaaggcttcccagatgaatgtaatgtgcagccaggattgcaaactactgctccatctcagtagttctcaaacactagcctgcggcagaatcccctgggtgttaggtgcgtatcacaacacagattgctggatcacctccccacactgcctgattcagtatgtctggcatagggaccaataacgtgcatttctcccaacttcccaggtgcattcgtttgcaacggctgtggtaacaaagcatcataaactaagtggcttacaacagcagaaatgtattctcccatggttctggaagccagaactctgaaatcaaggtgttggcaaagccatgctctggcagctagtccaggggagaatccttccttgtgtcttccagcttctgatgtttgccagcaacccttggagctctttggcttgcagaagcatccaccactccagtcctctgtctttacacggctgtctccgtgtgtgtcttcacattgttttccttgtctgaacatctgtctctgtgtcctaatttctcatttttataagaacaccaatcatattggcttagggcccgtgctcatgacctcattttatcttgtttacctctacaaagacttcactttcaaataaagtcacattctgagatattaagggctaagacaatcaacataagctttttgaggggacataattcaacttacaacagcaagtgatactgatgctgctggtctagcaaccccagcttgagaacgactgccttgttgtgagctgcaaaagtgcaaagacaacattcctttctttcagtacatcctacccagagtgtagcttggcgcttggcacatcgtatgttttaagtaactataggttgaattaattaatattctttccacacagcaatttggcctgcataaaagacttcgatattttcctgatgttgccagaggcttaatgtgtgacatttcgtatagcaaatgctcaataaatgttgggtgagtgaacatagctgtcactcctcattacatattttaaaaacaaccttagtgggccttcatgcttttattccaccttatggagcccaatgacagaatgctgattaaatgacatggctcctttaatgggaaattaacaatctacaaaatgttgtggattcagtaataggcatttgaggcgctgactatgatgatttgttgcttgccttgccttgattccccagtgagaattcatctctatttagcaagtgctgtgatctactccagtaaaggagatctctttctttgaatcccagcaacctctagcttggtctttagcttcatatatcactgttaattttcacctaagtcagtggttctcaactgggggtgattgtgctcctcaggggacagacattagagacatgttttggttgtctgtcgtgagagcagagtgtattcccattccccagctgggaccagcgggtatgctgctctcatctaatggacagtggccaggggtgctgctgaacatcctacagtacataacacagttctcatcgctacagagaatctctggccccaaacgtcagtagtgccagcgtagataaaccctgacctaagcaaagacaaaatggacatgaagttgcctcaatgggcaagaccaagacttctgagccaccccatcagtgacacttgatgtagccggtagcaggagtgccagggagaacacagctttgttgttccatatccagctgtttggatcagagggaaatgggatctttcaatcactactgcagtatgagaaagtgagctgcacccagtggttactaggtggggtgctctgtgcagtgtgcttcgagcacaccctctcactgaatgtgagatgatgctcccactcgcagtgtctctgaggtgagaactattacagtccccacattgcagaagaggagtctccagcactgagactgagtagttcacccaatgtcatatagggtggagtgttaaagtcctaaataaaacccagtctataggacgattgagtctgtgattttaatccctgtgtagtctgggtttacatttccattcagattcctgctccaacatttcctatagatgctcctcaacttacgatgggtttatgacccgataaacccatcgtaagttgaaaattatcattaagtcaaaaatgtatttaatacacataacctgctaaacgccatagcttagcctaccctaccttaaacacactgagaacacttccagtacagtattcaataaattacatgagatgtttaacacttcgttataaaataggcattatgtcagatgattcatcccaacatcacaagaggatatggcaccacatgttgctaacccagaaaaagactagaattcaaaatttgaaatacagtttctattgaatgcatatcactttcatactattgtgaagtcaaaaaattatgagtgaaatcatcgtaagtcagggactctctctagctgcattgtgttgggcaagggatttaaccctcaccgtctttgtttcctcatctgcaaaatgaggatttataacagttcaaagggtatctactaggattaaaagatacaaaatacatctaacaatgtctggccacagtataagctcaataaatgttagttcttctccccgttagccgtcattacattcacaggtattaagaaagagaaatgtataggtatgatatgtaattctcttagttaatgagactttccttaaactaactagaagattccattcactggaaacatacttaatgatgaagcttttattctgttcatctccttcagggagtacttaaaaataactcacaagcccattgttagagctcatgttctttacccaaccaggatttaattagtccttcagctccttagcccttcttagaagttgttcgatgttaaatcccacatgacccttgggtgggaaggtgtggaaaccctccaagcaccatctgacatacccagtgactaggaagacttcacagtaagagttaaggatttttaaagattgccgatgttaatgaagaaggaaaaaaaatagtggatgtgctaaattagatatttacaaattatgttcctctctccaggggaagattcattaattttcaccgtaaccagcttcattctattgggacaccagaggaggatttgcagattacagatccagccacatctttctcatgcttaaagaagtctcattgtctgcactgtccagagaggggaaagtccactgcctggacaaggccttcatggctgttcacaacctgccccagcctccagtccattacccttgcctattttgttgcagtgatggaattaaagtccttctaatgaaaaaggctgtaggtgaattttaatccattagccatctaccagacctcctctgccatcctttagactctccatacagttcctctccctgccgtatcttcttgtgtgtcaatatttatatcaagcaagccctcctcatctgcccaccctttatctgccaggctaagtccaactcctacttcaagaccgcattcaaataatgcctcctgtctgcagctttcctcagcttccccatggagaattgatggctccctttctttgagcgtattcattcattcattcattcattcaatgacaactatctaccaggagctgttctaagcattggggtgtggaggtgaacaagaaagcatagagccattgttctagctggggaaccaatatgaagtaaaacataagctaatacttaagtccagaagttcagaagtgataagtgctctgaggaaaatatggagtgatgaggaagagtgaaattggcagagtgaagagtgatatttgatgaggcaatcagaaagagccattgtgaggtgaggtttgggctaaaacctgcataatgagagggaagcatccatcctccaagtgtagagcgtgggacgtcttggtagatacctcaccagctcttcccttctcagaggctctgaactcctggagggtggcactcttggcatccccagactcttggcatccccagtactttgtccggaattcatgcatagcagcagatagccacaggtgatggctcaagtgccttcatttaatttaacttaaaattttattttcggttgtacctgttatgcatttgttagccatactactggttttttttttttttaatcaaagaagaaaatagctattgcttcttttttttttctctgggttcaagacgttctggaaacaaagtttgaaaaatccatttaggaaatgcaatttaagtgccagataacatcttgggattggcgccatgatcgatgaggtctgggtataaccaacgtcttatgccatgtctctgatctttactcaaattcacctcctattctgggtagcgaagtttggggagacccagtggtgtggagagagggttgtgtttagcttctctttccctgacctcagagtaaacaccagccatctgcataacagcagtgcccttccatagtacttattaggctattgttactcagttgatgtcagttggtgccactagacagagggcactgcagccccatggccatgtctgtctttctgaaagattcaagtgccagtctctttgcatctggcacacagtaggtactctgaaaagacttgcaaaatgcagaaatgaatgaatgaaggcacaacaaaaacacggaccggaagggacacctccggtcctgaacagcctggcttcaacttcaaggaccacagttggcttgaattttaatccatcaggtcatctccatgtgttcactttcttccataaaggtgaatgtgtcaagcactgtgcaagctgccaggagaatggtggagtatgataaccatctagtgggggaggcaaacttgaatcgaatgatggcacaaataagtgtggaattatagagtatggtaaaagctaagaaggaaaggcaaacagggcttcaagagtacacagcagtgagcctggacccagggggatgtgggaagcccaggaacctggataagtggctgttgttgtttaatctattttttagctttcattttagtttcagaggtacatgtgcaaatttgttacataggtaaactcatgccatgggggtttggtgtacagattattttgtcacctgggtactaagtatccaatagttgtttttttctgatcttcttctcccaccatctaccctcaagtaggccctagtgtgtgttgttcccctttgtgtgtccatgctttctcattatttagctcccacttataagcgagtacatgcagtatttggttttctgttcctgggttagtttgctaaggataatggcctccagctccatccatgttcctgcaaaggacatgatctttcttttttatggctgcatagtattccatggtatatacgtaccacattttctttatccagtctacagttgatgggcatttagtttgcttccatgtctttgctatagtgaatagtgctgcagtgaacatatgcgtgcatgggtctttgtggtagaatgaagtcactgttgagccttgacctccaaggctgaaatagataaaggagtgaggagggtgttgtagtgggaagctgtggcctgcagaagctatcctggggcatcaggagctgctgggggagggaaatggtataagacagcagaccaggcagaccaagactgggttctgtaagctctgctaggaatcttccttggtatctgcagagcacaggaaagcttttgagagatttcagtggggagatgatatatgcagagctgagtctggaattatcacctgggctgcttgctgccagatagattggagcaggaagggggggatgggaagctagccaagagcaggtgtccaggtgggagagaatggtcacttaaacctagtgggggtgccagggtggggagaggtagacagattgaggtgatatttaggaggcaaactcaacaggccttggtgatggcttatttagctcagtggtcctaaaccagggacagttgtgtcttccaaggaacacctggaaatatccagatattttttggttgttgcaactggctgggagattggtgggaaggggatgctactagcatttcataggtaaaaactaaggatgtggctaaatatcctacaatgcaaagggcagcccctcccccaacagcaaagctttatctggccccagtgtccgtagcgcagtggttgagaaacctggcttcagatgtagaaacatcagagatgcagtgtcagaggtgatctttgggtcttgtcttgctaacaaggtgaaaggtcatgccattctctgagatattgggaccccggatagccagttcttttacaaggggtatgtggtgtcaatggagaccagaagatgggttcctgaggcatttggagacatccaagtgaggagatggcttgttttcttcctaaattttcaccatcccccacaaggcagcctttttttttctctgttaatgaagtttccagccaccttacccttgattctcaccttccaaccccctgccttccaatattccacccctcttttttctgccctagaggagaaacctatgatccttgcattagaatggttttcctgccatcactattgcaaaatagacaagggtaaaagaaagccttcagtagaatttcatctgagtattttctttgcccccttgtgtgtcattttctccttaagaaaactgaggaagaagtgtgatttagtcccctcatctgcataattttcttccctgtgtggctgtgtgcttgtcagtgctctgacagatcaagagtgctctgaaagctcagaggagcaggaagagacccaggtgacctggtgagagccacgctgaatctcggttcacatgtcgttaacggagcttggtccttggagggccttgtggggaaggacgcagacaagctgtgatggagtccttgggtctcacctgggagagcccacgggagcacctgtgagttggttccgagaaaacatcccactctccaggtcacctctctgtgcttcaccccacctctcattcttcttttgtgcaaagcacctatttggaagtaaaatatcagctagaaaggaaaggagtttcagaagaaagtaccacatcagcgttttgaacaaattaagttgtgtgcaagctgagcagcctgtatcaaggggaacgtggtagagggatgtgagcctcaggctgcctgctgccggttgcaggctgccatatgcttcacctgcttgtgccctcgagggtccccttctggggtccccagtctggcttatgatcatattccagcatagagcactccctaaccccactcccgtagcactgggactatagctttatttcttgcatcatttttctctacgctcaaaaaaaaaaaaaagcaaaaacaaacaaaaaaaatctgctcagcatgagaaatcaagttaatgaaaacgctaccgcattgaatttccaataagagaaaggcaaagcaaaacttgtcaactaaagaaaggggcattcactgtaatcccttcgaggagaggtggaagcaggagtaatacaaaagctcattactgtaatcaaggcatttgtaactgttggtggcaggaggtgaaagagagagagagacagagaggggaagactctgacggaggttttaactgtatgcatgccagtctttcccactcgtcttgctggtacaatctggatcgttcatatagaaaggagacagggtttgccaaacttggctgaccaagccaaaaacactaattagcagcagctgctcaaaattggggatgctcttgccttctagtgcaggggtgatgacttgttctgactcttcaagattcacaaccttagactgcaggatgcactttgccaggggaaatgtattctccaacgtggctgtgtgcattggtgctcaaacattggtgaagccccaagtacttgagagggacaaacaaaacacctgtggaatctcttggtcagctggccagcaggagtttgaagccagggtgaactcaaagcattctcccaaagaagcctttttcaaccagggggcgctgacagaagttgtcaacacgtctggcaaagctttccagcatctgctatgatgtcttaatcctcctgtgaggagtgacagaggtaatgtgtggcatggagccatcagtgacatttggtgattgaatgttgctggtggcagtgtcttaatgatggagacaattgattgataggaggtcaactgccaagcagttaatccgatggcaaattccgctcataatggaagagctggcccatgcatgcaaaccagcatggtgggggattcctgctgatgcagctgtgggcacatgaggagggggaaagatatcaatgcctctgatgaatgtctagcaaagttttccttgtgaaacctcatggaaagttccatgaggccagagatcacatctactttgttcactgttctatcctttgttgctgacacatagtggccattcagtaaacatctgttaaatcgaggaagcagtgaatgagttggaagctgccttccttaggctgttttacttccagaattctactttttcactgacagtaagcctaacctctcaggttagaaatctaagttgccttgcattcctccctctctcttccccaccaagctctgcatattccatctcaggaataaatctctaacatttctcccttgtcttctttctctgaagccaatttgcatctcccaagtagtcttctgatgagtaagcctacccccatctctgttccatggcccccttaagtcatttatatctatctatctatctatctatctatctatctatctatctttgagacagcttctcactccatcatccaggctggtgtacagtggcatgatctcagctccctgcaaactccgcctcccgggttcaagtgattctcgtgtctcagcctcccaagtagctgggatcacaggtgtacaccaccacacctggctaatttttgtgtttttagtagagacaaggtttcaccatgttgagcaggtgaccccaagtgatccacctgcctcggcctcccatagtgctgggattacaggcatgagtcaccgcccctggcttaattcttttaacatgtaagtctcatcatgttacaaccctgctttacatagtcaaagtcaacaagtgttatttggccatagatatctcttaggccatgacaacccacctcctagtaccttcccagccttgggttaacttcatgtcagtgctcacattggtgcttcactgtgtgctgtgtcttacgtttcaaacacccattctgcatcttcttgtttcctaatctttgctcatgtattcactcaggctggacatccaagcttctcttttttttcctagcaaaacactgtctttgtttaagatgtgtcatctggggacctttttctgattcttgtcctcccttggagaaataaatgcatctccctttcctttcttccatttttcatcactttgtacttgaattgtcaatttgtctacccatctcacctgctggcctatgaaggtgtcaagtcaggggccataacatctttttcactgttccttccagcaactaatatggttcctggcacataattacttaatgttagttgaaagaaaaaatggatggatgaatggatggatggatggatgggtagataagtggataggtggatggatgggttggttagcgggttaataagtaatgggttagatgcatgacaaaatgaatggaataagtaattgaatggattcataaactgattcattccaggggaatactaagaaaatagcaactccaccacctcccaccttgggataaatgatatggccctgtccagggaaggctgagtgccctttgtcctcagacagtgaattctggagttccaggtacatgagcatcagggtgtgatctagaaaggagcctgtggacctagttgggcgtattctcttggtcctggggattctttgtgccatggagaagagcatagtttgagggaggtcagaatgggaggccagaacccagctgcttatgtctaaagccattatcttaccaggaaatgactaagacatatgggaaaggaaatgccaatctggtaactcctgtaactgtcagttccagtggaggatgcaccaattgctcgtgctcacatgctaaatcctttctccagacatcaccctggcatggccctccgtctcctagtcaggcattaactaataggggaaatgcaaaatgttgataccgcagaatatagagacagaagagattcacactgaaagtgcaaattactttttttgcagtgaatagaaagtcacattactctaagaagctgcctaattatctgtaattatgcccaaaatagtcaagctagtttgctagccagttgaagaattgcatcttaaatgaatttgtcactaaagaaagaatgttgaaacctggcaaaagagattactgcatttcaggggaaagattagaacatatcatgcctgtgttcagtctttcaaagacgtggttattggctgggcgcagtggctcacacctgtaatccagctctttgggaggccaaggtcggcagatcacaaggtcaggagttcgagaccagcctgaccaatatggtgaaaccctgtctctactaaaatgacaaaaattagccgggagtggtggcacgcacctgtaattccagttattcgggaggctgaggcaggagaatcacttgaacccaggaggcagaggttgcagtgagctgagatcgcgtcactgcaccgtagcctgggcgacagagtgagactccatctcaaaaaaaaaaaaaaaagtgactgtggttattgtaaacatttttgcttaggaagcatttattacagctgttcaatgtagcattttacggtattcggtggaaactctaatgtaagttcggagcagtcctaacattccaagagttaaaattatccatgattgggatgtaatatctaaattgaaataaataaactgtttttatatgaaggattttttcctgattcaaataaaggaatctagtttcattgtaggcaacacaggaaatacaaaagttataaaattcacatctgtaatcccatcaaccagagaaaactcttagtaactagtgggtgtttcttgctagctcttttctatgcatatgtttttcttataacactggaattttaatatatacaacattgtttagttacattcttccatgtaactttcatgagcatttttatctgccctgtaggaatcaaagtgatgggttttttttgttgttgttgtatttttttctcagatggagtatcgctctgtcgcccaggctggagtgctgaggcacggtcttggctcactgcaacctctgcctcttgggttcaagccattttcctgcatcagcctcccaagtagttgggattacaggcacccaccaccacacttggctaatttttgtatttttagtagagatggggtttcataatgttggctaggctggtcttgaactcctgacctcaggtgatccacctgccttggcctcccaaagtgctgggattacaggcgtgagccaccacacccagcccaaagtcatggtttttaaatgccaacataatattcaccatttttacatactgttgtttacttaaccaccaatttattgtagataattttgtgtcttttataggtatttataaacgattctgcagtgaacattcttgtacagatataattgcctgtgtctctgtctgttttcttaataatgcctaggaatggaattactaggtcaaaaggtatgatcattttaggaggttatagattagacctcaatgtagcagtgccatttctgtctgtgaatctttctttctagatctttctaaaccagggtatagaaatagaaggtaaaatcctcttggacagaaaagaaaagaagcagtgaacacttacttaaaaaaaaaataggcaatggaggagagccaaaatttgaactccagcctgaaaatcacaggatccctggagacaggaatatgcactggcaggcaacagaaagccaaacagaaatgagatcgaagaagagataggaaaacaaaacatttcaaaggaggcatagaaaggagcatataatggtgatggaggcaacgataagtaggcaatggaaagtagagaagaaaaatagcagcatggctgtgaaggaagggaacacgaacttctgcaaaagctgtcagaatcaaaatgaagccacttatgttaaaattttttttaattaataatcaatttaaaaccctgaaaaatgagctgaggagggttatgaagaggggagtctcacacttggttgcctgataacaaaaactgtcacaaaagactgcaaaaaccacaaccttgcacaaaggccatcacaaccttacacacacacacgcacacacacaaatacttctgcaaggacatctgcccagcaactgcctgtccaagtacagactgatgtcacccttattattgatctttgtagccagcaataactacttcaaagccattatgtaatcttcctcattttttccttcaaaaacatttgtctttctttacctccctgcacacacatacaaagttactgcagcacatgtattcccattgcaatgccctactgctgaatcttttttttttttttttttttagagaacctctccctctttgttatttaggttgatgcttcctgaggccacccctgtgccacacagacagaaccctgcggggccagaggtggagggtaggagccattgagtgaaaaagcaagtcaacatctaccagcttgcagcccctcactgaccatgttgtatacagagagagcgagctactttggtacttcatcaaccagacagttcagcagcttgaaagaggggagatttttccatgttgcagagtgacaagttgatatacaatgtttatggagaccatggtttgtacagtggtaaactcaagcacagaaacaggcataggggtatcttagaaccttgctgctcaaagtacagtccatggaccagcagcattgaaaacacctggaagatttttagactttcagaaaccaagaccctgcctgccccaggcctgtggaatcatagtttgcagtttaactgattccccaggtgattcatatacacattaaaatttgagaagtgctgtcttaaaagacatctttttatatgaatttcagactttgctggtgcttggatttccagtgttcactggaaaagccgaaagatttatgtgagcacttagttgactgaattgcatgtgattttagaagagggatttccagatgtaaagttaaaacatgatgtgtgatacttagcataagtggagaaaaccaattgataagcccaaggctaagtggaaccattctgactttttgagaaacgcaatctgtttgggggatagtttctaaagttcatcagaagaggtgtcattaaatcagattttaagcagaatatagcagtttggctaatgttggatagtctgtctgctcccaattccagaaagtaaaatattttgcaattgaggattgtaaacatcttagacagttgcaaggactgtacatgacatatccatgcaagagtattccgttctgtttctatcagcttcttatgctttttcaatgggaaatagttttggaataatgggctcattagagatagacaaagctatggcctgggggaagtaacactggtacccagagggttttaactgtttcactccctttcccagtgactcaaactatgcaccagtattaattttaaatgactttacaaaaagacttaatgagataaatcgtgtaggcacagtataaaagttagtctttcatgttgtgtctgcctgcagcagcgttctaactcaaacgttaggagaggcttagagacaatttgggtctagcatcaaatcagataaactatcatttttaattattgttattttgataaggacttcatagtctcttaagtaagccagccctaaaaatccttgctcatgtttttaaatggtaagggagattctgcaaagatagtatgaggaagcaggaggaggaggcaaatactggttaaatgccttgtctaaatccaccacagtcctcagcatcatcatgaacaaattgcagcagttatgcaccaagcaggatgcaaagcaggaaacacacattctcacatgcggtggtcaatcagccaagtaaagccaaagttgttgttgttcccagttcaaagatgaggaaattgaacctcggaggggtcaaataactcatccccaatcacaaagccattaagtggttctgtcaggatttgaatccatagcctaagttcatcaccacattcttctccttgtctcagtttcggtatttctcacaaatcaagggacctggagagaaacagaaactatttccacaacatcaagaatgtcacttagaatcaatattggcctggcttcgataacttacctaacagagaggtaatcttttcatggggcaccccacacttcacgccacacttaggcaagaagaaatgttcacagtctcagctgatgccagggaactttacagcaaaggaaacgttgaagcgcctcctgggctgtgtccctccatccctgtgcctctgtcatcctgtctacagattctcatgacagcaatgacaactctcaaccgattttctacataaggggtccccgacccccaggcctgtaggaaccaggccccacagcaggagaggtgagcagtgggtgagcgaacgaagcttcatctgtgtttacaggcactccccattgctcccattacttcctgagctcctcctcctgtcagatgagtggcagcattagagtctcataggagtatgaaccttattgtcaactgcatgtgagggatctaggttgtacgctagttatgagaatctaatgcctgatagtctgtcacgtctcccatcacccccagatgagaccatctagttgaaggaaaacaagctcaggactcccacagattccacattatggcgagttgtataattatttcattatacattagaatgtaataataatagaaataaagtgcacaataaatgtaatgggcttgactcatcccaaaaccatccccactctggtccgtggaaaaattgccttccacaaaactggtccctcatgctgaaaaggttggggactgatgttctatgtatatgatagaacatgttactgacatgttacattatatgtactattctgtgttgaagcaaacgaagctctctgtaagcctttcggaaatagtacagatacggaaacaggggcatctaaaagtcggccatcaggcactcagggtgacatactctgcttgccctttgttataggaaatgccctggagttgagtctgggaggtactgggaggtgtctcagcaggagataagcagcggggacttgccgtcttcctagatagtactgttacttggttggtacctttcatctcaatgcccatttgtgataccagtttgaccccagtagcacccaatttcagacttccccagccacctgtgacttagagtgagtagagaggcaattagggcacatgcttcgatcattttgagtgacagagtcttccagataaaaacaatataaaagagagactgctaagggtctctggggtgaagggtctatagatccgtcacttccacagggaagattgcttttcttggttgtttgctgagacctggggggcattgagcactgggaaatcaatgattgtacagctttatataaaaagggcacccagcaatgctcacacagtctacagggctcatttcttcctgaggcagaagagttttgctacactgacaagaatccttctggctggacacagtatgtcacctgttgtagaggggctagagtttgagaccatcacatttgctttctgcaagccctgaagatttaagagtgaacctacattgtttattgggatgttcgcaggttgtagtggtaagattggatcagcgcggtaccagttagcagagagggatgatgtttttaaagagtcttccagcagccacaaacatctatgaaagatacttccatcaaaaacaaagcttgaagtcaaaaaaaatggggaatttaagagcatctagatttgtctgttatgtgcaacaacttcttacctgactggttgtgccttgggtagtatcactggtgccttatgcatgaataatgtatgtataatgtatgtgtcactgccttagaataagcaacgtggaccacaggtcttgggcaccttaaataatttatatttaaaatctacatctagtcagagatgcatctgcatctacatgtaacatttatgaatgcaagtggaactttttttcccttttttttcaaaagctaaattgcctgtatttgagtgttagtgttccaattaatttagttgacatcatttcaactttgttggaatacctactacttacagtaagttatgtgggcccttgttatgaattaatgagagcaacagagaaataacttcagggaaagggtacatctttaaataatttacccacgtgggtaggtaggaaaactggatctgtggtcatgcgtagtgtgcgggtatccgaagctgggtgtccacagtcacatcgggtcctctgtatctgtggcacaagggcagacagagaggtcagtgtccaacaccatggaggaccacaggctcacctccctcaatggggtcagcatctcataaattagtcatgctggagccctctccaggagttcctggtgggagctaaagggaaggtgaactcctttcttttaaacactgctatcatgttaagatccactgccaggaactaggagggcagagtgaagacagagaaatgcaaagactgtattctgaaaagttaaggaagcagttctgtgggtgaggatagtgaataataatgttgtgagttgttttgatgagccaggcaatgtgttgatcacttcacatgtagtatggtctttaatttttatttgaaaaactgaaggccagacatggtggttcacacctgtaatcccaacactttgggaggccgaggcaggtggatcacctgaggttgtgagttcaagagcagcctgagcaacatggagaaaccctgtctctactaaaaatatgaaattagctgggcatggtggcgtgtacctataatcccagctactctggaggctgaggtgggagaatcacttgaacctgggagacagaggttgtggtgagccaagatcatgtcattgcactccagcttgggcaacaagagcgaaactgtataaaaagaaagagagagagagagagaaaagaaggaaggaaggaaggaaagaaagagaaagaaaaagagagagagggagggagggagcgagggaaggaaaaattgaaaaccctgaggtaggcaccttaattctacccatttttcaccttaattctaaccactttccagataacaagcacagagtggccaagcaactttcttactgtcacaaagaacagggattggaagccaagaagccgaaggcaccacagcgtctttttgaaacttggtgctttcgtgcctgcccaaattctctgattaagaaagaattagtttcctaattcttttatttttaaaataaaaataaaagattaaatcagatcaaacagttggccaatatacatgttggttattcacacgatggaggcctcattgcctgatacatcccatactgacagtagcagatttggaactcatgaaaccctcatcgcttcaacttcctgcaacaccccagctccttctaatagaacccagtgtctccttaattctttatgtgatgaatacgtattgagtagctactctgtgttagtccctggacaagagcagagcaaaggcaagaacgagataggagaggtctccctctcacagagtttggaatatagtagacatattcatagttctgactgggcaaaattcttctctcttacttttatccatagtttccagctctgaaacctaatgctacaaagataaaagttgcatttgatagataatgcaatggaacactactcagcctttaaaaaggagaaaatcctgccatttgcaacatcatggatgaacctggaggatgttatgctaagtgaaataaggcagactcaaaaggacaaatattgcacgttaccacatatgcagtgaatctaaaatggtcaaactcatggaagctgcatgggaaaatggttgcaggggcttgggggaggggattggtgtggtattagacaacagtacaaagtttcatttatacaagatgagcaactcctaaagacctactatttagagtttcacttaacattgtttctctgtaatgttgatgagaaaacaaaaatggtcattggtccctgggcctccctgctgtgtgctctgccgttgatgttacttagcttctttctctgtattgacatctttttgccttgctacctagttactaagtctctccaagtttctattccaaattcccaagagatcacaatgattgacgcaaccttaatcatatgagttggttcccctttggggtatgcccacctctggcccagtaagccatggtgctgtggcaaggacaagtgtaccataaggttggccccccccccgccccaggggctgagggttgggcagattaacctggaagggaaagggtatgtctagcaaattagaacaagtaagaagtatgatcacctgtaagttcatgctacattttctggaggtttttcttaattatttaattctcctctcagaccttctgtgactcccaaaccaataaaccatttttgtttggatgttgttcttttcttcccttgaaaaatactcattcaggttcttctctcattccttcaaaagagacttcaggccgggcgcagtggctcacacatataatcccagcactttgggaggctgaggtgggcagttcacctgaggttgggagtttgagaccagcctgaccaacatggagaaatcccatctctactaaaaaaaaaaaattagccaggtgtggtgacgcatgggaggctgaggcaggagaattatttgaacctgagaggcggaggttgtggtgagctgagattgtgccattgcacttcagcctgagcaacaagagggaaacaccatctcaaaaaaaaaaaaaaaaaaaacttcaagcaagggaggctatgctatcaaagtatattttcctcctcttctgcaaggggtctacatttaagtcaatagtagcacaatataagaagaaagactattaccagctaacatttattgagtatttactaggctatcagcactggtctaagcactttacaggttaaattcatgtattttctacaatgatcttaagcagaatttccttcattttcttatttccaaaattatactacctaatatagaaggtgatgatgaattttgagagataatgtacctgaatttcttattgttcatggtatatgcggaataaattgtgcctgctgattgctgtagtggtatcatcaactacaacattgttccacagctgagtggcatcactgttttgtagttccttaaaagagaccactgctctgaatctgactaaactgaagacagagcaccaaaatcaaatggggattcagatgtccaaaggatgggaggtgaatgataaaaatggttagagtcacaaattggaatccagtggagcgatagtgccgcagagtcaagatcctagagagcagaattctgagaaacccatgtccagagaatgtggtcaggaccttggagagctcatggtgatgtccaagtgtcttccacagtttagatctcagactagtgcaaaagtctgcatggggctccagccttgtaagggtctcatcttgttttatttggaggctctgacatagtggaactctgggtgccaaagggatagttcagaacaggaatcttctgacctggatagggcaatcaaattcttgattgtgttagtgcatcaggatccttgtcagataataagaacttttcatcttcctgtgtcagcagagttcagctctactaccagaatagaaaaaaaaattgcaaagtatatagcaaaaaattagcaaacagcaccaacttcttttcttatgtaacccacagtgaacaagaggcaattgtctcaatcggattcaggaacaacactgggttacatttggattctatgtatttttagatgtttaatttctatttgcctatttcatgaaagattggtaatcacacataaatctgcatgagtaagaagagacccatgaaaataaatagtcctacagatgtaagatttgagataaaacatatcttaagtgaatagattgtctttgttcttcatgaaccttcaaccttcatgccacataggtttggtgaagaacgtttttgatgtctgttacccacatggagggtttctgcctgtctattttgggtagaagatacttagaacaaaagtcgtcttgaagggaggagaatatcaagaaataaatcatgtctgtgttcctataaaactaataacaaacttggtaaacatgcatctgaaaaataactagaagtgctattctactgttactataaaggaccctgagtactgtagatttggttaaactgtgggtagccaagagggacgaggacctggattttgtcctgagcttttggcaggctggtagagggacaagtcccctttggataagtccccttttctctctgggtgtgtctcctcatctgtagtagaaggaccattggattagctggtctacaagattcctttcatgatcagaagtacagagtaagtatatgaatgatgcgtgaattaatgaacaaacttctccctgttgcgacattccaggaatagcccatggacttgcaaagagaggcaaaaaatggcatctaccagctgcttcctcttcttaggagtctccaacagagcctaataacatggggaagcattactaaattatgactttgtgcaagattattaactcggagtgaatggctattctttttggagattttaagcagtcatggaaccaggatggactcctgagatggacaactgcatttattcacttcaaacacaacatgataaaaatgtttttgaagctgtaattttacatcctgaaaaaaggttaaatttaaggcaatgtacaaagacaaagaatgactttgagcaaatgcattaatttggtttgagatgttcagaatttaatgttgactaaattggttaatctgaagtcttttgggagtggtgacagttatcctgtccttactgtaatcaatgtgcttgatttggtggaaattttacatatagccttacgaatccttttgactgaagtgcaagtttcctctagaaacgaccagttttaggagggcgtgtgtgtatgtgtgtgtttgtgtaagaacacatactggacaagacttcttgaaaaacagactcagtagtgtcaagcagcatataactctccccaaaccaaagcctcctgccctattttctgcctttcctctgctccctggcagagctgacctaccatctctctcggtaacttggcaccactactatccagaaactgaagtgggatgggtcgttttgtttattccgtgaagttactgtgagtgcacatcctggaatctgagagatccagatctgaatctcagtctcttgtgtcttcacagcctgcctgtatgactgggataaacaaccttaaccattagtttcttcatctgcaaaatggggatgtagtaccttcctcacagagcaattatgagactaaatgaggtcaaatacgtgaaatgattagcaccttgcctggtgttttgcaagtaagtgttcaacatctgagaggcactactagtatcagtagtactgttggtatttatcaggtgccttctgtgtaccaggtaccaggtgaatccccagagatgaaaattggaccgagtctgtattttcaagtagctcaaaatctagcaagaaaaaatggcaggcaagcaagtaatcagggaacaattgggtaagtgaggtgacaataaggcattaacataaacccagacaaggggcagtaaggaggggaggggctgcttcttgaaaaaggtgacatatgggatgactctttttttttttttttttgtttttgttttgagatggagtctcactctgtcacccaggctggagtgcaatggcacaatctcagctcactgcaacctctgcctcccgggttcaagtgattctcctgcctcagtctgctgagtagctggtattacaggcatctgccaccacacccagctaatttttctatttttagtagagatggggtttcaccatgttggccaggctggtctcaaactcctgacctcaggtgatccacctccctcggcctcccaaagtgctgagattataggcatgagccattgcacccagcagggatgaatcttaaaccaagtgacaaaaaggtaagaataatgactgatacattcagggatcagggatagtctgtgcagaggccagagagaagagtatggaggttggagaaaggcagccctcctctgccctggctccagagaccccatgtctgccacagcacaattgtctgagtcctgcagtaaatgctgtaaactgttgttgttggttttgttgttgttgttgttgttttgtttgtttgtttgttgttttcagttagaagcagtgtcattcatacaaatgaaataccaaacaggacccccatggcagaggcaacttctcattttatctcttgctcctcagcgcttttgagtctctccctgcatcacttccctgccctacacctgccaggtctgtgggtcctctttcatgtttgtagttctccaatactcttcaggcccagtgatccttttcagactcttgtcctctagaaaagcaattcagatctcgcccaaggcttacttctcggtttctggctataattgccctcatagtaccctgaccccagactcctactggatgccatccgaaagagttctcgaagccctcatctgcgctataggcacagaccactctccccagccctgacaaccctgacctcacatgcccttgggatttccgttcctcttccactgttctttttttttttttttcttagttgcagagtttttcggaaggactgattaccgagtctcttctttccccaagagtacttctttgtcacaaatgattccactccttgaggacatttggtgacatttaattcatctcctgttctctgcttggatgaattctgggaactccctgagaggaaggacaaggcagtggaacatctgagcaatgcgatctttatgtggtgggtgaaggtgatggattttcatctccttcttcacgttttttcctgctgcatggggacctctgggcattctcctttctcttccttgcttttaactgatttattcttttcaggcttatgacttttcttttgtgataactgatttattattttctgataagttattcttttgtgataactgatttattcttttctggcttctgacttttcttttgtgataactgatttattattttctgataacttattcttttgtgataactgatttattcttttctggcttatgacttttcttttgtgataccagtttgtaaatgtgtaacttgtctgatctttcttctttcagcacccacctctcatgctatagcgtttgcactccattgcatattgtttaagactgggactcatttgagttgtaacgcaggtgtgagaagctttgcaaggctacagaactgtgttcatccgtctcttgacttggactatggaagttgccacctgctcagatgccctgaatggtatgttgggctctaaattggcctgacagtaccacagtcctcttccaatttcttggggatgtccaggcattggataatggcagcccagttgcttctgcttgcagtggaaggaagggttggcatcgttccccagcacccaccatttgctgggaaggaaggactgttcttccctttctttaacttgcacctcaatgcataaagaatatctgccctttccccaacatggggcaggggtggcctgctggaatgggagttccagcttctttctcaatcccttattcactcctgtcataggaagacaagttgctaaatgactgtgggaaaccgaaacacccttccagccacatatactgttagataaggttcctggctctcaaaggcagagccccacctccattctccattctccctcttccactctctccatccaggtgcagcaagccgttttgtgcttcctgttccctggacccgcccaagccctgagcaggcatgggtttaccctccttgtaccatctaatgaggccgggcagagcatcagatgggaggttctggtcactctcaggcaaagccctgctctccagctcactttatgacagcactctgccttcagggttgtcatcacctgttcagataataatctagctcatcatttttcatctgcctggtgttctttgcgtgttgcttccagaggcagaatcccagagaagagagggaactgtcagctcctaagaatcactcctccagaaaagctcagcaaccaagaggaaaaaaaagaagaaacacagtgaaagaggaatgctttccttattcccaccctcatccctcacctattctttctctacttcctcacgttccctccatccctgggagatttaccatctgccattccctgtgtgtcatacagttctaggctctgtgcttctgtcctgcctgtgcctgaaattccttacaattttccccatttgccatccagccaacccctgcttattcaaaactcagattcagcctcccttcttccaggagatccttgactccccagccaggcttagctgccactcttctgggctttcccagtgcccagtcatggctctcatcagtgtattctctaaaaccattgacttcttcgccttccctagcaatctgtgagtctgtagaagaaaaggccatatcaatctaactttgtattcctggttcttggcacatagtgggtgaactcacacagactagagataaatcagagatgaatgagtgcccccttgagtccagggcgtacctgtaaaattgcaaatatctgcatgtacgagttgcaggcagggaaactgagtcacaagaagagttgcttgcataagacttcgctagtaaatggcagagctggtgcatgtgaaaatttctaaggcagaaatatgtacttatttaaaaattttttaaaaagcaagaaattgtctagacaagttttttctttgttcgtctgttgttttttgtttttgtttttgttttgagacagagtctcactctgttgcccaggctggagtgcagtggtgcgatctgggctcgctgcaagctctgcctcctgggttcacgctattctcctgtctcagcctcctgaatagctggcactacaggcgcccgccaccacgcccggctaattttttgtatttttagtagagatggggtttcactgtgttagccaggatggtctcaatctcctgacctcgtgatccacctgcctcggcctcccaaagtgctgggattacaggcatgagccaccacgcccggcctagacacaagttttaaccctgtaaattctgttgcctctaactgcaaccaaagccccaattcatcgcattctgcagagtgctgcccacattcacttggggaatcagcagcatgtacacctcattacttcacctccaaacccagctcacaagcaggcaggatgcgcaccaactgtccggttagcagagcttcccatttaaatcaaattctcttctcctcccaagctcatttcaaaggcattcattggtctgaatacatgtgctggtggaacgaaatgacactcaccccaaaacaaaaggaaaaaaaaaagctgatctgatgtaaaatctgtctgcatttcagagctgtcgagatgaaaaatgaagccacgagtttggcctttaaaaatattaatttcttataaagatgaactggagagtggtaactagaaaattcccttatctcctaggaagaaaacacaggatgaaattctggtccttcttcttgagtcttgtatgtcatttccaaattcaacgattacttgttcacggttcatttatgaggtttctgagcataatgaatgtccgcacatgtcactgagttattgatgaatcattgtttctattctgagctcagttcacgtagttcaatgtgctttggcttggctgtcactttaggagatgatagttaacccaacggagtaaatctggccagttcccgagtgggggcagggggttgggctcaactaagggcaccaacaataaatgcctccttgctggtagatgggaaggactgagaagacagaggggaaattgcttgcattctgctaacatctgcaacgtctgtaacagtgtcttttccagcagttgtaaaggatcctcactctccctttcctccctcagtcccagttcctcctccagagctcctcgtgatcatctcccaaagccactcacttgctgttctgtcctttgaggcctctgtccacttccagctcctgcctctctttcctggaccattgcagagtctcagaactgcctctctgctcccacttccatccattctctcactgcctccagaacattctccttttctgaaacactctcctctgcttgaaagtactgaaggcttcatcttgcctagtgcagcaattccacattccttataatctagtcccaaaccactgtctggcctcctctcctttccctccttctgaacaccctagattcctgccaaatataatgttattccacaaacctatgaggaccttgcctgccctctgtgctttgcacatgctcttcctccagcctttgcactctttccttccctcgtccacctgggagactcctgctgatcttttcagactcagcttaaatgtccccaccaaacctcccctccctctccccattggaaccagctccacactgcactccaccatgttggcatgtacagtacatgtggctaccagttgattgacagattgtccctgtaagccagtctgctcagggctatctctgacaaaatagtgtgttccccttccttggggagtaactttagacaatttgcagtggatactgggctgcagccttgatgctgttttttctctggaaactatgcttgaaatatatttgaatgaataaaataatacatctagtaaaaatacatttttctatttttttctaaaagtatcttacacattttccatcaggctcaattgtgaaatccctccagattcctaattatcttcttcccaagataacaagatttctgtcctctcttcacaaagacataggacatggactcagagacgtccaggcatctaactctctgcctgtctgtctctctggggaagccaatggtttttttgtttttgttttgttttgtttgagatggagtctcactctgtctcccaggctggagtgcagtggtacaatctccgctcactgcaacctctgcctcccgggttcaagtgattctcctgcctcagccttccgagtagctgggactacaggtgcacgccaccatgccaggctaatttttgtatttttaatagagacagggtttcaccatattggccaggttggtctcgaactcctgacctcgtgatcttcctgccttggcctcccaaagtgcttggattacaggagtgagccaccgtgcccagccaggagccagtggttttaaactgatcatcatccattccctttctcagacttaggtccctggtcctgtgtagcccctgttttcttacaaaacaggaagaagctctattgttggccagaaagcaaagcaaaggaacctgagcacacaggattctaactcatgctgttgatttcattagtataggtcttgcatcgtagatgccaaacagagtatccacttaccttggtggccacaaaaccaccttgaggactagcaaaagagccatatggggtcttttctgtctgttcaccccaccttctaaaatccccacctctcacacctggtctctgatgacacttgtctcggatgtgactctgtgtctgccccacaagatgatgtcttcatctgccatttaacccaaccctttctgagttctgatcatgttcctgcaccagggagtgagaatggcaaagccaaggaaaaacgtactgctgccctcaccgtactcatggtctagcgtggaacagcctcgctgctttactgggctgctgtgggaaggaactagcacagtgtatgcaatcactggaaaagacggctggggagctcaacagcaggagacaaagtccatcctagtattcccagagattctttctcatccttttatatatataaaaaaaaatttaaatttattatttatatatttatataaattattatatattttctatatattttataaaaattatatatttatatatatgaataaaatatattttatattttatatttataaatatatatatttataaatataaataaaaatttatatttttatatatataaatataaatatatttatatatttatatttataaatgaaactgtataatttttatataaattaatattatacattcatatatttataactcatccatatatatatatatatatatatataaaaaccttctggcgccacccaagggccagcacctccagctaaacattcaaaagcagaggagctgcattcctctccagcgtgagggaaccacactcaccaaagaaagccaaaacagaccccgttgacatgcacatatttccacaaacatcataaaagtccttttcactttatttcattaccagactatcagggagaatttcccagtggaaatcttcacccaatttgctccatatggattttctaccttattttactactgagaaagcagtctacatgttttatttgcaagagaatcaaaagatggaaaattgtcacatgagggacagtgagaacaggtagctgatagaaatacaattgacagttgcatcctggaagaagctctaacggtcttcatttctctcagcttgatgttgggccaagtttttacttctttaaaagaaaaaaaaactggcccttaaagcaataagatattgatcccttaaattatctgtgtattgaattaggctaacagaatctaagtttaagcaaatttgaaagaatgatcttgaacacgagataacaggccccgagtttgtactcccaggtaatggtgaccatacacttttaccataccagataatcaagaaatattgggtctgccactccttaatgtaacgctggcatgtgccttgagaatccagcacaggcagtttgctcctgaggaggaccaggggtaaagtttattctccctttttccttctcaactgtaattcacccctcaattactccctctcttgtattcccaaactgcattttcttttcgctcatatcctgtggtttgtctcaattctatgcagctaggtgcctgagctagaaactacctaccaaactggtgcctcattcccctggctcctcacatgaaacgtgcactccggccacagaacttagcagtcgctctgcatggggacagatcctggctctgtcatttcctctggactaactaggggaagtcatttaacattctgagcctcagttttgtcatctatgaagtgtgtcagatggtgaggaccatgtcacaggttgcggtgagagtcaaatagggataacttccagaaaactcacaaaggctgacatgtgttaagtgatcagtagatgttatttatttttacagtcatcatcaaaaccctaattgataactaggtattttttattccactttcctgtggtgtgtgtgtgtgtgtgtgtgtgtgtgtgtgtgtgagtttcactattgttgcccaggttggagtgcaatggcgtgatcttagctcattgcaatctctgcctcctgggttcaggcgattctcatgcctcagcctcccgagtagctgggaagagacagggtttcatcatgttggtcaggctggtctcgaactcctgacctcaggtgatctacccatctcggcctcacaaaatgttgggattacaggcacaagccacagacctggccttttgttccactttctaaaactctctttcattcctctgctactctccctcctggaccatctcgtctcacctggatggatatactgtcagtgtcaggttcgcctcttaagtcctcagtactgagcacagtgcctggcaacatatggccccaaaataaatccctgatccattgaattgaatattctagccctcgctcaccagttaattgatgttattcctggccacttccgggacatgggcagaggaaaagctattgaacatgtataatagccaaacatggcattcgtgatttagaagaattcggaacagacccaaaatatgctttggaaactcaaatcatccatcatttctcctataaatttcagtaatcatttctgtttggtttgttttaaggatttgatgcatttaaaatttaaatgtgggaaagttacgccttttgttttatttcctagtagtatgaccaatgaggcaaagaatccaaactcattaagtttcacacataaaggattgaaatgtgtacagtacttacagcgagcacaggctgagtgatgaagctctctttttaggccttgaacacgttgacatacgcaatatttttcatccacagaatatagtaagaacatcatctcacaccatgaaacattaatattggttttatgactgtgcacaatgcagtaacacattgctgagctgccaagaaatttaaagaataaaaaagatttagacactgaaagaaccttgaatcattgaatttggggaggtagggaggaaggttggagtatgcctaggagctgattatgtggcttccaacaagtgaactagagccaaactatgtgtattttaaatgatttggatccttaggtttagtactggtgggtgtggctcagttctgcctagtcaccattcagtggtgggtcaggaagccaatgggttcagcaaaaaaaccggaatgacagtctgtcagcatggaggtgaccactgaacctgtggaaggtaaggaaactactagaggaaggacagtgaccagcacttgtgacacatgctatctcttcccttttttgtacccatagtagacatcactaatcaatggcggcacctttgccctttgagtccagatataaccttgggatcctacttaacaaaggggcctatgcacagttgccataattgatacaatttgccatataaactgaaatgtaacattcctaaaatttttaaaaataaaaaacaaaggtagaaggaagcccaagttttgtcaatgaggctgcatttttaaaatgtaggtaactcttttcttatcacccagtagattctttaatggcaaaaaggccaggcttgcttaactactgtagttctctgtcaaatcactacactcatttatttggtaactattgaacacctgctttgtgacagcaacatacatgctaattggtagctgtcccattattttggcagttctcagttctgagccttgggacagggaagcctggaccatcttgctccagatttcagtaaattgggtccccgggatttaaagaggagatgaggatccccagatacgcttggaggtataaaggtatctccaagccacagttttcccgagacagtccttaagcgccgtgcccctcaattttcccagctgcgaaatgggcagctgctgaaaaagagaccctgcagcattgtcatgaggttcagatgagagagataagtgcctgggtcatagaagatgctctggaaatggcagcagatattgtcattatgctgatgttgctattgtcgtcattattttttgtctcagtgtacacccctgatgcatcggatgggagcaccttgctctccattcttagaaactgtgctcatgcacttgagcttgcctccaaagtctagagcctcaaggtcggcctgattattgacacgtttgactacctagctccaagcagggagagccctccaggccctcagtggtggtgttctcttgaagcctgtgcctcaaaaacactggtgaggaaaagcagctgtgactgcaggctgagaaccaaatacccaggtctggattaggtgtgtcacttacagttgctgctctgagatcagacccaggctcaaatcttggcctcaccacttaccaaccacacacctgtgagtcactgcagctcttgcgtgctcagtgtcctcatttgcatcacagggatggcattccgtgcctgcgattcactatgggtcttaacaaatctattccttctcttcccctcccacttcagtggtagcttcgcgaatcacgaccaagtcataccaggccctgttaagattcccatgtaacaacaactttctatgaaacaagaatttcacatacaacttctggggccaacagggctccagaatttactccctgcaatatccatgaactccagttttaaaactccaacccatgaaaagtaatttctaaagggaacaatgtgaaatacccaagagaaatgaaaacacacatccacagagaaaccatgaacatgaatattaatagcaacattacgataatagctaaaaagtgggaacaacccgaacgcccatccactaatgaattcataaacaaaatgggcctgtccatacaatagaatattatttggccataaaaatgaacgaagcactgtgagatgacgtatttttgttgctgaagccacctggcttgtggaactttgttccggcagccatggaaaatgaaggcagatggtgactgctgatggatatggaatttttctttggggtgatgaaaatgttctaaaatcaattatggtgatggtgatggttggacaactctgtaaatatgctaaaaacaattgaattgtacactttaaataggtggattgtgcactatgtgaattatatctcagaaagctgttacaaaaacaaaaacaaaaacaaaaagtgtcccacactatagccagaataatcttatcaagtcaaccgcctggttaaatcaccaccgcagggatccttttcctctcaggagaccaatctgagcctgtccatagatctgtaagacaagtaccatctgacccatctccatccagcccctgctcacaccacgtgtccctctgtctcggccctccagcccgggggtttccatcttcacccatgcccatcccagggcctttgcacatgctattcatgacctggagtattttttcaccttgctccatcctattgtcctcattacctcttaacctcccgtcagattttagctcaaccatcagtctcttgagaagcttcctggtctctgagagacggtcaagtccttcatggaggtgctttcattgcacccgaacctcttcagctatcatttcaccattagaatttagcataaacttatatgattaatatctgcctcccacactgggctatagtttgtgtaagagcaaggtccaggactatttcactcacctttgtacccccagaaactagcacatagtactctttattgtatttttttaattgatgtaaaattcacataacataaaattaaccacgttaaagtgaacaattcagtggcgtttagtacgttaattgatgtaaaattcacataacatgaaactaaccatgttaaagtgacaagttgagtggcatttagtactttcacgatgttgtgcatccaccacctccagctggtcttaaaatatctttatcatcccaaaaggaaactccagagccattaagtagcctctcccacttcttcctccctgaccccagtccctggctaaaaacaacctcctttctgtctctatggatttatccattctggaccttccatataaatgaactcattcaatctgtgacattttcgtgtctggagtttttcacttagcataatgttttcaaggttcttccatgttgtagcatgcatcagtatttcatccctttttatggctgaataatattttcttgtatgggtggagcacattttgtttatccattcgtctgtttatggacatttggcactgtttctaccttctggctaatgtgctgttctatgaacgtgtgcatacatgtatttctttgagtgcctgtttctaattctttggggtatatatctagaagtagtagctctatgtttaactttttgaggaaccatcatactagcaccatatgtggtattacacatagcagtgataccattttatattctaaccaacagtacacaagaattccagtttctccacatccctcccagcccttgctattttctgttgttgctgttttttatgctagccattctagtgtctatgaggtgccatctcatagttttgacttacatttatgtcatgattagtgatactgaacattttttcatgtgttcattggccatttgtatatcttctttggagaaatgttgattcaagtattttgcctacattttaactatgttgtagagttataaatgttgcctacatcttctggatagtagacccttatcagatgtatgatttgctgaatatttttattccattctgtaagttgtcttttcactttctttataatgtccacttcattgtatttttaaccaactaaataactaataagtccagtgacaggcatttagatgacatttgtgggcaaaacaatcaaggactcccatatgcaattactaatttatagctccctggatacctgggggtcaggaatcagtctgttgattggctgcgggctttcacttccatccaagcatcaggtcacatggtgccgtcatagctgcagactcacttgtgaataatggatgtcttcatataggaagggttaaacagcccctgtcctactgtgtccactgaccaagtccccttcatgatttatggatgatcacattgaaggaagaagagaggaataggagaagatgaggtttcccagcacgtccttttcaggacctccatgtcacgcctcactgccaattaacatttacttgaattcttggttccctccccagcagctgttgggtccagctctctggggatgtctgagatataaatgctcagacctgcacactgacatttaaagagccagtgaggggtctgcattctttatttaacaccttctttctgttgcaatatgaggtcctcccagatgcccctatgggaattactaatggccatcacatcttggttcagggaatggttgtctgcttttaagcaaagcctgagactcatgggtttgtactgcttcccagagggctgaggaggagaaaggggtaggaaggccacatccgtcaccctgtgatggatgcaccttgtgatacatccccctcgaaatcacgtagatgcatccaaaagcccttaaccattatattttgctctgataataaagcttagtcttttatgaccactaaataatacgtgtttactgtaaggaaaggacacaaaggataaaatgaacattgcataactacatcacccagagataattgctgttaatatcttgctgtatataattctcctgctctatttatatattgtaatacataaataccttttccacaaaaatgagagttcactattcatacagttgcataacctgcctttgcttctcaacaatataatagaaacattttccatgtcattaaatattcccctactaagcatttatttttaatgtgggtgcctctggcttaaacagcagcaatcttcagtgctgcaaagagctatgcttggtggatttgaatacattcttctgctcagagtattatgagtttgtttaaatggtacccgggtgaaaatatatcgctggctagccattcctggagcaggaagagtgtctagtcattcttgacttgctcaaatcctgtaaaattaaccatttctcacagccgcgggctacttttctggatgggaaaatttgctgggacttaaggttccagggcacagaccgggcggtcaatccctggcagatctgtagctctgttaaaggagacagggctggttaaaatttaaataaccctggaaggtcccaggctgaaatatgctacagggagacacaaataagagagacgcacaaatgtcatgagtgttcaaaagcagaagaggtcacattccacaggaagcaaaaggggaggagaagcctgagctgacccttcaagggcaggtccagtttggagaggtactaagggcagtaaatattcattcaggcattgactccactgatgtttaatgagcatctattaatactgcatgcccagcagtgcccttgctgtcaaggatatgacaatgaacatacatagatggtctccaacttcaaacaccttacagattggcacaattcagagcaatagttagcacaataggagagactactggatacagtaatattaataactgctcaataaatgtccactattcggtgtcctatgtgtatcatttcattagtgctcacaacaatgcggtgaggcagattctattattctccctatttgcaaactgaggcttagtgaggttaacgtacctaaagtcctatgtgcaggtagttagtagcggagtcaatctttgaacactttccgcctactgagtgtctgttcctgttatgaaaagcattttgcacatttcctcttatttaatccttctgacaaccttgcaaaggcaatgataaaattcccatgtttaaagacagtgttataaacacagagaaagttgtcatttgtccaggcccacagtaagaagtggagcagggctgtacctactgtggcctgaggaccactccatgcccactctacctcactgttaccacctcagtgaggcagagatcctggctggactaggggagagtgaatcaccccagggagagccatcctaaggctgacttcctacactgtcattgtgttagttctcatattcctataaagaaatacctgagactgggcaatatataaagaaaagaggtttaattggctcacagttccacaggctgtacgggaagcatggctagggaggcctcaggaaacttacaattatggcagaaggtgaaggggaagtaggtatgtcttacattgctggagaaggaggaagagagagaagggggaggcactacacacttttaaacaaccagatctcacaagaactcactatcatgagaccagcaagggggaaatccacccccttgatccagtcacctcccaccaggttcctcctcccacattggggattacaattcagcatgagatttgggcggtgacccaaatccaaaccgtatcaatcatttatttcattcacaagtgcgtattcagcacctgtcatccctggagctgtactgatgtgaatggagtcacagcccttgataggctcacaggacacaggaagccaaatgtgccattgtgataagtcagatattatgttaaatgtaggcatgggtataacacagtgtgggggcagaaaactggactcccagttagacagggacaaattagggcaggcttcacaggggagtaacatttgagctgacacttaaactatgagcatgtgcttacctgggagacacctggacggaggctgtcccaggcaaagggaatggcgttttcaaaggctcagaagtagagagagcatggcatgtttggctaactacggccaggaattaagtactgctgatagataatggatgaggggaggagtgggaggaaatgcaggcagagggggacagatctccaagggcctatggtgctgtccacagagtttaaatgttatcctggtagcaacagggagtcatgcaaggttgtagagaagtgtagcagagtgattggcattgagtgtcagcaagatcattttaataaatatgtgcgtgaggtgatgctatggaaccactggggctattttttgtggcctgacttacaggagaggtagtgagaatagaaagaagacaggtgtgagcaaattaaggaggtagaattgatcaacttagtaattgattaaattggtccaggaaggtccaaaatctaagactctaagatcaaggtaactcagcacccagttttcatttctgttcatttctctctctctctctctctctctctctctctctctctctctctctctctctctctctctaagtcaggtcagggtctccatctgccacccaggctatagtgcagtggtatgatctgagtttactgcagcctcaaactcctgagctcaagcaatcctcccaccttagccttccaagtagctgagactacaggcatgcgctaccatgccctggcttatttttatatttctttgtagagacagggttttgctgtgttgcctaggttggtcttgaactcctgagctcaggtgattctgcccgcctcccaaagtgctggtattacaggcctgcaccaccacacccagcctgttcatttctagtaagtccattattttacttcttttatttgttcttattaaagtttccatgctgttggagttaattgtaagtagaaagttgagaacggccaaatgtttggttggttgctgagcagaagagcaatacttagcatctttgttacataacagatctctatttgtgggagttaatatttataaaagaaagaaagatgcattacccatagatggtgccatttattctgtttatttttaaaatgcttttatgttgttaaaatcctagcctttggttttgcatctataatgaaagttgggcagattgtatttcagctggcatggaaggagaagatcttttctcttttacaaaaatcattactgcatttgttcattgatccaacaaatgcacgtgggcatttggaaagcaggtatggtctctgcccttccgaagctgacagttgagtcatttatccctgagtacagcctcagtatttacccctgttttaaacagctactcttccttaaacattgatagaatgtcagaaattagtcatcaagaaccaagggtgactttcagtggttatttaatatttcagacttaaatattcttcccacatgctcctgcctcaagacttttgcacttgctacctcctttttctgaaagtttctcctccaaaatatccacatctcctccttattcctttcatgactttattccagtgaagtcttctcaggccaccctatttaaaacagagccttggccaggcacagtggctcacacctgtaatcccagcactttgggaggccaaggcagtgggttgtttgagtccacgagtttgagaccagcctagtcaacgtggtgaaatcccgtctctacaacaaaatgcaaaaattatccaggcgtaggggtatgcccttgtagtcccagctgctagggagactgaggtgggaggatcacttgagcccaggagttcaaggctgcaatgagccaaaatcatgctattgcactccagcctgggtaacagagcaagaccctgtctcaataaataaataaataaataataaaagaaaactgagtctccaccctagaactttctccctttttatttcatctcctccttagcacataccactgttgatcttctttacaatcattctgctcatccagaatgcaggctctaggatgagggcatctttgtgaccttgtctatggctctgtccacactggctaaaagattgcctggtcctgggtgggtgaatgtttgtggaattaatggatgacccctctctgagccttgagtttctctcctgaacacagggttgtcaggggggtggttagtagggtgtaagggaaaaagagtagcagggtcccaggatccttggctctgtgagggctgctcccagcattttaggctgatcagactacttctgcagggcaatgctgggctggagttggtcttgctttacgcagatgtttctgggttacacaacacttggcttaatccttttttttttccatcaggcccataagacaatttaaaggaatgaaaaaatatgtatgttttaagggtctagacctaatgctagcagcatccctttggagaggttttttttgtttgttttgaggggtcttttgtttgttgagacactgtgcctttcaaaatttaaggtactgccttgttatgcaaatcacacatgtttctagtagaaaaaaaagtaaaagatgtagagaaagcaaagcaggcttcccatggagggataaatggatccttcccagcccacccactgttctgaggctgctgcccataagggttgttaggacacacaggagcctgagtggccaggtctctcaggagtggagacattcacttcccagccgtgggacatttacccaaaccactgcaaagagccacaaatagcataagaccgtgtgctgacggccagtggaaatggagctcagcgttgacagagcttcctgaagactgagctctcttgaaaatgtaaaattgctgaggaccttaagcagagtccgatcaaccgtgttggcccagttggactttcagcctgaactctaagaagcatggtccatccactgagcagaatggccattggtggagtttgcacttaaccatgtttgttaacttcctagggatcctgaaacaaatcaccaccaactagagggcaaacaacaactgaaatttattcagtttattgacaatcctagagccctgaagtccaaaatcaaagtgttggtaggccttgctgtctctcgtggtcccagggaggatcccatctgcttctgccagcatctagaggccccagttccttagtttccagctgcaaagctccagtctctgcttccaccttcaggggcccttctccctgtgtcttctcatcttctgtctcctataaggatacttgtagatttagggcacacccagctaatccaaaatcatctcgtctccagatctttaacttaattacatctgcagagacccatttttccaaataagatcacattcgcaggtactgggggttaggagttggatgtatattttgggcgaccaccattcaacacatacaagcccgtggagatagcactcacttcactttgaggagctatcattcttagttcctttgattttaaagctcatatctctgtccaggatttattgcacatctattctgtagttttaactgtaatagcttccacttgctgattttgttctgtgcaccaggtcacatggtcaacgatgtatagggattatcccattttatcctcataatagtgatggagggaaggtaagattgctttattttgcagaaccaggatgtgtgggcatcaaagagtgtgatttggtggctcacgcctataatcccagcactttgggaggccaaggtgggcagatcacctgaggtcaggagtttgagaccagcctcgtcaacatggtgaaactccatctctactaaaaatactaaaaagaaaaaaaaaagccgggcatggtggcatgagcctctagacctagctactccagaagctgaggcagaagaatcacttgagcccacgagggagaggttgcagtgagctgagatcgcaccacagcactccagcctggatgacagagcaagactctgtctcaaagaaataaataaataaacaaaaatttaaaaaagcagagctgagatttgtatccttattttggcttaaagtccttgctgttttcactatgccataagtgagcaaaagcagagagttaaagcatggtttctggctgggcgcggtggctcacgcctgtaatcccagcactttgggaggccaagatgggcggatcacgaggtcaggagatcaagaccatcttggctaacatggtgaaaccccatctctactaaaaatacaaaaaaaattagccgggcatagtgacaggtgcctgtagtcccaaactaaggaggctgaggcaggagaatggcgtgaacccaggaggcggagcttgcagtgagctgagatcgtgccactgcactccagcccgggcaatagagcaagactgcatctcaaaaatttttaaaaaatgcatggtttttgcttccaagcacctcataagcagagaggaagggacagagaactatctatggtttattgggacacgatgtaatatatgctacaagggaactgtgtcaagagctctgcagtctttctaccctggaaattttagtaaaggcttcaaagagaaagtgacccctgaggcggtcatttgggaacagcaggacttggctgcgtctgaatgtagagaattgcattctgggcaaagggaacagcatctgtgaagaaaggcaaaagtgagtggaccacccacatgatccctcgatagtgtccaggagcttctgtaggatgtagtgttatgatgctgagacactgtattaggctattcttgcattactacaaagaaatacctgagactgggtaatttataaagaaaacaggtttaattggcccatggttctgcaggttgtacaggaagcatggtgccaggcatctgcattgcttctgatgaggcctcagaaagcttacaatcacggcagagggcaaagcgggagtgggcacgtcacatggcaaaaacagaagcaagagatagggggaggtgccaaatttaaacaaccaggtcttaggagaactcactcactactgtgggggtggcaccaatgaaagctctgccccaagatccaaacacctcccaccaggccccacctccaacactgggggttacaattcaacatgagatttggtggggacacatatccaaaccgtatcagatgctcccgagccatgacttagatttgaattgctgcagacacgtgtctctggtggcttcctgtgtgccataccctaagctggcgtgggtggccttcccttcctgaacagcgtgatgctggtaacctgggacctccttccaccttcctgcactctataactacttcccagatcactccgaatttatatttgccatctcaggatatggcaaagtaagacacaacagtaacccaaactaaggcaagggcagtggggatgaggaggttggagtcgtgtgagagtctgtttggagaaggaaatcagtgatactctgttcagtgggtgtgggagaggaggcttgacacgagggggccccagttttgatgcatctaccagaacagggaaggactgtgcttggctggggagctgctgagcttgctttgggccatgctgtgtttgcagtgctcgtgacacattcagctggaaatgttgaacaagcagttagaagtgtagatctgggaattaggagacagttggtaatggaagctgtcagagtccacaggggtgggtggaaccaaagctggaggaataagcaggatatccaagaagaaggctgaccattagagactcggtggagattgcttaaagagctgccaggagtggcaacctaccaaaaaaaaaacttatcattctcccagcccaacccatacagggctcgtggaaagagctgggaaatgggctcccacgtggaatctttggactagtaccaacaggggttttggctactggggaggtgaagaatagtactgtgtatgccccagggtgtagcagttgagagtataaggtacagacccaagaggttgggtttctatcccagtgccaccacataggagctatgtgtcccaggacaaaagaatcctcaactgcacaatgaacacagcaaccacagcaacttcacaggggtatgttgaagaccaactaaggtaacccacctaaagggttgaatactatttccaacatgtagtaagtgctctgtgcacgtagccatgattattataatgacagcgtgtctgagtggagcccggatgaactggcaagcgatgaccacctgtggactgcagcgggaaggtccgcagcctggggctagaaccacaagggagcgtgatgcacacaggtgtgcttgcacccacggctgaggtttttcttcccaccggcacagggcgctgaggcagggatttcctcccagagagagggcggttgagttcagttcccctccactttgaaaatggctctggaggaggggcggaggaaaggcagagactccgtttattgttatttttaaaaataaaatgaaaaggagccctccaagggcttgtttatgggttttattattggcgaagaagagcacacttgtctttatcaacatcctgtctgtctgggagtctgagccgagaagggcaagaccaaatgttaagtcgtaacatctgacttgttgttccttgctctgctaacgatccaggctgttaagaggcttagcccttgtcagcagagccaatacaatttcaagaacaaaatgactgctggagcccagatcagaaaagggctgcctcgtgggagcaggtcagggcagtctattaggcatcttgtgcaaataatgctgaagaaaggtggtcagagaagctgactgtaccaggcataaaatcacggggggagccttccagaataatctgtggccgggttatgctcactgctttttctccctggtccacgaattagcttttggacaacagctgtggtgtaactggaatccatcttgtgtgattttttttccctcagatgatttagaattagttcaatttattttcaaaaagtataacccaatgacagcagaaaggccatgtctcaaattgctttcctgtccatggctagagtgggtgggtgtcatttgctgatttattactctctccgtgggctcctttcgtttctaaagccacctggaattatggccagcaatagaactctaaaccaaagtcagctttgcacgaaaatgcatttgacttaagagaccacggaaaatgctgattaaaagtaaccctgcatggcaaaatttgattaggagatcacatctgaatgggaacaggttcgagggaacggaggatgaatcaggctcagcaaagccaactttgattgcgcttttctaaggggaggatgtggtgctgattaaacgtctgaaattagtgggcagggaccattaacatgcaaaggactgatattaggcaaaggttgtaaagctggaatggctgcaagtcgtagacatttaaaacctagttttagaaacatccaccgacccctcggtgagctcctgtgcttctgtcactgggagtcagtaattgaattttctggacgttttgaccagtatgtaactgtgtggagccgattacacagcagaacgcaatttttagcctgaccttaaaagcattaccttctgctgcgtgattagaaaacatacagagagtgccgcccttctaactgcacttgatttggggaagaagaaagaaaaagaatcaccttgctattttatgaaacctggtaagattcatttagattccacacagatcatttaataacagattttgtaaaatcttaacatacggagccaccataaaacgtattatcttttattacccatacagagaatgacattttagatggtaataaattgaaacccaaggaaagctatttgctttcggagagtgcttggcgaatgacaggaatagcagtttcccaattttacacggtggcaaatatggccccccagggtcattggagccagcccccagctggctttgttgagatttatctgagcaacattctcttatacctcttttttttttttttgaaagatcatttccgtccaaacctcaccacatgaggacccagttgtcataccataacatccctccttccatcccgtacacctggagatgtgtggctggcctagggctgagcctggggctgggaccagccagtggggcatctgcctcaaggtggaaaagagcccagcccatcagctccaaagcagccacagcctccctctgcatagacacctctccaaaggagaaggaccttccctgcacactcttggacagccaaagcctcatcaccctgccacgccccgcaaaaccaggctttctagagactgattcagcctgtctaacattgcccatgcctgcctttggacctgtaacatctgcagaccatgagagcaacctgaggccaaatttgctgtgtggtgatcaacataaccgtttcttgatttactcattcattgaacatttactgagagtgactgagagtgaactagtttgtgtgatttttcccccaggagatttagaataagttcaacttgttttcaaagactataacccgatgaccacatacaggcagtgtcttgggacctcagtgtctcaaggggcaaggcactggggctatggcaggaataagttaaagacagaatccttgccctcaccaagggctgtaataaatacttagaaagtgactgacacattggaaaccacaggcaccaaagggaagcttctccggtacttgatatttaccactttgtagatggcaggacattcatcttcccactagacagattttgaaggaaaaggtctggttgacatcacacttcaaaggattgaaatggaaatattttccagagaaatgacagaggatgtcatcctgggaaggcaggccccctgggaagctggcaggtgggcgaggaatgaggtgcggctggtgaggccacgcaccacgtggagccaggaggctgctgggcgtctcagtgttccaggaaactcagcggtcaccccccagagaaggtgtactcgtttcctgtggcttccataacaaatgaccacaaaatccgtggcagacagcagcacaatatattatcctacagagctagaagtcagaagtccaaaataagtctcactgggccaaaaccgaggtgtcagcaggtctggattatttgtgagggctccaagggagaatccattttcttgctttttctatcttctaaaggcccctggaattccttggctcatagcctcttcctccatcttaaggccaacagtgtaatgtctctcctcgtctccctgtctccccatccccctccctcttctctctctttccccttattctttctccctttcccccccccggacccctctccctcccttcttcccctctccccctccctctttctctctgtctccctccctcctccctcccttgccctctccctctcccccaacaccatcttctctgcttccatcacccatctactcccgctgacactgatgtttctgcctccctctcatgaggactctcgtgatcacattgggcccattcagttttccagggtggtctccccatttcaagatccttaacaaagcctcttgtgccacctaaggtaaaatattcacagattccaggaattagaacatggccatctttgatagatgtttttctgtgtgccatagaagatacgagagcttctagatccaaaagcctggtggcatttagagctcacttccactgtgctcgatacatgaacctgacattgagcatctcacagcataatcacaggacggacgtgtgaagggaaaattgctatacagtgtcattatctcaaccaagagagaaacactcaccgtgccatacagccagggctaatgcagggaaggcaggagtgactctgggaagacaaaccttcatgatggaggcaaccttcaagcaagtgattgtttgattatcacttgcttgaagtgattatcttccaaaggataagtgattgtttcctggggcttaggaggtgggggcgggaaatgtgcagggagggcagagggtacagcataagccaagctgcagagatgcggaggagtgaaaaagcctaagaaggtatgaattacaaatagctcagctttacagaatataacactgagtgaggagaacaaacagatgaggccatgaagagtttgtctttcatgcttgaaaaactcagacattatcctgtagccactgaagggttttaaggagagtccttggtcagatggtagctggacagttcgctctggctggctttggggtggagaggggcatagaagaaggcagggggaccaacctggaagctgttgcataagtcaaggaagaagagatggggacttgacatcatgtgcacacagaggtggtggagaaaagaggacagactcgagaggaaggggaggtaaaatcaggagcactggatgagcagttgtttgaggtaagagagagggaattgctacagagactcccaggggccggctggagatgatccctccgggaagaacggccaggttgtggggaagatgggttctgatattggcccatggaggataagggagagcatctagtggagacatccataacaagattgaaagcaggcgagatgctgtttggtgtcttagagagagtctgttttttctcgaaatggacgtaaaaaaaaagaaagtttcaaagagaacttttggaaaactatgattttcatttttcatttaaattgcatcataaatgggtgagttttaaagtaaaacatctaagggtacatcttgacctgcattgagtcatacattcattcagaacaatgctaaccgaagtgtgcccctaaatcgacgacatcagcgtctccaagaaacttgtgagaaattcagatgctttggccctgccctgaaccttctgaatcataaatgctgcaggtgggctgtcaatctgtgttttagtacacccaccaggggattcttttttttttttttttttttttttgagagggagtttcgctctcgttgcccaggctggagtgcagtggcgtgatcttagcacaccgcaatctccaccttctggtttcaagtgatcctcctgcctcagcctcccgagtagttgggattacaggcacctgccaccacacccagctaatttttgtatgtttagtagagatgggggttcaccaggttggccatgctggtcttgaactcctgacttcatgatccacctgcctcttcctcccaaagtgctgggattacaggcatgagccaccgcacccagctggacaagcactttcaagaagcagtgactctgactctatgtcttacgtacctgctatgtaccaggcataatgttgctatgtcagggcccaggtctagaaaacaaaagctaatgtggcaaatagtacttgagcatctcaattactttttattttacttcagtgttacaatctgtacttccttgtctgaatctaacagattagcctgttctgttctgctcctaaccagccatgtgctcctgggattcactctgtttcctctcactgtgagttccttgaaggtagggcaggacgagaaggcctcgaaggtacttttgagaacttgtgtctcttcacctcacaaaccttgactccaggcacgctggtggccctgttgcagcctgatgtctccactcttattcccaggcccttcttccttctctgaattctctcccctcacacccatccttcaaagctcagctgcagtcttacattaacctgaagccactgaaaagccaccgaagcactcccagttagtagacagctaacttagcacaggctgcctgctgccctggggagccacttatatatcttttatcttcacccaagccgtggcttccttgaaggtcgagagcgtactttttcttgtccctttggtgtcctgaacagaaccagaatcagccttcccttcttattcaatgactacttttaatagagtttagggattaaaggtctcccaccttcttccatataatttgactttcagtccaagacaccatctctaatcctatggtagggtatgcccttctgcaggaatcactgcttaatctcttccggcctccacctctccacctataatgtctaagtcaactgtcccctcctttgtaattccacagaactctgtgcttaccccatctcattgtgctgagctcatcagggtgttggtctctcccacgggacttgattcctgttacttcttcgcaccatcccgcacaatgcctagcacacagtaagtgctcaatcaatgtctgatgaattaaataagctccatatagctttcctgagcaccccacattctgacccccttcatgtaaaccttaattggtattaataccattctgataacacttatctcatctgaccttacgtacttgccttttgttcatctctctggaccagaaatgcaccaaaagcagagtctgtatcatttatcacatcctagcagttatttgagcctaatagacactaaataaatgtttcagtgaactcacactgaatgtcaagtatttgccaccttgagcctacaggagatgctttttccaggggttctaggaacgccattggcagtttatttactgtaactcatcagtggcagcagaagatgcacacattgcctggaaatgttttatttgattttggtgtccctcaaccgcaaatctatcatttaggctattccagccacatatgtctaagagacagtgtttatttcccctgctgcttctccaccctgccagctttgtcgcagccagtaaatctggagaaatgagcgctgccttctccttgcccaccagcccccagccacgaatgcaaaaataaataaataaaaaataaaaaacagcaggtgacagccaagaatgtgaatgttcacattcgtaccaagaggtaaggtgaaaagaggcctaaagacaaacacaagtcaaaccaggctcaccctgctgcctgggaagatggaagaacatcgctcgacctctgcagtgggaataaggcacattttatgaggatgtgtaagcggttcctgctggatttatggactacctattcccagtgttatgtggccagagtggttaaatcaaactccagacagacaacaactcgttctgcttcagatagtgttttcaccaatcttttgcaatatttatagactaggtgtcaggtgcagccagcccggggaagaatgtggtccctgtttaggcttcatattgcaaggacgcttgtgatgcccagctgatcgggacaaagctaaagaggaaacgaatgaatgaattccattacatctttgctatgtagctcatgttaatgtttctcattaacgataccttaaatgttagactagaaagggatttgctaacaaaaatgccttcttacagccttccttgactcctagagcagcatgtgtgtgctggagcccattctcactggctcacaatagccaactggtgtctctgtttccaactaagtgcttttggagtggaatcatctgggtagcttgaaatcagctatggtaggagtagttaaaccaccaaaattgacaacagtacaaatcaggagaatctgttcttaaacagctacaggtataccactctattcattattttttatatattatatataattgtatatttatgtaatagtgtataaacatacagtatataaaacatgttatttgtcctgtaataattgtaatcaatattatgcaataatatgtaatcatatttatgtaatagtgggctaattgtgttataatatgactaattgttacatagctatgatgtcccaggcagtgaattttatctcccaggcagagacataaagcctctaaacaagaaaaggcccctgatctcaagaagctcggattgtcatagccacgatagccactaaacaagtaatcagtaaacaagcacattatagactgtggtagtggtaggtgctggggaaaacggtactcattatctattgctgcatgaaaaattgtctcaaaacttagtgacttgagacaagaagcactgattatctcacagtttccctgctcaggaatctgggcatttcttagctatactctgtgcttaatgggcactcacagagctacaagcaatgtgttcagaatctgctgtcttgctggaagatttgtctaaggaaggctccacttccaagttcactcagtggctgttggcagcatggttggcaattgcttttggctcttcctgaaggccaccctcagtttcttgttacatcttcgaaagacttcccaaaaattctactaaataatagcagtagcatctctccagcatttacatatgccaagctctgtattcagcactttacctcttttaattctcacgtatcctataaggattattctcccccactttacagatgaggaaatggaggcagtgagaacataagcaacttggctgggatcactcagctactaagtcatggagccagggtgataataattgatcacatattgattgactccttcttaaatgtcaaccatcctattgtgcaccaaggtccctgccttcgtggagcctctgtgctgtgaataatgaccatcagcaaaggagcaggaattcacctggagcaagaactagaggtgaaacattcgatatggaaaaagtggggtaccatggaaagaaattcggtctagacaaactgtaaagagagatgtagagtgcagttcaagaccaggcgagagagagatggggtactgtgtgggttaatgggaaaacctttttccacatcacatctatttgttgattttccccccacagctaccactatgcttgttattagtgataaatgttctgttaaatgcatacctgtgtggaagtcattgtagctgtgcaaaacgtcgagggtctggtgatggattaagtgccagatttaatgacatggcttgattcttttttcaagatgagatgtttgcttttcaaatcagtgtgatcagtgaacctggcctgtgtctgtggagattcactcgaggctttttcttgcagacataccatcttgcttttgtttctagaatatatattagctggtagctagttgacacccaggaggagacagcaaatgcaatagaaatgcatgactgcagaactcaaaccaggagagcagcttgactctcttagatatgtcttacaaatcagatagcttcaaataaaatcagaggagccaatttaagttttccagttttgacacagtgcatttcttcctccaaataaaattctatctccttgagctgcagttccgcaaagtataagtcattccctgagaataaatgactttgctttggaaatgccactgatatgctcagacctttgagacataatttagttcagggaaacagtaatatatcatcattatcaataatgaaagtaaatcgcccaccttgtgtgctgactactggctaggtgttgcagccaaaggcatggtccttgcccttgaaaactttgtcatccacttagggagatagtaaatgggcattcaaaataaagcaaaatgggacacatagccttcatattaaacaaggtaagctaagcacagtcataagcagcccttaaacctaaaaaatggcttatgtcttgctcacatcacagtctaaagcaggtcaccaaaggggctttgagctatatagtcatttggagatccaggtttcttccttttgaggaaatagaaagtgtgagaggttacatgggaggtttaagaaccacaccaagtacataacttctgctcacgttccactgaccgcaatcagccacacaagtccatttgactgcaaggacgcctgagctgtacagtctagccctatgcccctggaacccaaggaaataggatccagtgaacatacaacattgttttcaccacaagttcctttgcttgcaagtaactgaaactcattcaggctggttttggtacctaaaaggagctcttgagtatacagtggaatgagttacagaatcaacgaaagcgttgaagtcaggggccatcaaagctccagtccttggcagccaagctgcttcttcccggcagagcagcaccttttgcaaaattcagctcaaaagctgtttggagttgcagttgattacattcgtctttcctctgagccttgaaccaaagaaacacagaatcaggtgaggcccagggagaatacaacttgatcttgagaatggggttgaccttgataatggggcccccttctcactgatgagttcactcacctagtgacagggcagctggacaagtgaaagtgaacctggacaagtgaagaggcaggttgccttcctcatgggcagagagaagcacaagggtggtgagtttcctcccaaaacattcaaggcaaaaatccctctattggtcctaggagttcggggtttaccctacattcctgttttcctgactctcagtcccacatttcctcttttcagaatccagttgtcccagcttgaattagggagttacctgtgaatttagtcaattcttggcaagagagacaaacatgacaagtggccactgggatctctttctctgcatcaaaatttcctcctggagaaagggcatctgtgggctggacacctaaagagcatctcttccagcagagtaacaaatgcagagtggccagcgagggatacagaattaaaaatacatgtgtatatttcaagtaagagtgactccgagagctaggaaattagggggtgactttctggaaaaggctctgaggatcgggaagtaggtcagaggcaagtggaaggtattctgatcatgtatgagcaagggagttcatgtggcattttctctaattttcaagtgcaaactgggtgttgtacattccaaaggaggttactttcattatcggttttggggattttgttactgttctccttgtgaaagcaataatgttcattacagaaaaatccccaaatcataacaggccaataaactttttatattagaattgcttttaaaagtgaaaacttgggcagggcacggtgtctcatgcctataatctcagcacttggggagcctgtggtgggaggatcacttgagcccaggagttcaagaccagcctgggcaatacagggagaccctgtctctacaaaaaatacaaaaattagccaggtgtggtggcacatgcctgtggtcttagctacttggggtgctaagttgggaggatctcttgagcctgggaggtcgaggctgcagtgagctgtgatcatgccactgcactccagcctgggtgacagagcaagaccctgactcacacacacacacacacaaaaagtagaaacttagaagcaacccaaatgttcatccagtagggattgactaaataaattatagtggatctgtacattggactattagacagctgttaaaatgaacagctctgtaaacactgagataaaagtgatatggtaaaacaaattgtgtcgctatgtaaacagtattactttgatgaaatgtgtgtgtatataaatgtgtatattaaatatgtgggtatttaaaatgtacctccgtgtgtgtccacttgtataggaaaaaggagataactatcaatatttacctctcacaggtggggttgggcaagggtggaggagagttctttgaaatgactgttttatttttatgttgcttacaataattggatattacttcagtactaaaaatatttttaaggtcagccttaagtttgccagaaaatttagacttttgaaacctcatcacaaactttgcagtttatctacataacagtctaattgattctctactaggttaatcagtctatttctcattataggtgcaaagttttatttacttcaggagatagaaattggttcattttctaaaattatttataaaatttgttgaactacgagagttatgccaatgtatccttcccttgtgctaccgtaagaatttgtacatacctctgctaagctttgatttattttattgcactcatatgtgaatatgactgtcctcaacgctaaactttgacctctttggagaaagagacttgttttttgatcactgtatctctagtatccaacacgacatttagacaagaagttcattaactgccaattaaatagatgcataaactagttaaagaaagaattagaccaggtgcagtggctcatgcctataatcacagcactttgggaggccaaggtgggcaaattgcttgagctaaggagttcaggaccagcctgggcaacatggagagaccctgtctctacaaaattacaaaaattagctgggtgtggtggcgtgtgattatagtcccagctactcaggaggctggagtgagaggattgtttgagccaggaaaatagaggctgcagtgaaccatgaccacatcactgcactccagcctgaacgacagagtgagaccctgtctcaaaataaataaatatttttaaatagataattacagtaactttccctggctacaaaaaattttctgtttaagggaaagtattaaaagagaaaacgatgtattcataaaatgataggaatactgttttgaagaacctattttgatgctattgtatggtgtgatagctcctatgctttcttgctaatcagagaattgatcatagtgttattgcaatagttgcaatattagtcaaaactgccttattcctacctacggaacatctgaatcaagtgtcttgaggaaagccaaaatgtattagctcatagaattcacaaaatctaaggaataaattctggcttcaaggatgacaactcatccttgaatgatgattaacaacaacaacaacaaactccatctctacctcttagtctgtgtttccttcattctcaggttgactttctttgtgtggttacaggtggccactactagctccagatggatgccctaaccacctccaagtttaacagaaagataacttcctttccctaagcgttctgaaagaactaaaggacaatgtcctggaattgaatttcactcccagggtggactcacttaggttatgtcctcatcgcatgatgataggaatggaaagccctgattggccaggcctgaaccatatgaccatccctagatcaggagtggggtcagccccacccacctgaactgtacctgtactgagggtgaggaaggggtgatgcccgagggaattataacataggtaccagaagaagagggagtgggtatcaggacagttaagcagcatactcctgctatagttagtgcttgaggcagtcctgtagcacatccccacagcaatctgtactggaagttgaagaatgaatgctatgagaactttatctccttcttatgccaccatcatagagtcaccctagtctcccaatttgcttcaccgcgcaatgtcaggagctgtcctttagagaccagccctgtctgagatcaaaagctaaacattctcgtaggactggtataaaagttagtaacatcctcttggataaaaacattgaaatatgaataaaaagcctgaaaacattcatactctttatcctagtaattccacatcttgggatctatcagtcaaaaacaaaccaaaaaaatttttaaaaagcagccaaaatgtatataagccttcatgaataaagatgttaattgcactgttatttaaaattgtcaacattttgaaaaccacaaataaccaaaaggcctaataatagaagacaagtaaattataaaatatacatatgattatattgtaggcaacccttaaaataacatctaggaattatattggtaaatattatatgtgaaaaataatatgatatttaccataatctcttcaatattgggggagaatccacataattttttgtcagtaattgtgtgctttcaaaaataagtaacaatgttttatgacaaaagtgaaagcgttatgcaagaaattagacctgtgctgtccagggtagtggttcacatgttcagagacactcgggaaagattttaaaggtagccaatttactggtttcatatggtccagctgcagaaattatagccaatagtacatgcagtccagctcgtcagtgatgacaagcagaaagccacttccattaggctcaagttttccagcttcagcctgagaatagatgggatttcaagcatctataccgagagatgccaacgaaaccagccaggagcaaaattaccagaattcttgaaccaggcagaaccagggcagatggcatctcaagcaccttcgcagaccagcgccggctgacccagccagaactggaactgggtacggtgtcaattccacttgtactcagcagtcagagaaccgtgtgaccttcgatcctggcggagctggaattgaaaccgaaacatgaggcgtagagccatcacaggagcacactaacttcccactcatcaccgtgaattgaagtggagggccttaacaaaccacccagcagaaccaggactccttaaaatagtagctcagaaaccactcagaagttaaaggaacagcaatgaatggtgtccctatgagcagacagccagttgcacttcaaaatacttaaaagtttttgagagagctagcgttgagctattgaaatttaccatgtaaacttaggacttcagaagaaaattggacatcctccattgcttttttgttccttgcttcctgtggtatttcttaattattggttggtataaccagctgtttttgaagctgtcatactggtaggactatttatgtgattgtaaacacctattatttttgttactaaaggtagttcaactcggactctctgtgtgatgattaagaaatctgtccaacgtgagttaagcaaataagggaaattattgccttcattagctgaaaagttcacaggcgggtctggcttcaggagtggcatgatgaagcggctccagtacaaccactaagaaccatttcttttctgagattccagtataattaattctcttaggatattgcctttgttcttggatgcagggtcttcttctgcattacccctcctgtggtcatgagatgactcctctagctccccctgccaaatgcttccaggtccacaccacagggaaacagaacttccttcacctaactgtcaaacacagggcctggacttaacattatatcactggaataagatgcactgactgacttcttctaattaggactcattccaaaagttcaatcggtaggagatagagaaaggcaatcctaacccaaaccacatgagcagagaagaagtaaaggataggtccccaaaggaaatgcggggtgctgccttaccagatgaatggtatgattgtggaccaattcaagcagaaacctactaccaaagataatttaaatataggggctgttatttaccaatgactgcactcttcttcatcttaggatcagggctatttggctagttgttttgagtatataaacatgatagccaaatctttgtcaaatattgagatgaaaaacacttatgtgaagagagagaatagtgcaatattgcttgtgttaagtttatcaaatcattattggattaaatgcgtcttccacatgtgacagcctgtgcgacaaaaaagacatgaaagaagtgtggtataagtgactctaaacttcagtggggtttcttccccatctgtaaaatgggaacaatgattgcaagttgagctgcttgttgaaaagattaacaaggatttctataaagtgaggtaatgcaatgcctgcctcatcagattttcagtaaatgtgagttcctaaagctgccatctttgtcctaagctcatcatcaaaggtaacctcattttcagatcagcttcctgaggtctctgaaatagcagatatggatgtaaacattaaaggacaacgtaggggccgggcgtggtggctcacacctgtaatcccagcactttgggaggctgaggcaggcagatcacgaggtcaggagttcaagaccagcctgaccagcatggtgataccctgtccctactaaaagtacaaatattagccaggcatggtgatgggcgcctgtaatcccagctactcaggaggctgaggcaggagaatcgctggaacccgggaggcggaggttgcagtgagccgagattgcgccactgtactctagagagtgagactctgtctcaaaaaaaaaaaaaaagaacaacaacaaaaaaaaaaaaaaaaaaaaaaaaaaaaaaaaaaaacccaaaggacaatgtatacccaagcccaggaaatggaacattctgtgatatatcaaatgtctccctaaaaaagaacagtaaatatattgtccccatggcaaactccagtctttgaatagtgactgtcttatattgaagagattccaaaggcacatttatacacaataggtaaaaatgttatcactctttaaagatgcctaccctagatggaggagggggagagacagctccagcaacacgcctgccacctttccaaagcagtaacccaaatctaaatgtcatattatttctttgtgcttgtgctttgtagactctggaaaatcccaagtatgaactgatcatcgaggctcaagatatggctggactggatgttggattaacaggcacggccacagccacgatcatgatcgatgacaaaaatgatcactcaccaaaattcaccaagaaagaggtaaacccctgtgccaaacaccaaccaccactgtggtcacagctacaattactgattgatgttaattcacgtaccacagcacctgctggcccccctttcaaaatcaaaatactcctttgtgggagagacgatggtgttttgctggaattctttctcacatttttattttgtgtttgtgtgtgaggctaaaatactagagcacggtgagaacaagagcactgaatcttgttaaagtccataagaaaataacttttaatgcccaagtgccattttcatagttttattgctgttatttagcagtgagttatgagagtcccactgtgattttagcataacaataactatttttttccagcaagtgcagattgagaggccagacggaacagtagcaaggaggtaaagcagatttcctagtccataacaatgtggcccaggagcttataaataacaacaaagttagctcatccaggagagccattattcattctcagtccctgtgcttttatgattatggatcatggttgttgtttcccatttattccaagggagcgatgtttggggaagggctgagtacacaagatcacattcagttgctaaatttgtacccaaaccaggaagccatttgcactaagcacattctgatggaaatgtgctaagattgtggcttctttaggggcctgggccagggcatggatttgatgcccttcttactgaccaagtgaagaatatggaataggtacgatggcccctgacttttgcagagtctttactgtatctaccatggtgtctccccctgagatctgttgcctgatttgactgtgtgagcctggctttaccattttacaaatgagcttactgtgatgctcagagaatccagagaacaagctccaaggtcatggacagaaaaagtggcagaaacaggaagtgaaccaggttcctgtgattcaaaagctgcagtcctaactgtgatgctgtgctttcctcatctgccatcaatgcttccaacctccagggtgtttggagaaaaaaacctatatagggacctgcagttgccccactgctctctggaggaatctcaaggctacccagggtggcttgagacagatggatcctctcaacccccgagttccccaatggcctctgtattagttcattctcacactgctataaagaactacctaagactgggtaatttacaaagaaaagaggtttaattggctcatgattctgcaagctgtacagggatcctggctggggagacctcaggaaacattcagtcatggcagaaggcaaaagaggaagccagcacatcttcacatggaagagtaggagagagagagcaaaggggaaggtgccacacacttttaagcaaccagatctcatgagaattttatcatgagacagcactaggggggtgggtgctaaactattagaaagcactcccgtgatccagtcacctcccaccaggccccaactacaacactgggaattataattcaacatgagatttgggtggggatgcagaaccaagccacatcagcctcttcacctcggcatccccctgcatggctcactcaggaggtagacgtccccctttctccctgtggtgtcttgggcactcaggattccaacctcaaaacagcaaagtccacgggagcttgatttgctccattctctgacttcccatggcagggttcctctagctgctaatacagactgctcactcttgccatggttccaaactggcatttcaagaacaccagttctaattagttccaaacaattctaattcacttccaagaaattagtcacaaaaattacaccaccggggtggggataggaatgaaaaaaatatacttcagggtcaagtagatgtgggaaacactgaattgattacttttaaatggtttatttaactgcaggatttctgattaactttaaaatgctttgtgtttctctaacagggttaggtatggtctgtggggtttctcattcttctttggcctgggggcttttttttctaggctaccttatatggcttatggagctggtgtttcatggaatgttcactgggggatttttgtttatctttataatttcttttcaacctatttcaaaataaaaactcagagcacattgtaatattcaatataaacttaacgatgggaacaaaaataggataaccccaacccaaaatatgaagatgaatctgtgttaccagctgtgtgagattaattagttacttcaatgccactgtgaatttgggtcctgtgacttaggaaaaaaagaaatctttgctcagttgtggactaaacactgtgaatgacagactattgtttttaatgtcattgaatccaaggaataatttaacatggactctaaaggttagctaccattccacaatatcatattgatttcaaaatatcatattgtaaacactaaaagcatacaatgttatctgtcaatcttaaaaaataaattttgaaaaaagagacactgagtagcataaggaaaatgtatctgcctgtaaataccagcaaaagcacacacattttcttcaaatggagattagacaatgagtttgagattcccaaaaggcagagctgatacctaaactcataaagagagataagtaatcagatgaaaggaagtgataacaagtacactagactctcatttggatattaaatgtcccaaaggagtctttgcccaatgtttgataatttaaattcatgattaaactttctgtcgtgttcctgaaaggctgatgttctttgttgaaggggattcatacactttggatagtaacactgctgggggtaatgtgattgagaagtaaggagggggcgctggagccggaattgggttcacatcccactgaccagccatgtggtgggagcatgttaagtgctctacatcccagtctcttcacctgttaacgggctgatcgcagagcccacctcattaggtcattgtgaatgagctaatgactaaaagaacctagatagtgcctgtcgcccagtattttctaaagtatagagatgaggacagtggtgatgacaccgctgatgaggatggtgggaggaaggccatgatgaagaagaagattgtgatgagaaagatattattatgacagtgatgtttccaaaatgtcagaggccaaattgacattcttatcgaaagggccacctcccctccaggttaaaaggctactcttttcctttaaagtgacatatgaatctgctcaagcacttcaaaatacatggttaggaccctagagttctaggggagaagcaattctgcaggagaggtggcagaatctgtaaaatgcatcactatgagatcaggcctcgggacaaaagcgagagagaccaagagaaacctgctggggagaggagagctcctaatgaggactggctcagatgcagtggcctctaggatatggaagaggtaggaaaacaggatgccctagaaacagagaggaaagatggggcttatgatcttgaagttgaaacaaattttagagatgaaaatcaaggtttagtcattccaaaatagaaatggtgatcatttggagttgaggatgtccagaaagctctctaaggagatgttgtcctaagtaaattttttcatatcttaggacatttcgaagttgataagaatacatggtttttgggaatatatgaggtttttaaattctatcttacatgactttccctctccggagagatgtatccttttatctgtttttgaaatctatataaaagaggagttatgattgatcacaaataatagagactagaaataacactgttgaacaaaatagaggtagtttctctcacttaaaagtttggaagtgaaggctgggagtggtggctcgtgtctgtaatcccaacactttgggtggcggaagtgggaggattgcttgagcccaggagttcaagaccagtctgggaaacatggtgaaactctgtcgctacaaaaaaaaatacaaaaattatccaggcatgtagtcccagctacctgggaggctgcggtaggaggatcatttgagcctggaaggtcaagacagcagtgagtcatgatcacaccactgcactccagcctgggtgacagaatgagacccagtttcaaaaaaaaaaaaaaagtttgcaggtagacagacccaggccagtttggtaatgacatgatatcaatttcccaggttccccttagctttctgctccgccgccctcacggctgccttgtggtacaatagggtcactgcagcaccaggtataacagccagtaacaggaagtaagaagcagggaatgagaagaacaaaggagaaccggccacctgagtaaatgtcacttgaaaacttccccagaagactaagtgacttctgcttgcatctctgtagcctcccttacctgtaagggaggctgagaaataactacagttgtcttcagttggtatgttgcatttatagtgtttgtttaaggaaggagatactttaaaggttacttttaaaagtaaattcttattgcaaagtaagctcatccaggcacggtggctcacacctgtaatcccagcactccgggaggccgaggtgggtggatcccctgaggtcaggagttcgagaccaacctgaccaatatggtgaaaccctgtctctactaaaaatacagaaagattagctgggcatggtggcacatgcctgtaatcctagctacttgggaggcttaggcaggagaattgcttgaaccagggagtcagaggttgcagtgagctgagatcacaccagtgcactccagcctggtgacagagcaagactcggtctcaaaaaaaaaagaaaaacatgtaagctcaattctttagtcctctcgtgttcatttacaatgactatacacttgctgagaagcaacagccacatctctcctatcctctgttgtatcccggcaggcactcaataacagagcatttgctgaacgcttcctgaagataattttaacttcagaacagcttcactgcatacgatgaacgaagattgtacttaaaattgccgctgatacatgaaatcaattttcagtcattgatgttcatgcaaatttaggttggaaacgctagtttttctctgtggagagttttctataagttttcctaatagcttgtacgtatgacttcaactaactgttagttttgaacttcttacataaggtattttgaaatgatctgagaaaatctagttaaactcttcaaatacagactttgaaatatacatgaaaacttcagcagccccatttgtggctttttcattcttgtctcttaggttattttattaaaaaaaagatttctgatttgtagctagaacatggttgatgcccaacaaatactgattgaataagtcatattttcacataaatctcaggtcatggggattaataaactcgctattaattaaagaatgtgtttgcaagtgattataaaatttaaaaaaaacagaaaatttcaaatttcattttccagttctaccttaaaatggcaattggtcatttagatttaataatttaggactttttggcaattcaatgagttctttctaaggtaaatgttttggtgtttaagctataacattatcatacctataataaaaacgacataaaacttataagatcctgtcctccagctggaaaatgagagatgggcaaatgctccagttttcacaaagggacaaaggtaaatggtaggagttaggagctgtcaagctgcaagtgagccataggcagaaattcacatcaggttatcaaatgaatgctggagtccaggctccaatttctaaaagtcagtgtggagtcctgaagaatacatggtgcctcaagtatcttcttttcctgtggggtattagcattttttgttttttgagacaggttctcattctgtcacccaggctggagtgcagtagcacaatcatagtttcggctcactgcaacctcaagctcctgggctcagtcagtcctcctgcctcagcctcctgagtagctgggacttcaggcatacaccaccatgtctggctaatttttgtatttttttttttttttttttggtatttttgtagaggcgaggttctgccatgttcctcgggctggtcttgaactattgggcccaagcaatccacccacctaagcttcccaaagtgctgggattaaaggcatgagccactgtgcccagccagtattcgcatttttaattaaaatattgtgttaattaactgcctaatacaacctctaatagtttttctcttccatgtctggctgcaaactctatggtcacttcttcatataacaattacataagatcattgtctatagaaatataagaacaaaaggtataggctttcttctagcagggttgatagaaattttctctgtgtcatcaagagtttagaaactttttttttgtttttgctttcacaacacattttattattggaaaacttgtgcacattttgaggaatatcatcaaatttaaggacgtttctgtcatatatatgagctatgccaagcttgttcaacttgcggcctgtgagctggcagcatgcagctgaggatggctttgaatgcggcccaacacaaattcgtaaactttcttaagacattatgagattttttttttagctcatcagctatcatattagtgtattttatatgtggcccaagacaattcttcttccagtatggcccagggaagccaaaagattgggcaacccagaactatgcaatttccagtcttcttgtgtaaaaactaatctttaaatcaatgacacatattagctaagttgtcatccacatcctcgtatgaggcatattatgagttttatgttatctttattggagtgagcatggaagatcaaatcggcaagaatttaaatctttttccaatgtgtttattatgattcattcttcttcattagtggctttattaaacaatcaagaagctattttatttcttgtgttagaaatttaccttttcctcttaataaattatttgaggcagaatgatgtcaggatacctgtttatttcattttttaactttatcacttttgattataggccattcaagttttttactaacagctttattgagatataactcacatgccataaaattcacacttttaaaatgtacaattcattggttttcattatattcacagagttgtcgaattatcattactgtctaattttagaacattttcatcgtcccaaaaagaaacccgaacccatgagcagttactccccattgcccattcccccacgctggccaccactgatctactgtcagcctctatggattagtttattctggacatttcatatgaatggaatcatacaatacgtggtcctttgtgactggcttctttcacttagcattatgtcttcatggtctgcccatgttttagtgtgtcttagtacttcatttctttgtgtggctgaataatactccattccatggttataccacattttatgcattcatccactgagggacatttaggcagtttcagtttttggctattgtgagtaacgctgctgtgaacattcatgtaaaagtcattaagtctttatctgcgttttctctcacatcctaaacagctagaataaaaaaaaaaagtacccataatatcactccaaattagtaatctgtaattcctcagttgttttattgaaacatttcaaaatgcgtttctaaattgcagttaatatgacttattcaagacttatcaacttctttttgtcatgtaacttccatatgaaaaaagtacacaaatcctgagtgatttaattctcaacagatcaaacacaaaacccaaatcaagacacagaatatgatcagcaactcaaaagcttcctagggttcctgctagtcccaccacctgctcggtaaaacagctcctctcctgacgtctttcactataaactaatttttttcctatttttaccttatttatataaataatcatagtgtggacccttgggactaacttttgtgagacttatctatgttgttgcacatagccgtaatctattcatgttcgttaccatgcaaatatatttcagtttactccttcatcctactacatgtgggcatttgggttatttccagtttggggataatttaggtaatagtggaataagtattcttgaatgtgtcttttggtgcatatttgaagcttatatgtgtttctgtttggggtatatctacaggtgaaattgctaattcaacttcggttgattccaccagagtagttaactccagtttacagtggaacactcactgagaatcttgactgctatatattttccccaacatttggttttatcagttttttggtttgttattatttttagcctttccaatgtgtatgtagtgacatttccctgaggctttaatttgtatttctctggtggctgatgaagttgaccatcttccatccactggctgttgggattctacttttgggtaataccttttcaagtctttcaaccattttttaagttgggttattagtctttctcttatcgacgtgtttatctttattctggatgtgagtcctttgagttatatacatgttgcaattttttttttacactctggctttcctcttctctctctgaatgaaggtagagtcccaattttaatgaattccaatgttggttgatggttaatgtcatctgtgctctatttttgcctaccccaaaggtttaatttcattgatggatatgaaactatgtatatttcaatttgccaatttgtgtttttccaggaatttgtccatttcattttttttctctatttttcttggttggtcctgccatggagtcattctatccactttattaatcttttcaaagaaactactttttgttttgtggatttttctctattgggtgtttctttgtttttttccttctatctctttgggtatctttcaccatttatttttcaaacccctccctagaaatgatactttaatcattgattttcaatctttctttttttctaatgtatggatttaagactatataaattttcccttaagcatgactatagttgcattacataatatgtgctatgatgtattttcattatcattcagatcaaaaatatttttgaattttcttgggtcccttttgtgacttgtggttttctagaagtatattgctaaatgtgacatatttgggagtgttttttattcttttccattaatttctatcttaattctacagtggttagaaagcatccactatatgattacagtcctttgacatttgctgagacttgctttacaagctcacatgtaatcaattttgatagatggcccatgaatgctttaaaataatgttaattctgtagttgtttagtatcgtgatctatatacatcagttaggccaaggtttacaattttgttgttcaaaccttctatatatgttttattaatctgcttattgtatcagttactgaaagagtgatatgatatctataattacagatctatctatttctcctgttggtactattaaatttttaaaaacttaatttgaggctgtcttattagatgtatacaaatttaaaattgttatatcttcctaatgcattgactctttaccatcatgaaatgtacctctctatctctgcaaatgctttctgctttaacatttatctcatctcgtattagaataattatcttacctttcttttggtcagtgtcatcatggtatatttctttctgtcatttttttctttctgactttctgtaatcttatatttagtctgtgtctcttttaagtggtgtatgtatgggctttgattttttaaaatcaattccaataatgttattgttactggaattattttgcccatttacatttaatgcaagtacaacatattcgggtttcaatctaccagtctaagtatttgttttctatttgttgctcctttttgataaatttcttttcctcttatctcttatctttttcacatttacttgggtttttttataatttcatattcagctctaataacttattagttatacttcattttcatattcttgtagtgggttctgagaaattgcaatatatattctcaacttttggactctaacatcaagtagaatttttaggacttactggataatccaaggactttagaaaatttgagctccttttatcatcctcctaccttctgagatattgttgttatgttttaattctgtatcagtttatgtttttctacttatttaccctttgtattattatttatttatccctgtttttgtgcttccacatggaagaattttcccctctgattaaaaaattccttttattttaaaaatactgcaagtctgctggtaataagttctctcatatattatctaaaaaatgtcttttttgccagaatttttgaagaatattttcactggaggtaaaatcttggttgccagttattttcttagagaacttcaaagataacatttcattgtcttctgacatctatcatgtttgtcaaaaggtcagctgtcagtgttacttttatttccattgaaagaaacgtgtctcttttctctggctgctttcaaaaacattctttgtctttacttttcagcagcttaactgtgacatgctgaactgtggtttaattcgtattaattatacttgttccttaaatatctcaattcataaacccatctcttcaaatatttcttctgactcattttatcttcactgggaccctaattttatatatgaatgtgtttgtgtttgtatgcacacatacatatacaaacatacatatacacacacacataaatatatatatagactttctatgcttctgttgagctatttttaagctcaccaatcctctcttctgtctaatctactatacccatttattgatttaattacactcaggccaggcacggtggctcacgcctgtaataccagcactttgggagaccggtgggcagatcacttgaggtcaggagttcaacaccagcctggccaacatggtgaaaccctgtctctactaaataaatacaaaaattagtcaggcgtggtggcgcccacctgtagtctcagctgccttggaggctgaggcacgagaatcacttgaaccccagagttggaggttgcattgagctgagatcatgccaccgcactccagcctccatgacagaatgagagtctgcctcaaaaaaaattttttttaattaataaataataattacactcatattttaaattatgtaatttcaaattcttttttgaataaaattatcagctgaaattctacattttacctattttcatgaatattttagtcaaattatttacaattcaatgtctgctaactccagcatccattaatagatacttctgagtctatttctattatcagtccttttctcctggtttttggtcattggttatagtcgcctggcatacctaggaattttttaatttaattttggacaacatatatgaaaatgtttagagattagtagaggctctggctgatgattcccccagagaggattcccttttgctttctgtaaacagataagagtaggacaggatgactttaagtcagtctgagatggagttggtttgtggtgggactcaggctttttcaagggtgggtctacttcccagtgttcccttctcctcggatgcagctttcctggggtcctaactgaaagtctggtatgtttccagggctcctccactttggccgaccttgcatttcacttctcagtcccttgtctctgctgaaagctctccttggccctctggcctcttagacagcaccttctgctcagatgcttagcctgctcttcctctgccctcacaatctgggaaatgccttcaagggtaaaagttctatggaatattggcctcgcttcagtgaattttccttctctccaggatcctggactctcaagtattggctgccttaccagctcttcggcactttcaaataagtggggggttttatattaaatccatatcctggttgttctagatttgagggttggtcaggaagaagctttccccaatcatcataaagagagaaaaaatctggattagctttttaatctggagtatcaggaaaatatcagtagacatggtgcggatataattcctgtggcagaaagcataatattttcatttaaaatgtggagaaatataattaaatggcttcacagtacccactccatctcataccatttgcttcaaaatcaacttatttcagtaaaagtttaaaatgtttgaagtgtctcctacttgatgatatcgataagcaagaagggaactctaaatccaagaaagctaaacttttctttctgattcttcacttgatttgacatgaatatctacagttcccttaactctttgggatcttttcctctgtttttgatagtttggtgactccagctatgaagttagaagacacacctttgtgcttccaccctttgccagaagtctaattgaagtaaatatatttatccagtcctccaggattccgtgcaatatatttgagtgcttcaaagaaaagcctcctacttggataagcgtttacttcctttaggagaagagctctttaacatcagatgcacttgtgtctaaaccccgaccacgtaattacacattctgcttgctccaaagagattaatccagaaagccaaccacatatttcttagaagatggaacacatttcaattatctgactcaagtgacttttctggagggtggagtccaagacattttaagtaccagataaatctttgaagccgattaaatgtttttccaaatagtctagactccctcttcctatgaggctttttatagctattatagtgatatatgtgaggcttttttttcctgatactgtaaaatcacatatctgacagttttcagtgtggctgaggttttaaatcaacccaactatatgctactgggatctctatctcatattttgtacagaatggtggggaatatcaatatttaaagaaatggtatttttggagagaagagaacagtgtgatttcagtgcatgggtactagcagtttccaactctgtaaacagtgccatcactcatgattacatcatttcctgttctttcttgtcctggccaacactttgtccaaggactctaagagatcatctactgcaaattgcattcccaacttcccatcacataatcgaagagaggtttgctgcaaaaccgccaacaccttcatttcacatttatcttcacttgaaaggggtgagttcatcacttttttctcctgcaccaagaccataggaagacacgaaatcatcaactaaatcttccagcgttcaaatatcggaggccctggaaacagcaggtatgccgctgaatgtttttgaataaaagagagtgaagggaaacgtttgtacaaatataagcaacgatctacaaatagaagccatcatccaagcagtacagttccaactaaggaaaagggtggtatgtgcattcctggatttaattgttcatacacacaaggatgagctgtcttgcgttgttggaaatgcccacgctgattataaactctgtgtggaatgtcaaaacatctggatttttaagtgaaaaaatatataatctaccatgtggctgtttcttcaagtcactcctaaaggtagacaaggcagccagatgatttattgcattaatcactctttcataattatattcgtgatgtgttgatccccatcatccctgtgtgaacctctatgcgaattccgtgcctttgctaaacctctggttatgctcaagggtcagtggcaactcagtgacaataaaagcaatttttcactatagctggcagagtcttaccaccgagccactccatagcacagtggcctctgaagacttcatccacctccttctattcaaagataatatcctcatactaagagcaacaaccacaaagccataaaacatctacttttttaactctaagaatatgacatgactacacctccataatgcagtgtgcagaatgagaacacaggagttcagaaatagaaagccaagagcagcataaatggagcctgttggaagatgaaacgtccaggtccacactgcacctggaagccattttgtactgaacaattttagaagtaagatcatgggtctgatgcatacatggtttcaaacactgtccacctggctacagcctgccttcgtcttaggccacacgggagctctgtttacccctacgtgccaagctttggcatgtctttgtgccactacacactctgttcccttcttcccggaatgccttttccttcctttgtgcctgaaaaattccaatttatccttcaccacccaacttataaatcccccaggcactttgttacttcctcttccttgtcccaaaacatgttagcccccttcctagcctagagttaccacattgcctttcgcttgtggactcacaacccctctccctaatccgcttggaatgctttgctctttaagcccatctccttttcatctccgcctctagggccaagcacaggggcaacatcaagtgtttaattagagatgagtttattattcatgcagcaaatacttattacagaactgtgttttggcttctgatgtactattaactatcctttcattcactattatatacaatgttacctgtataccattatatgctgcgtataagtaatactctattatgtatgctattctattctaatatgcacataccctaatatgcacatattctagtctaatatataaatctattgtaatatgcacatatcctaataagcacattttctattctaatatataatatctattgtaataagcacatatcctaatatgcacatattctaatatataatatctattcttttctcatatgaacatatctcaatatgcacatattcaattctaatatatatctattctaatatgtacatatcttaatatgcacatattctaatatatatttctaatatgcacatatcctaatttgcacataatatctattgtaatatgcacaaatcttaatatcacatattctattctaatatataatatctattctaatatgcacatatcctaatatgcatatatctattctattctaatatgcacatatcttaatatgcatgtattctgttctaatatataatatttattctattctaatatgcacatgtcctaatacgtacatattctgttctaataatatatgacataaaatattaaatatgcaatattcaacttctggtgtgctatataattatttaattgcttattgccactctcactaaattagaatgtaagctcctcaaggaaagaaactatctgttttgtcatctgctgtggtcccgcacccagcctgccgtgtagtgcatgatcaaataactgatgaatgaatgaataaatggtcgatgcttgacaacaaagacaatcagaatctctgagtcatgttgttgcaaagcacttgcggccaggcatggtggctcatgcctgtaataccagcattttgggaggccgaggtgggctgatcgcctaagctcaggagttcaagaccagcctgggcaacatagtgaaaccttgtctctactaaaatacaaaaaattagccaggcatggtggcatgtgcctgtagtcccagctacttagggggctgaggcaggagaattgcttgaacccaggggttggaggttgcagtgagccaagattgtgccactgagctttagcctggagaacagagagagactccaaaaaaaaaaaaaaagaaaaagaaaagcactaggaaggcatctcattcaatacatagttttatagatgaggggtcctgctcaaggtagaaaacagatcccagaccaacctcactgtggcacaaaatgctgctgccgatgagaaacccaggctccagccctgcactaacatagcaagtcacaggatcatccccaagatttatcattgcactgtagtctgccaagagccgagacagttggagttaaattccatctcagaagtgaataaatgaatctacataaactgcagagatccctgaatctacttccctatcggtcaagtaaaaagaaaaaaaatcaagaaaactcaatgttaataaataatacataaaggaatcgttagagtggagacaggttcaacttatcctgtgagttaaaaaaaaaaatgaaagcaagaaaatattccacagttccagtgtgctgagctcattcttgtgagattaaacaaaataattcaggattaatatattcatttctttgcaaactactatctatttcagttacagactgagtatcagtttttccagtgttggcactttatttttgctgttgaccggctcagatctgaaagacaggattttatgagaagcgtcaccttcagcctgctttgcctgtgtgtgcctgcgtttgtgtatcacacgtgataacgttatgctgtcgctttccaaagtacattcattcattcattcatccacctgcttgcccatcagacatgtatgtgcgctatgcctcctcttttccaggctctgtgataagctagagcgcagggcagtgagtgaagtgaacagggtccctgacctcacgaagcatggctggggacaaccagccaaccagcacatcgatcctgaatgacccctcatgatgagatggaagagggtaaagtcataacagagggggactgcgagggcacttggcatggagctcagggagggcttctcagaggaggtgactgtattcatttcctgggctgccataacaaggtattaccagccatgtggcttcaacaacagatgtttattacctcacagctctggaggcagaagtccaagagcaaggcactggcagggttggttcctttggaggctgggagagagaattggtttgatgcctgtccccacacttctggtggccgccggcaacctttgtgctcctgggcttgtgcatgagcacgagcatccccccagttcctgcctccatctacacctggcttctccccgtgcccatgcctgtgtccacatttcctctttgcagaaggacaccagtcatatttgactagggcctaccatagtagcctcgctgtaacttgattctctctgtcaaggtcctctttccaaataaggttacagtctgaggtcctgagggttcagatttcagtgtatccttagggggagacacaattcaaagtctagcagtgacacagaagtggaggatgcagatggaagcgtccgtgggaagaccccggcctgggaagggcatgtctggcaggaggaactgaaagccacccagggtgaccagagcaacatgaaagagtcagggagggtgtgaggctggagagggcgggaggggccagatctcacccacaagacgaggaggctggatttattccaagtgcatggggaagacattggcagatgttaaaagagatagggaggggggccgggctcagtggctcacgcctgtaatcccagcactttcagaggccaaggtgggtggatcacgaggtcaagagatggagaccggcctggccaacatggtgaaaccccgtctctactgaaaatacaaaaattagccgggcgtggtggcatgtgcatgtagccccagctacttgggaggctgaggcaggagaattgtttgaacccaggaggcggaggttgcaatgagccgagatcgcaccactgcactacaacctgtcgacagagcgagactccgtctcaaaaaaaaaaaaaaaaaaaaagatatagggaggaacattccaagactcagagcccccatgctgcttaggaatactgttagtccacaagagtgagtcaatggctaggagattgctggggatgccaacagcatgagacccaacacctatgtccttcacccaagtgggaataacgccaaccacaggcagccaacatgagtagacgtttatgtagtaagtttcaagcttaggaagcccttccacacgccacatgctctctctcacctaatacttgcaccgtccagcaaagagggtcttgttgtccctccacgtagatgaggaaactgaggttaagtggcaccgattccttccctgaggtcactgggagctacatggtaagagtctggcctctgcatctgcttttcccttgcaaactcaaagagacgtctctccttcaagttgcaagtgtcctatcaagaacggcaattgtgtcgtgagtttctgtgaaaagcaagactggtcattccatcacttctgtctgtccaacatgccccagacttgctcttttggggccccatgctgttaagtaaacatcccccagccagtgtgaatatctgaaagcacctgctttgtacgcagcagggtcagagacctttatatgcacgccctcgagccctcctcctgccagcactgagacaggtaccatgatcgtaatacccctttcgtgggtatggagatgaaggctccgacagctgaagaacttacccaggctccagaccccaactctcaaccctctgctaagctgcttctgtcccgtgaaaggattagcaatttaccagtccagtgccagtagagcccactattcaggcatttctgccggattcagtggcagccattatatgactctccagtggtctagcccttggggtcagctctgtaggattccttgccagggctattcctcggggaatacctatcctgtttttcttgttacacttgtgcaccaagggtttgctgaagcagcccaggtctattaccaccgttttccactctgcttgaacttgcaaacttcaacttactgctggccctcttgctctcacctcacctgcctttttttttttttttttttttttttttttgagatggagtttcactctgtcacccaggctggagtgcagtggcatgatctcggctcaccgcaaactcctcctcttaggttcaagcgattctcctgcctcagcctcctgagtagctggaattacaggcatgtgccaccatacccggctaatttttgtatttttagtagagacgaggtttcaccatgttggccaggctggtctggagctcttaacctgaagtgatccacccgcctcggcctcccaaagtgccggtattacaggtgtgagccaccgcacgcagccacctcacctgcctttctgttcaaatcaggacaatgttttgtgcaaggcctggatataactacagcacacaaaagatttctctcctgggttcattaggataagttcaagttaccctctgtccctccgtcatttcttctcattataaaagggttggagggcttctttcaatagccagtgaagttgattagcaaccttgtatctttattttgataggtccaatgggaaaatatactaatcatttcttatgagcaaagaatagataaaaaaattcatccatataaataacttttcgaaagctaattattatcaagtgcttatctgtgtgaggcactgttcgagatgctttgggaactgtagctcatttaattctcacaacagccctatgacgtaggtactcttattgtgcccatttcacagatgaggaaactgaggcacagagaggtttaggacgatacctgagacttcagcgtggtggggcaggaatgtgaggtgtgagtcagagcacctggttccagaggcagctttcaaacacagcactgcactcccctgagcttctacacactcttccggccccatgggattccgaaatgagagaaatcaggcccccaaaagaccagccttcatcaggagactcggacgagaaagtcaaaaaacctatgttgaacacagcaccattcttgcagcagtattaacttttccacacttcagtatattcatgtgcgtatctactttaaaatcttcctgcatcaccatcaatagcttataattgatactccaataattagatatcataattgaaatccaggttttactcactggagaatttgggcaaagtcctgcaaagcaagagaaactttagttcattaatgaggctcatttttacattagcccgctctcgctacataacaatttttaaatctttttacatttatgatagtcgttactgcagtttcagaatcattagtgagataatgtgcttcttcaagttcaccagtctctgtgaatttgatatacttgttctgagttagcagggttgcagcggcctcagctttttggttcatgcagtcaccgcatgcctaccaaacacaggctgcgggctgaaggctggagattgaaataaggcagcaaattcttgctttcatgaggcttagcagggaggacaggtataaaaatagtacaagggtgaatcttacaaataaattcagagtgctttgggaacatgacctaagggaaatggacccgaagtctgggaaggtcagctcatgaagtgacatcttgtcctttaagacttggctctgctaggtagagtaagaaggggtggtacaaggttagcacaatccaggaagagcaaacattgtgtgcagatgccctgaggcatacaagagcccggttgaggggctgagaggtggggccagggctgggtgggagaggtggcacacacccagggactcagtcccctattacagactccaggaagccatgcatttccctcgagttcccccaaatcactccccagtcacgattaacgggctctcttttctttcacttgggccctttcagcgccttgtttctccctggatctcagcatccttcccagcatgcactatcggctttattgcaatcggtttctgcgtcttctgggcagcccctcttctggggctccttgagggcagacagagcttcactcatcatggtcgtccccttcggcctcggagcggtgtgcacagagggagcacaaagaatgtccgttgcattaaatcaaatctaacaaacagcactttttcccggcagctctacaaataggaacaggtgtctttgctaatcgcccctgaatgcacggttcaattcagggctgtaaatccatatatcagagccagaaccagttagctgtctggtctataataaccacgcactggcctctcacatcatgggcactggaccctgtggctgaaaagaaagtctcaacaaacccaaacaaactgaattgtccacttgtaccagcctcacacaggaatggtcaaaatacctcttttccttcagctctgggaaattgaaaagacaaatcagttagcggaagcctaagactagaggctcacccttcgacaaggaaattcacttgtattttctccggagtcaaggatcccctgtttgcactcatttcgttgttaggaacagaaatccactttcaaccagcagaaacgaatttcctggaaggcattggtactcatcactgggggaggttccggggctttccagcttcaggtgcagctgcgtctaagccctcagacaatgtggacgggatgctccttgtctgcagctccagctgtcagctctgcctgtctctctatgttggctttattctctgctaggctctctccttgtggcaagaaaggtgacttctgacagccctgatgccttatacacaaaggcaggaacacccacatcctctctcccagatccaaatgctactctcatagaaagacttttggtctctctgggtcacagtaccccctcagaccgggcattgattcccaggaaatgatgagataacgcccccacccctgccccaggtcagcagtccccagcctttttggcaccagggaccggtttcgtagaacacaattttttcacagatggcaggggtggtgggggatggtttcgggatgacactgttccaccttagatcatcaggcatcagttagattctcttaagaaacgtgcagcctggatccctctcattcccagttcacaataaggtttccgttcctatgagaatctaatgccaccactgatctgacaggaggcggtgctcaggcggtcatgctcactcacaggatgctcacctcctgctgtgctgcctggttcctaataggccatggatcagtacaggtccgcagccccaggggttggggacccttgccctagatcacctgcccacctctgggaaacaagatggggagaaaatgaggcctgtggttgactgcaccaacgtgacctcaaggagcaggttgtggtggttccctgaagaaagcaatgcccccagatcaaagctacatttcccatctactccagatcctattcaaacagaaccagttcccttgagcctggccatgatttgcatgtgaaaagctggtgtgttgcagccagtctgcaccagctttgggagagctgattgccgcatgtcttgccggttctgcatgtgtgcggtgatatcgagtacatagcttgaaattggccatggggggaatatttaagcacaaaaatggacacaagctacaaatcagggcttttccccctgaattgccattaaacatttaccagcacaatactgtgggttagttatggtgtttgcccacctaaagaaactctgtgtgtgtgtgtgctcatgtgtgtgtgtgtgctcatgtgtgtgtgtgcatgtgtgtgtgcacacgtgtgtctatgtgtgtgtgtgtgtaatttaagccaaaatgacggaccctgtgttatctttgcagatccgtggtctcaggccatgcttaattcttccacgctggtttattggttcctgtgttccaaagctccgcatgtaccctgtttaaaggacggtccacttccaccctatacagttggagggtcacccattcatttgatttcttcaggtccattttcttcatcctccttccacatgctactgaccatcgctaacaggactgcgtgctgagagccgagcctgttacctgctttccccatgacagggctgtctgcttcctctccctgtcccaagatttgttctttacctctcagaactgcagaaaacaagttattttctcttggcatttgtgccgctctttttcctccctcttttggcttcgaaaaagtggtgggtctcatgcacttgtaattagctggagcacatctgacccatcgtcccctgagggagggcagcttggtggtccctagctcaagaaggggcagcccccaccccctgaaattagggaggggaggtctacagctttttccaggaggtacctcagcccaaagtctgtgaatccacaaaagcaaggtcggcctacccttttacgtaagccacgcggtagccagagacaaatgcaagcaatagtgtgatgtgagatagggcagaaacactgcaccccaaagtcaggtgtattggggtctttccctgggagtccgatgcagcaagcaacactgtcacaggtaaaacgtgaggaaacaagcttgcttcttttttttttttttttcaaagcagggtctcactctgttgcccaggctggagtgcagtggaacaatcacagttcactgcagcctccacctccaaggctccaatggtcctcctatgtcagcctcctgcgtagctggggctacacaagtttgcttcttattcctgagctttttaaatttcttcagctgattttgccgtaccgcgtgtgccggtttcatcttcctcctcgttgtaattgtttcatgaccggagtcaatgctagaggccccgaggaatgcaggaaagcaccagccatcaggacgtgttgatgagacacacactgtctgggaccttctgtgaataacatgattggcgttgtcaccgggataactgcaggagagatgtgaaagtgcttaggatgtagttggcgctcaggtcattctgcaggcgttaatgaagcacgtgctatgagccagggtctttgctggggacctaaagatgagtaggtcagtggacaatatttgaatgcaagtcacaaatgtgtggtttccaaacctggactgggtggggctgacagggatttcttccattttttctgtttatctctgaatggttcctttagctgctgacttggcaactgaactcaacgttgtcctctgcccccaaggctctcttttgtccattctctctttctcggaggatgactttgcctcctacttccaattcaaaataaatcctgctggaagaagcaacggagccatgaccaaaagcagactttgggtcgagactgccgagtctctacttttactgaatttagtcctgaatcccacacagactccctgtacccgctctccctaggacgcctcggaatggtcctccgtgatgccgctgcgcctgtgctgtctggaccaccttctgccttggtgttctgacaacatcctagagcatctcacctctctcggctctttcccagttctcatgctccctgatggtccttaaaaagattcctattcagccaggcgttgtggctcatgcctgtaatcatagcattttgggaggccaaggccgatggattacctaagctcaggagttcaagaccagcctcggcaatatgaggaaaccccatctccactaaaatacaaaaaaaaaaaaatgagctgagtgtggcagcctgcacctgtagtctcagctactggaggggctgaggcaggagaattgcttgaacccaggaggcagaggttgcagtgagccgagattgtgcgcctgcactccagcctgggcaacagagtgagactccgtctccggggaagaaaaaaaaagattcctattcatggacctaataccccacttctaggagtggagtgggataaactagacagagatgaacatacatacagcgaagcagaattcctgagaggcctctgatctgaatagtgccaactccaggcattagctacaaaagaccttaattgcaaaactttctggggacttttatctttcctcatctggagtatccacaccattgtcctgcctgcgaggaatttggatagtttattttgtttttcattttgttttgttttttagacagggtctcactctgtcacccaggctggagtgcagtggtgcaatctcaactcactgcagtctcggcctctcaggctcaaccaatcctctcacctcagccccccaagtagctggggttataggtacacgccactgttaccggaaagaggtcccaatccagaccccaagagagggttcttggatcttacacaagaaagaattcgaggcaagtccgtaaagtgaaagcaagttttttgggaaaatcaatgaatacaagtatggctacaccatagacagagcagccccaagggccaaaggactatttcttgactgtgtgttaaacaaggagcagattattcaagacttttccaggaaatggatgggcaattcccagggctttttagaccgtatagggtaacttcctgacgttaccatggcatttgtaaactgtcatagcgctggtgggagtgtagcagtgaggacgactggaggtcactctcatcgccatcttggttttggtgtttttccggcttctttactgcaacctattttatcagcaaggtcttcatgacctgtatcctgtgccaacctcccatcttatcctgtttatgcctaaccgcctgggaacgcagcccagtaagtctcagccttatttcagtcagcccctgttcaagatggtgttgatctggttcaaacgcctctgacactaccatgccaggctaattttgcatattttttggagaagcagggtttccccttgttgcccaggctggtctcaaactcctgagctcaagtggtctgcccacctcagcctcctaaaatgctgggattacagatgtgagccccggggctctgcctggatagtttattttttatgtttgtcacatcgctcttctctgtctccactgataagtcacattccagacccttttatccatgtgatttcttgagatatcaagattcctacagacctgggaggaagtgtcgtacatctttgggcaaaagctgacctgagacaataggcaattgcccttgatgctaagactaaccacaagctcttcccagtctgtagtttttatttgcacatttgcaggctggagtgtgtcctctctatctagtcggtatttcaataggaggcgaagatctctgtgaggcaatctggggtttttctagctgggcccgtgttattcatggccagccagctctcctggtttgtttatacctttttcccacctgaaaccttgatggttgatttgtgaaataaaaccaaaattgctcaatctgtctaaaagctttctgtgggttttaaacttacctattttttaaaagaaattttaataatgcttctggcttttagaatcagcaggaaacctacaatcaggattgttgtatttgcaccaatatcaaacataaggagcataagtaataaggaacccagtgccctttgttgaatacgtaaattttcatggtaactggtaattgctggcctataaaagctctcttccttatgttcctgctactgagtaaaaatgatttttgtatttgtaacagactagattcatttcaaatggaaatattaatctgtaattgttcttatacgagaaacaccaagttcaaggcaaaaataacaaagccagttaagcatatgtttcatacctgcacaatttacctaaatagagattgcccaaagaagttttgctggcttctgaaaactttctcataagattttaaaaatatattttatggtcaagaggttgtagcatcctcccaggactaattcatatctagccaagaaaaattacattttcccatttacattccaaagtctgaactgttattttataaatgaattttccctccaattcagaaagcactggctacattacaaattttaatgctactattataggatcataattttaaaaacccagggttctccaagggcttcagcagcatgccatctctccactttattaaaatgaatgaacagatgtacaatttatttctgccaagccatcatctaaattcataagctatttctcatgtgtctgaaatccacgttggtttcccattttctttgccttagaaaaaaaattacactccctcatttatcactctggggacataaacgagaagtctactctccacttcattcactttggactaatatcctcgacacaatttaaatcccatctcttcaagactattcaatgagagcaaggcagtggaacacccagcatccaattggaaaactccttggccatcaatgtagaagattgacaagctcagtcacatgagcttacaccttggcagatgcaggggaagagagcttacaacagcgttgaatccattcaggtagatgggacagtctagaaccatcacacttaaaagtcaacgtcagtaacagaaatgtattttagctgccgtatttcatagagccctgataccacccttacttcccacatgacctgtcatctgacagcaggctggcagacaggcatttaacagattcatctcgggttggcaaacatctagcctagctttgaaaacccacgtgttgatctcagacctgcctttacatccctgcaccaccattttctgatggtgtgagatcaggcatagtttttaacctctctgagatctgggttatttttcagtatgatggagataagtggacctgctttgtaataaaggttaaataaagtgcaacattttgatgctatgaacctaaaagtatctgggacaggtctcagtcaatttagaacgtttattttgccaaggttaaggacatacccataacgcagcctcaggaggtcctgatgacacgtgcccgaggtgctcagggtataacctggttttatgcattttagggacacatgagatatcagtcaatgtgtgtaagatgtatattggttcagtctggagagtgggcgatcagggagcttacaggtcataagtaggtaacagacaaatggttgcattcttttgagtccttgatcaaagacggcggtagaggaatagtcacttatgtcttagtctagctcagtgaatctgcatttttacgtaaacaatcagactgaggaagcaattagatatgcatttgtctcaggtgagcagagggatgactttgagttctgtctgtcctttgacctgcacctgtgaagatgagcgatcagtttacgttgcccaggtgaaattcaacagaagtttttagagtaaagatcttgaggcccacaaggaatttccttgcaggcaaattgtgagggagatattttctatatttgtagctatcttattaaaaataaaatgggagcaggtttgcctcccataggtcccagctagacttttccctttagcttagtaattgggggtcccaagatttattttcctttcacaatgccaaggtcaataatatatggcaagcacagtgcctgacatgtggttcagtaagggggccattgtgatgaagatggcatcccggagatacatctctgccgcagaacagctgggctaaaagagctctcctcttcctcagttctgcatttgctggcatggttctagtgaatgtaagaaaggcattttgcagccagcagatgcagtcaacgagcgcaagttgtaaaggctgcagaatgaagccctcaggttatctggcagaattctgctcctggaagaattctatttatgagatgctgctggaattgagcaataaaacttgccggagtctctagtttcacatggaaaactgccctgtgtccataaatgcttcttgggtttggggctttaatcagattttgagtgtttggtttgttgttgtttgttctttcggtggccctgttgcttggagaagaaacatcatgttaacttcatttgcttgaactctgtgaccatcctgtgatttcaaacacagcttgtctttttctcatgtaatgtttttgggaggggaaggtgggttctcctgatctcgggaagatccacagcaaaatgatggagttctttcatttagcagagttacagcttgaggtggacagtgtcaaaatggcaagctccccaaagaggaaaggaaagagggatgtcactccaggatgcgccaacgagatgctccttaggaaccacggaagtgacacttgtcagcatccacacaacaaaatgttgatgaggggagccagccttggtgactcctagcagctcccggcagcagtctgtctgcctgtgttgtcaacagtccctgaattaaatcagtcactgctgccgccaatgaacttgtaggttgttgtgggataaggggccctaggcagtttcttcatctctgcttgaccaaaccacgcatcaaggtcatggatcccaggtgcccctgaagacattcaagaagtctcgttcgccagctgagcaaagtcatgagacaaactgtccatatgacaagcctgcttttaggctttgacattccagcaaggaagcaggtgctgctgacagaaatgtggtagtttgagagaacaggattttaaagaagaacgaacccaattatttggatccacagagtcttagaagatagaatgcagggaggaggcaagcagggaggaaagagaaggagcttttatgtttcctcattgttactccatcacactgtcagtttgactagaagggctgtttttatttccctgaatcccagttctgtttctgagttcttattcacagggcaggatgggctgacactgtagagacgtgtcctacagtgaaattagagatgactcctaatttcagtcacatctccatcagtcagcccctcttaggtattgcacaagttccttagatgctttgggcctcagtgtcctcacttacagaatagggattttggtaatgaaggccagcagctccgtgcatgacaaggtgctgaatgctttctgtttattatcacgccgaatccttatgatttctttgtgaggtgcattctactagaccctccagttctcagatcaggaagctgagggttagagagctaaggtaatgcacccaggttacagcaggttatcctcaagtgccccacggagtagtgacattttgtcaccattgatgctatattactgataatgatcaatagataggttactggaaaggggtccagatccagatcccaagagagtgttcttggatctcatgcaagaaagaattcagggcgagtccatagagtaaagtgaaagcaagtttattaagaaagtaaaggaataaaagaatggctgctctataggcagagcaacagcatgagctgctagttggccatttttatggttatctcttgattatatgctaaacaaaaggtggattattcttgggttttccgggaaaggggtgggcagttcccagaactgagagtttctcccccttttagaccatataggtaacttcctgatgttaccatggcatttgtaaactgtcatggcactggtgggagtgtcttttgacatgctaatgtattataattagcatataatgagcagtgaaaatgaccagaggtcactcttgttgccgtcttggttttggtaggttttggccagcttctttactgcaacctgttttatcagcaaggtcttcctgatctaaatcttgtgctgacctcctatctcatcctgtgattaagaatgcctcaacctcctgacaatgcaacccagtaggtctcagccttattttacccagctcctattcaagatggagttgctctggttcaaagcctctgacagatactgcatccatgaggtgaataaaggtggcaccggtgttcattttattggctaagaaccccgaaattgtcacattgcgtgcagtggttccggaggtttgacctcaccgtagaagagcacatctgaagttagttttgaacatattgacatcagtgttttgaaactcctcaccgctttctaacagtctttccagttagctgagtcagcacaaaaggccttagccaggtctgaaaggagtttgttttcatgttgcagggagtgttttctaataagggtttttttctccattgaaaacatctcttactttgcgtctatcattatgatcttactcggagagaaaatggtatcttcctgggctgattgctcattggtggaggcttggcttccaggaagacgcacactggctttccgtagcactttctctcgtttttgtttccaaaatcactatttattgcccttcaaaacaggttgcgtttgaattagggttctgggcctgtacagtctgtgggagcccaagtgcaaagtagattccatcataaacaaggtatcccccctccaaattaacagtaaaataggccatgtgatcccagaatgcatcatttcaggcttataaagaaaagcaacttagtttccttatttttccatttttccatgatcacaggctcacagaagttgcaaaaatagtgccagaagcaccttgaacccttctctcagcttcctccgtagtaacatcgcctataactgtagtgcaacaataccaagagcaggaagttcatgtgggcacaatactattaaccagacctcacgaagtctccacccatttttgtgtgttttctgtgtgtgtgtgtgtgtatgtgtgtgtgtgtgtgtgtgtgtgtggtcctacgcatttgatcacacgtacagatttgtgtgaccaccaccaccatcatgatacaggacagctgcatggtcacagaagggctacctgtcttgctactccttattagttgtattaaccttccccttactcttgggcttctcccctggcaattattaacctgttctccacctgtagttttgtcacttcaaggatggtacataatggaatcatacaatatgtaactctttgatattaactctttttttttttttttgagacggagtctttcccagccacccaggctggagtgcagtggcacaatctcggctcattgcgacctccgcctcccaggtttaagccattctcctgcctcagcctcctgaatagctgggactacagatgcctgccaccatgcccagctaatttttgtatttttagtagagacagggtttcaccatgttggccaggttggtcttgaactcctgacctcaggtgatccacctgcctcggcctcccaaagtgctgggattacaggtgtgagctaccacacctggctgagatgagctcttttcactaagcatgatgcccctgagattcatccaagtactcacatcagccgatagctggttccttttgattgctgagtgatattccatggtatggtatgccagagttcgttgaaccattcacccactgaaggacatttgactttgttgctagattgaagctactgcagttagagccaccctgaatatttgtgtaaggcttttgtgtgaacatacatttccatttttctgggtaccagctgctggatcatatattaagtgcatgttagttttataagaaactgcctgttttccagagtggctaaaccattttcatccttatcagcaatagaggagaaatccagttcttccacattctcaccagcatttggtgttatcactctttttcattataaccattctgttcagcatatagtaatagctgctctctggtttggtgtatagcaatatgatgttaatttgcatctccctaataactaatgatatgaaacatctttgcatgtgcttatttgccgtcagtgttctctttggtgaaatgtctaactatgtcttttgcctattttttgtttcgttttgttttacaggccattttcaggactttaacttttgcccattttctttctttttttttttttttttttttttttttttgagacagagtctcactctgttgcccaggctggagtccaggggtgtgacctcggctcaccacaacctccgcttcctggggtcaagtgattctcctgcctcagcctcccgagtagctaggattgcaggcacatgccaccatgcccagctaatttttgtatttttagtagagatgcggtttcaccatgctggccaggctggtctcgaactcctgacctcgtgatctgcctgcctcggcatcccaaagtgctgggattacaggtgtgagccaccacgcccggccccattttctaacagaatcttttaatgtttgagtgttgagagtcttttatgtagtctatatgcacatcctttgtcggagatgtggcttgcaaatatttatctcaatctgtggcttgtctgttcgttatcttaatagaatctttcacagaacaaaagtttttaatttcatgcaagtccaatttatacttttttcttctatagattgtgcttttggtgtcaactctaggaattctttgcctagccctaggtgttaaagattttatcctctgttttcttctacaaatttttatagttgtatttttacatctaagtccatgatcctttcggaactgatttttttatgtaaagtgtaaggtttaggttgagttcatttatctgccagtggacacacagttgctccagtagccttttagaaatagctatccttcttccattgaattgctattgtccccttgattaaaaaaaaaaaaaatcatgtgggtgcaggtgtatttgtgcaggtctattccgtgtcctccgttctgtcccattgatctatgtctctgtctcaccagtactgtactgtcttattaccggagctgtagagtaaggcttcacatcaagtagaatgagtcctctgctttattcttctttttcaaaagtatttcagaaaacattttttttcctttttcgacttttactttagattgcaggaatacatgtgcaggtttgttacgaaggtatattacatgatgctagggtttggagcatgatgaaccctagcacccaaattggtagtttttcaacctttgctccttccctccccacttttggagcccccagtatctattgttgccatgtttatgtccatttgcacccaatgtttaactctcacttcggactgagaacctgcagtgtttagttttctgcttctgttcattaagacaaaagcctccagctccattcatggtgctgcaaaggacatgatttcattattttctatggttacatagtattccacggtgttttctaacccaccattgatgggcacctgggtttgttgcatgtctttgctgttgtgtatagtgctgcaatggatatatgggtgcatgtgtcttttcagtagagtgacctattttcctttgagtatctactcagtgatgggattgctgggccaaatggtgcttcaactcttaggtctttgagaaatgtccagactgctctccgcaatggctgaactaatctacattcccaccagcagcatatatgtgttcccttttctcctagttctaccaacatctgtaattttttgacttttgaacaaaagccattccaactggtgtgagatggtaactcattatggttttgatttgcatttctctgctgattagtgatgatgagcattttttcatttgtgaattggccattcatatgtcttctcttgagacatgtctgttcatgtcctttgccctctttttaatggttatttgtagaaaaccattttaaatacagtttgaactcaacagctttttatcccctctaaaattatttttctgattaaaacataactcatttccattgtaaacaacattaaaatatcaaaaacgtctaatagaaaaatttaacagatctcgggaggagccaagatggccgaataggaacagctccggtctacagctcccagcgtgagcgctcccagcgtgagctacgcagaagacggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggatgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgactcctgacccccgagcagcctaactgggaggcaccccccagcaggggcacactgatacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggttggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaagcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgccggagaggatgcggagaaataggaacacttttacactgttggtgggactgtaaactacttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctataacttagagtataataaaaaaaaaaaaaaaaaagaaaaaaaaaatttaacagatctctccacacacctgagagaggactatgttctttcccttcgtatatatcaagttctacttttttatttacaaacgtgtgatcacactctcttcagtatattgccatctgtctcacgatttgtatctttttccttgtctgtaaaaagggagaactattaataatactctatttctttagtctttggtgaggatcaaatgataaaacacatgcagagagtttaacccagcacctgctacatagtaatgtctttgttgatgttatttttattgttcccccttcagcttatgctacctgctttgggtgatcttggcctttcttggtggcaataaagggcagagaaactccataatgtttagtaatccaagtcagtttgcagaagcagtcaggagaatgggttcttccatcactcagtccaggtttcctaccaaatagaatgaatgagacaggtagtactgcaaattcatagtttacttacgttaatcataatgtcaaacatgtcaacagcatcctggagagccccccaagtttcctgtccacttgtccactgtacagccacctacccacgctttacgtactacccagctcttcctctaagtgggatcctcccagaaagccagagctccgctcctagagagcgtttgaggaacctgcatgtggtttgtcttatcttcagatctttaacataagctgtaacgagggcagctagaagcagagcctatcagatcagcccccgccagctccaactagtgaaacccaacagagtccttggaccctgcagcctaagaacataaaaattctgtaatctccttctctttatctcagctctgccttcagatgtgtcccttgaatggcccacattctcccaatttcattaacttagcacattttatttccactaagtaaacccaaggtgcttccatggtccaatataacggatttcccttctgatccataatgccaaacaatatgctacttcattccctttaatggctttgtattgtgttctgttttatagatgtcccaccatttgaccaacttcacataaatggacattttgatggtggttcctggttttcccttttataaacattacagcaataaaaatgcttgaatgtacatcttcacgtacatatatgaaagtctttgtaggataaactcccaaaagcaaaatgcctggcccaaaagtatgagcactttacattgcagtttatagctctttttctaatatgattaaagtatttttaaattaccttcacttttgtcatccctcagttacgctggtttctgtattgcatagattcctagcctgctccactgcaaatgggctgccatacagaggatgaggttcatggtccagaaacgcatctggtactcaagcgcagagcagaggtggaattctaggcctgtgaatggttcacatcagcagtgggggtccccagtgaagtaggatcccaaaggccacagcaattggacggatactaatatccttcatgcttccacgggcatgaacttgaacttgcagtggaagcctctaaggcacagcaaggcaggagcagatatgaagtatgctttgcagctgtagctcctctagaatccaggggctaatgatcaggagggaggtgctaaatattctgggctcctcgcttggacttcaaacctacaagctccccactcttgaacctaaccccattcctgagtttccttctatgctcacatccactcccaaatcctctaaccaccctgagctacattatattaaaagggctactcctcatatgttcaccacagcactattcacaatagcaaggtcatggaaccaacctaagtgtacatcaacgattgactggttaaagaaaaggtggtgtatacacaggtgaaatactatgcagccataaaaaagaatgaaatcctgtcctttgcagcaacatgggtggagctggaggctattatcctatgtgaattaactcagaagcagaaaatcaactactgcatgttctcacttgtaagtgaagggtaagcaatgggtacacatgaacataaacgtggaaacaatagacagtgaggactccaaatgcagggagagagagagatgttggggatgagggctgaaaaaccacctatcaggtacagtgtttgctgtttgggtaataggtgtgctagaagcccaatcttcaccaagagacaatatacccatataacaaacatgcacacatgcccccccccaatctaaaataaaataatttttttaaaggtactccatcagaacacccccaacctcccgcaccctcaggtgtggcattacagaaacctcagcagcaaagccccttccccatccttctccaatcaccagagcactatgctgactcccagaaaggccacatgagaagaacttgctagcccctgcaggtggcccgttcttggtggtagagcataagggaaggggcagggaaaacaggaggagaggaggcatcatttcctgtaaatctagcacaggcttggtttgcttagacagtggaaatactaaaaaagtcaaaaagatccttcatcatacacaagaaaaagggagacgaaaattgaggtgaaaaatcattctgccattacttagaaaaccaattgtgaatcctttcctggttttaaaccatagctacataaactgggggaaatgtctgctgtaggtttgctccacatccagcctcgccccgttgggagaagccttggagctgtatgggttggagcagtgtctgtgtagagtactgatgctctcccactgggccctagtgtgggaccatacgtgaaagccaccaggtagggttgcacatagactctagactcagaccaaccggggtctgaatcccatctctccactccctaactctgctaccctaggcaagtgcttgtacttctctgtgcctcagtttcctcacctgtaatttggagctcatgacggtaacctaccccactgggtgagtagcgtacccgggtcatgacatgaaggatgtatgtaatcgttagctgtgattatcaccattccactaataagctttctgttgctgccgttctgcagggctcaactttctttagaaaatagttgtgttggccggacccagtggttcacacctgtaatcccagcactttgggaggccgaggtgggtggatcacctgaggtcaggagttcaagaccagtctggccaaaatggtgaaaccccatctttactaaaaatgtaaaacattagctgggcgtggtggcgcatccctgtagtcccagctactcagaggctgaggcaggagaattgcttgaacccgggaagcagtgagctgagatcacgcgattgcactccagcctgggtgacaagagcaagactccgtctcaaaaaaaaaaaaaaaaaaaaacacacacacacacacacacacacacagttgtgtttgcatcctgttatttgagttagctcaattctaccaaattcccatcctacagcctgttccagtaaccgcagagccatgagacctggtctgatggcttcttctctagctgcttgtatcaaaagaaggcaactcccccctttccccttcacctgctaatgaggcctggaacttgcagtccacatcacagcatcatttacgttttgtcctttcctggaggtctacaccaggcacctgggactgcaggctttctctctcccctgggtcttaaattacagtaacatcggccaggcgcggtggctcacgcctgtaatcccagcactttgggaggccgaggagggcggatcacgaggtcaggagatcgagaccatcctgtataacacggtgaaatcccgtctctactaaaaacacaaaaaattagccaggcgtggtggcaggcgcctgtagtcccagctactcgggaggctgaggcaggagaatggcatgaacccgggaggcggagcttgcagtgaaccgagatcatgccactactgcactccagcctgggtgacagagtgagactctgtctcaaaaaaaaaaaaaaaaaaaattacactagcatccactcttaccctacctgtaggaagtaccgtgttgctcacgggtgaccccaggaggcttacctttctgttttgtttgtgaaagtttctcccccattttgcttgtgcttccatagcaatgatgctagatgttggctcactttggaaacactcccttcctacaacataaatgtgtgtatgtgtgtgcatgcatgcgtgtgtgtgttgaactgagttacttatgagctgggcttctgcaaaacctgataatcaagggactctgtttccattcagaaatagctgtttttgacagagaaggaaaattgacagatttttccatattcggggattatctagaatatgattcccctcaaatggcccatctttttatcctcaacaatcataggatctgtgacacgtgaagaataagtgttatctggttggtgggtaccagcagtggtgctggtaggaccaaaggggaagagattctgtccaggagtctccttgactggtcagtcctacctgggtccagaaagttgatagccacgatccccattatgatccctgttaaaatccccatgccatggggatgtgttataagcacacatgcaagatgcattacaaacctgatcctaaagccccacaactgcctgataaggtaacagcattatcccagttcttcgcctaaggaaactggagtctagtgaccacacctttttttggttccctgacttagaacctcttaaatattccctcaaggtgtgtttgaatttgttgctttgtaaaggcaacaaagcaggagttaagggaaaccaaagccataccttggaaggaccaaggtatggggttaataaaacacggatgtttcatcatccaggcgtgtaaattacacatgtctggccgtgtgttctcagagtcacatgtgtattttacatgcaagaacaagccagtgggtggtctcgaggcagaacaactcccaggagaactttccatatggactgttttggagacttaagggtcactttgattcaacgcaagtttgtgtgatgcagtgattttagaaactgtagcaagaaggtaaggcttcatggtagttaatgcagaggcatcaccgtgacttgccagaatccttcctgggtggtgtccatggttcctgccacccctcctccctcccagaagtcccaggcttagtctgaatgctcagtctttctgcagctgcccagagtggtcagtgagttacactggaggcttcaaccactgggtttccatagacatggaaatttccattcatggtttctactgacaccgaccccctgggaatgctgaaaacactagaacacagctcttgattcgctcagattttcttatttaagacaaagaaaatttcttgtgcaaaaatcgagtcagtatcattctatctttattctctattctctctctccctctccccatctctgtctcctgtctttattttcttccttatctatccccctttttctctttccctcgctgtttctttcttcttcctttctttgtctcttttcctaacttttttgcatatgtagctgtgtcttttcctgccttctttttctgcactctatccccagctctctagcttccccgcaacacacatacaccacctactatgctatctggcaattcccactggggaactgtggcaagacatcttatcactggggaaggaaattcaagctgaaagaattcacctttttacttaaaatttcttaactctgtgactattcctgttttctacttatgaagtccagcctcctcgccccccattcccctcaggtgtggcagtgaggttaaagtggccacaggctgctgttggagtgagccttcctgctccatgtgggttctataaaatgtgcccttggcacctgttcaatcagacccaatgaggattttggaacagtatgttttctactgtaattacatctcaacagtgaccatttatattattccttgattgcaaataaatttacagtgcttatttttgtgctccctaccttcattgcatttttcaatatatttaatacactttaatcacacagtgggaggtgaggaaatacgggcccctcttgtgaagggaaagagagggtggttgggctcagagctgctttttctttgttacgcatgttgtggttgttttctaattggagagtcatgaacatgtttatggacctgcaaggagaaataagttgatgtgcagggaaggagggcaggaaggggtaaggcactgaggagtacatagccggtgggagccagggactggagttcactttgagcagcaaggaagatagcctcctgcagccaggggaaggaggcaagaaagaggcaaagggagggggcctgtgggtttccaggttggggatgctgaacacggagggcacctgccttctcgcactcttcccctgtgggtcaagcagcaaggtctgctgctgagagaggcaggggtctagagcccactttgcagctttgctgaagcacccagccacctgaggacctgattcaaaaggcgggcccaggttgtacctttctaaccagctcacagctaagctggtccaaagcccacactttgcatagggaggggaaaatggatgacatgccattttttcttcattgtcaagtaagctggagtctgaacacgttctaattggacaaaatggaaaatgcggtgttttaattttctgaggcccattgagacagccccaagggtgacacagctgcctcctttcaagcctctgctcctttgtaggttgatggaacttgaccctggctgtaagaccagaatcaatgtgttgcacctgcatccacttggcacccacaggtataaaatgtatttattgaaaagcagcaggaagtacagaaagcaggaaaaaaaatacctttcttcttttataaaagggattatcagctgctaattcaaaaattgtagggtaatgaaaactacatcaataattttcataataattatagtctttggttttacccttgaatgtttttctggcaacatctgattcaattaccccagaaaatgttactatgctcttccagcattttcctatgatgtttgaatctatgaccaaataagtgataactcttgtcctaggggagcttgtgggctgccgtacacaggcaactgtcatgtagggagacctgacacacacatcttagctggattagtggttctcaaccccagagggttttccacaccccgctgggacacccaacaatgtctgaacacattttttattgtcacagcttggatggtgctaccagcatctagtaggtaagaactaaggatgctgctcagcatctcccaatgcacagggcagcccccacccaatgaacaattatccatcccagaatgtcattagtggcgaggtcgaaagactctaagtgagattaggattacgattagattacaattcgaaaagaaaaagcagggtggattcggtggctaatgcctgttatcttaacattttaggcggctgaggctggaggattgcctaaggccaggagttcaagaccagcctgggcaacatagtgagaccctgtctctataaaaattttaaatatataaaatatattttaaaaatttaaatatatatatagtgtggtgtcacatgcctgcagtcccagctactctgggggctgaggcagaaggctccattgagcccgggaggtcaaggctgcagtgagccatcatcacgcaagtgtattccagcctgggcaacaaagcaagagcctgtctcaaaaaataataaaataaaaatagttgatcagaacacttctggttataagagacccctagctctaagtagtttagataacaaggggactttctattggtaggaatattaggtagtgagagactagggtactgtaacaaaaagttcccaaaagaacaacgtgtatttctttgctcatgaaattccttaaaatgatgttcagtgcaacaaacatcgtttctttatgtattttatttatccattttcattataacaatgtgcattttattgcttatgtgctgggcattcatgtaagcattttataaattatttaatccatcataatcctgtaagggtaggtattattattattaattattcccattttgcagatgagaaaatggagacacggagaggttaaatgacctgccaaaagtcacaaagataacaagatgcagcttcctgtggctttcaacatgaatcactttcctcattggtcttttattttcctctttttttttttttttttttttttttgagatggaatcttgctctgtcacccaggctggagtgcagtagcacaatcttggctcactacaacctctgcctcccaggttcaagaaattctcctgcctcagcctcccaagtagctgggattacaggcgcccactaccatgcctggctaatttttgtatttttagtagagacagggtttcaccatgctggccagctggtctcagactcctgacctcaggtgatctgcctgcttcagcctcccaaagtgctggaattacaggcgtgagccaccacacccatcccataggtcttttttaatgtgacagagtgccactggagtgcgtctctcctcacgcagattttcattatgttactccaccctgtgatgagagcccaggagggacagagaatgctttttaatcctccttatctcattgagcctgattcccaagggaacgattctcatccatttattctccctctgggactcagaaactccatcagccacctctggaaggaatatgcgacgtgctcatgggaattacagtcgggcccaaggggtctatttgaaatgggaatcagtggtgcaaacacagagaatggatttagagcagtttcttctgactaagacatttggaatttaaatgcaaattagaagctgtaagtcaattccgtgtatgaatttatacaaatcccttgtaatgaaagcagaaggtttctcttgtccttgtttgtgctgtggtgttagcatcacgagcctaaccaagtgtgtcaatctccctacagctctggagattagacatgtgctttctccagttagagacggctgtgagtgccatgctgggggtgggattctccatgggctgcaggggtctgtgtagtttctccattaacttcagcaacaccccatggaaattgggaagaaggagggtcctcgtggtttagccaaaggttttgaaagagacaaggctctcattgtaccccctctttactggcccctcatgccattcacaaagcaagccctcattctcaaatattgcctttcctcactcaggagctggaggctgggctctgggaagctgacaggccacggtctcttgtatttgaaaggagcaacccaagggctacatatgggttaacaaatgacttgaatccccagcgcctgcagcctggagtccccatatgacccagcagctccactcctaggtgtaaaccgaagagaatgaaggcataagtcctcccaaaacttgcagatgtgaacattcacagcagcattattccccatagccactaagtggaaacagttccaggtccatcaactgataaatggagaaacaaaacatggtccatccacatgacggaatgctttcagccacacaaaggactgaagtactgatccacgctacagtgtggatgaaccgtgaaaacacgatgttcagtgaaaaaagtcagacagaaatggccatatattgcgcaattccatttctatgaaatgtccagaacagggagatctccggggacagaaagccaattagtggttgccaggggccgggagtgggtgaagaatggggagtggctgctcctgggggtggggcttctgttcgaggtgttaaaaaaattctaaaattgattgtggtggtggttgcacaactctgtgaatgtactggaatccattcatatgtacaatttaaattgatgaattttttggtatgtgaatcatagcgcaataaaactgttagcaaagaaaaaactgcatagcaccatgtctaaagactataggggatgtcacccaaagggtcacctttttaggcagaacttgagctcttgttaaggtttgaaaaatcacaagctgttttttttttttcctccatagctcagaaatcaaaccagattgaggaaaatctttctagggaaaaaaaactcacaaaagctgagaaaattaaaatatatagagctcctagaatcaggaattgtagcttacttttaatatcatcagcactctagcatagttctggtacttaggtgttgaagagttgacaggaaacagaacccaggaggtaaatgaagaatcaatctgttgggaagaggtttagaaaggaagaaatcacttaggaattctcttaccctgctttatttttcttcaaataatccaacaagctgggtatttgattatttatgtatctatgtagcatctcactcccacatagggacaacactcatgacagaaggggcctcctatggtttgtccgctgctgtgtccggcattaagaaaggcgctcagcacggcgtcatcagccataaatatttgtggaatgtacagacaggggattgaaggcttggataggggaatatgtccttggagagtgaaatgaacgagtggctaggaacacacacatgggtgggggaattaacatactgacagggaatgaacaaatgggtggggtaatgaatgcacaaatcagagacttaatacatagtatagacagggatgggcatgtggctaggggatgatggatggaggataaaagtgtggatagaggatgaatgaatcattccagcagagacttgtaggcagccagcatgactgaatttgttccggttctttctatcaggctggtgcaaaagtaattgcagtttttgcaattaaaaatggcaaaaaattgcaattacttttgcaccaacctgatacatctataagcatgtctgggggaagggtccctcctgcaccctcacgtggtggggtttatctgaacattagggtataggccatagttaggaacagcccctgaatttaacagagaaagaccctgaagcaagtaaggcaggtcaggagaccaggatgggcagaggtcctgtataggacaatgtgcaagaaaggacccaacaaggcagctttgcaagatgtcgggatcaggggccaagaggagaagaagcacaagaggtcagacgaagaatcctgcagattgttagccccaggatgaggaaacaggcctgagagtctcatctgtttcatcagagagcaataaaagaaaattaaaatataataatgccaggatgttccaaacagctctttattgctacagaactaccatgcctgtactttcgtctccaggcaaatatactcaaaatagtttcctattgctccactcaccccatcattcgtcccctttctgcattaggcctacgggttaatggatgctgccacctgatccctgcatgatttcccaccaaccctatgactctgggttctggagaggtgaaagagcatctccaggtggctcaaaactgtggctccaggtactactcctccaggcgggctgctccctggggcacgtgttctcagtccaccagtgggccatgccgcatcagcccacctgcttcctggcacatgggatgcacagcccatgaccttggacccagcagtaggcagcatgctttccagttttgaaggcaaggacggaggcatacaaggcactacttgagatcctgtctgatttagaattttgtaggacggattcctgttgttgaacacactgagtgatgagaaacttggcaaatcttgttggcaaatctctcaccttgattccctttggcatcctttgtgtctgtctgatccttccagcctggcctttggatagcaggtacccacttcttaggatgtgccagacaccacggtaagagtttgatctgcacttgttcatttattcaccagaatcacctatggagttagcagtgaccctatccccattttacagataaggaagtaccgaggcttacagaggtgaagttgcttgtgtcagggcacccagctgttgagtgacaaagccagatcctctgaggtggggcactgagcagaggcccgaatggcaagatggtgccagtacatgaagacaagagtctgtcagagagaacgacacaggtagagtcctgcagcttgagcaactgtttacaaacccatggcagagcccatgtgaatgagggagaaaaggcagagatgggcagatcccagaaggcctgggaacccatggaaaaggctctggattttgtaaagtagaagctgttgcagggctgcgaagacagaggaatgtcagctccatgagggcaggaatgtgtgtcttctttgttcagtgaagactcccaaacacccagaatcgagcctggcatgtagcaggtgttcagtggcttcattgaatcaatgaatcatgtttaaatttgtaacaaaatgactctggctgctactatgcagaggacaggttgtagagagaaagtggcaggggggaaaacagaggaggagtcaaacacccctgtaggagataatcaaattacctgagcggagcttctgatggctccaccaaggttggtaggggtgggacacagagaaataggcctattcagcacatattctgcatgcatgcaaccattaccactatctaaggctggaactttttcatcacccgaggggaaactttacacccattaagtggtcattctccattcccacccctcacacccagcccctggcaaccataagtctgttttctgtctgtctgagtttgcctcacagatatttcgtagaaatggaatcatatagtttttaagagttgttgctgatggactggatgtgagaaatgagaaaagagaggaatcaaaagatgactcctgcattttcagccttcacaacatgaataaatggtggtgctctttgccaagaaaagggagaagggggaaagatgagatttgttttggtggagtcgggaggtggaaaggcctctgtttcgatcatgttaagtttgaggtgcctgttagacacccagaagcagatgctggctgtgacttggcacttacaatcctggatacagggcagagtccagggttgggggtgtgagtgtgtgattcctcagtagagaggcagggcatggaagttctcatccaggtgctgactgatgaagagctgccattgcccaagctgggaccagaacccctgagccatgttaagaaaaagtcaaccagatccaggcattgttacccttgaatggtaaaggtgatttagtggaatcttgatcaaggctcctgagccatttcctgtgggaaagtagacatctttgaatgactgcacagagaatcgtggtctttgccactctcccctacagttttggcaatatcacagccaattttagggcacaaacacaaaccattcccagttatcctttgcctgtaataggaataagacagcatggtgtaaggaattacttgattttagaaggcatttcatctctccaagtcaatctttagggatcgacactgctggtggcttatgaatttcagatgtggtacattctgggaatgccagctcttgggctccaggaaaggtgattaaaggacaggctgatgccaacatttatggagaataaaacttgcacttcaggtacagtaaactcagggcactcagttgggcttcactcttccatattcttaggaaagactaaagtcacatgaataagatctcagccctgcatatgtaatggcaaaatgaatgatgtaggctcttcctttgagaaactaacagactgtggatccagctcattgtaaagaaacagccatatgagtgatgtaaagggtattaatccctcaatacaggatcatttatctgtagtaccactccattgctacattgttcctgagccaagtgtcctggccaccatgtctctgggacagtgagtgacattatgaggtcaaacaaggtgtcccccatagaccgtcaagaagacaggctgctgcttttcagggatctctactctgatccccttgggatagcttctaggttcatgagtaggcagaatcccactgagttcctagttcctctttgacccccagagcagcactttagacataaagttcatctatgctcaggatgacagccaaccagtagctccaaagtgttccttgacaatcattttctactttactgaacagcccaccttcctctgcagcagaccgcttctttgctggagaggctgtgggctggggatatggagaacaaactgatgagtgagggatgtgtctgcagaatcagtcagtggaagagatgacctccaggagactgtgatttccttggcaaaggtactgcatttgcttgcttagcaatatctgtgaactccttgccatagaacagcaagaattcgcaacattccctgccagtggcatccttcagcactgccagccacatgtcctcaccagcaaggtcccatgtcctcaccagcaggtcccatatcctcaccagcaaggtcccatatcatcaccaccaggtcccatatcctcaccagcaaggtcccatgtccccaccaccaggtcccatatcctcaccagcaaggtctcatgtcctcaccaccaggtcccatatcctcaccagcaaggtcccatatcctcaccaccaggtcccatgtcctcaccagcaaggtcccatatcctcaccaccaggtgccatgtcctcaccagcaaggtcccatatcctcaccaccaggtgccatatcctcaccagcaaggtctcatgtcctcaccaccaggtcccatgtcctcaccagcaaggtcccatatcctcaccagcaaggtctcatgtcctcaccaccaggtcccatatcctcaccagcaaggtcccatgtcctcaccaccaggtcccgtatcctcaccagcaaggtctcatgtcctcaccaccaggtcccgtatcctcaccagcaaggtcccatatcctcaccagcaaggtcccatgtcctcaccaccaggtcccgtatcctcaccagcaaggtctcatgtcctcaccaccaggtcccgtatcctcagcagcaaggtcccatatcctcaccagcaaggtcccatgtcctcaccaccaggtcccgtatcctcaccagcaaggtcccatgtcctcaccaccaggtcccgtatcctcaccagcaaggtcccatatcctcaccaccaggtcccatgtcctcaccagcaaggtcccatatcctcaccaccaggtcccatgtcctcaccagcaaggtctcatgtcctcaccaccaggtcccatatcctcaccagcaaggtcccatatcctcaccaccaggtcccatatcctcaccagcaaggtctcatgtcctcaccaccaggtcccatgtcctcaccagcaaggtcccatatcctcaccagcaaggtctcatgtcctcaccaccaggtcccatatcctcaccagcaaggtcccatgtcctcaccaccaggtcccgtatcctcaccagcaaggtctcctgtcctcaccaccaggtcccgtatcctcaccagcaaggtcccatatcctcaccagcaaggtcccatgtcctcaccaccaggtcccgtatcctcaccagcaaggtcccatgtcctcaccaccaggtcccatgtcctcaccaccaggtcccatatcctcaccagcaaggttccatgtcctcaccaccaggtcccatatcctcaccagcaaggtcccatgtcctcaccaccaggtcccatatcctcaccaccaggtcccatgtcctcaccagcaaggtcccatgtcctcaccaccaggtcccatatcctcaccaggaaggtcccatatcctcaccaccaggtcccatatcctcaccagcaaggtcccatgtcctcaccaccaggtcccatgtcctcaccagcaaggtctcatgtcctcaccaccaggtcccgtatcctcaccagcaaggtctcatgtcctcaccaccaggtcccatgtcctcaccagcaaggtcccatgtcctcaccaccaggtcccatgtcctcaacaccaggtcccatgtcctcaccagcaaggtcccaacacaagttagaatgtgccatcaggtttcttttatcatttgatcttagaactaaaagggacctcagtggttacctcaagctgttgttctcagcccttggctgttcattagaatcacaggggggtgttttcagaaatacgtatgcctgggccccatccaagaacgatctctgaaagcaggaccccatatcattagtgggtttgttttaaggctttcaggtgttttaatgtgtagtcagggttaagaatgacagctttagtctgatacccttttctcagataagtgaactgggactcagagatcttgcagaatttaccagaaaggtacccatgagttagagcagcagtccacaacctttttttttttttttttttgagatggagtctcactctgtcgcccaggctggagtgcagtggcatgatcttggctcactgcaacctccacctcccgggttcaagcaattctcctgtctcagcctcccaagtagcggggactacaggcacccgccaccacacccagctaatttttgtattttttgtagagacgggatttcgccatattagtcaggctggcctcgaactcctgacctcaggtgatcctcctgcctcggcctcccaaagtgctgagattacactcagaagccaccacgcccagccaatccacaacctttttggcaccaggaactggttttgtggaagacagtttttccacggaccaggattgcggggatggtcttgggaggattcaagcacattacatttattgtgtgtttcatttctattattattacattgtaatatacaatgacataattatacaactaccataatgtagaaccagtgggatccctgagcttgttttcctgcaactagacggttccatctgggggtgatagtagacaatgatagatcatcaagtattagattctcatgaggaatacacaacctaggtccctcgtgtgtgcagttcactatagggtttgtgctcctatgagaatctaatgccaccactgatctgacaggaggtggagctcaggtggtaatatgagcaatggggagcagccgtaaatacagatgaagtttcactggctctcccacagctcacctccttctgtgtggcccggttactaacaggctacagaccagtagtggtggttgggaaccactgagttagaggccaactagaatttgccccacttcattgaattccctactcctttaaatatgcagaattgcataagccaaactccagtgtctttagaaagcagactatgttattgtttcttgaaaagccattcttcctccagattcagatgttggtggtcaaatgagtatctctacagaaaatctctctgcttctccgaattaaactattttcaattatcttgtcagatgaacaaatgtgttttgcattttctttcattttttaaagagagaaactcaagtgaaggagagctactaacgtccaatgaaataaagtatccaagcctgaaattgaagaaaaaaaaatgtaggcatatttgctctttggtttttatttttctgtcaccatctaatgtaatatttatttaatcattcccctaaggcaatgattttcaaactctctttagcagcaaaacttttttttttttttcaaacaaaatcccaggcaggaattctaatatacaaaacagataaaatataattaacagattcctcaggcagtttaaattcttattatttgaaggaaaatgtttgatgccttggtaggactcctgtaccatctcaaacattcttgctggactcagtggctcacacctataattgcagcactttgcgggaccaagacaggaggatcacttgagcccaggcattcgaggccagcctgagcagtatagtgaaaccctgtctctacacaaaatgtaaaaattagcttggcgtggtggcacatacacacccagctactagggatgctgaggcacaaggatcacttgcacttaggaggtcaaggctgcaatgagacgcagtcacaccactgcactccagcctgggtgacagagcgagaccctgtctcaaaaaaaaaaaaaaaaaatcttgttctcaggaacacagtttaagaaccaccgttccactgcatcgttttcctgtcagtcttcagtggccatgtcttttcattttgttttgtagggcaaagacctgctttgttatgcaagcctcttctccgtgaaaatgcatttcatttttagttttgcatatgtgcagttctgtatttggtgtagacagggtcatgtagaggaagagtacagtcactggaaggtggactgtgccaggtgggcatcttcctcaaaagccatggactcagcaccttctgtgtatctgcagccaacacatggaaatatctcataggaaatgaatcagagaagtgtgccctgaggggaagagggagcaattcctgccagggcatgcagtgaatgtttccctttcttgccctttggttcattccccagcacctgtagagccaggaggttgagggatgcttcattttctctctcagtggaatgggacccacagacagctgctgcctaggaacatcattttcctttcaacccaggatcaccctgggtgggtgggtcacatggggcaggacatcagtgagggggacattagtatcagtccaggatcaagaaccacactacctgggatgccaatgggttttggagaggactcttcactcaggacgtttctttcttgttgagatgctattccttattatttttgaactatttccacattcgagttttgcattttctcacctgtttagtaatggtggatggcttcagacatttaactgggaagactctggatgtttagtagacctttctgtcactgtccattaccatagctagtaggtactctctctttgcatgatggagataacatgcaaatccttttagcaaagcatctggcacaaaagagaaacacaaaattgtccgtagaagaaattaatgttagttggaccaagaaaggactttgattatgttttcttaaaaagaatctctgtgttttagactgaaatctttacagatgcaatggcatgtctgggatttgctccaaacagtgcagaatcggggcggggtggctgcggagatgaaccaccaggagcagggagttgaggatctctaaagcctgaagacaggcatgtggggggtattatcctattgtacatgcttttatacatgtttaatatttttcataacaagatgtgaaaaagaaaaaatacttgagaaaacatctatgaaacccaaagcaccatcaaagggaccactcacctgatgagatcagtagacatcttcagagttgttttccccagggcgccattattgcaaggaatagaaacctgctcaaggcagctggagtgaaaatgaggttgttgatgggaacagaggttccaacagacaagaacacagggaacctcggaggattgagagcaggactgggaaaccagtcagcgactgagagcacttcctatttgtcttttgtctttgagtcccagaaaaaaatctcttttgtaaatttttctctcaatttctccattcttttgcttctccatgcatattggatttctctgataatttatccttatccaaatgacaaaaaatggccaccccttgcacaaatgctgggaaacctatatttctcttagttcaaatttatcaaagaaataatcccatttttcatgaatcaactgatggagtggttaccccggagtcaggtaatcagctctgggtccaatcagctatggccaaggaagctaggatcacatgatacaaaatgactccctagtaccactgttttcagcagggactgggggtaggtttaggtccctcaaatgttttatggattatgcaggcaccctgagctatatctactcaaaaccgctaagattttcaggaaagaaatattctaatttgccatttagaaattatataatctctgtcatttggactacagttgagtccactttcctttttcttaggagaaatagagaagaactggttactattctcattgggagactctcaaacacatgtacgttgttttctttctaccttgtgtttttattcttgagacaaaataacccgaaaagttagtgtctacttacagtgctcttactttatgaaagatgtgacattcagcattttggggaagcagagacatgactccgactcttcaggagctcaacaatgggagaggcatgccccaggttgtctgtgtttgagaggcagggaagtctgtgccaagttctttctgttcatggttactggaattctcacctctagcatctgatttctttctttcctgtgtgagctacctcccatgggcattaaaaatcaagtctctgacaccactccgcatcttcaaagaaaacaaatcatttacagaattttaatcagataaagagaggagaaggctgggcacagtggctcatgcctgtaatgccagcaacttgggaggccaaggcaggaagatcacttgagcctaagagtttgagaccagcctgggcaacttagtaggactcccatctctacaaaaaaaaaaaaaaaatttaaattagccagtcatggtggtttaggcctgtggtcccagctaaggcagaaggatcacttgagcctaagaagtcaaggctgcagtgagccgtgatcataacactgcattccagtctaggcaacagagcaagatctgcttcaaaaaaaaaaggagaagaaaaagatgctcaccaatgactaggactatgatgatctggtgggttcctgaatattctttcatctggctcctgtagtcacttcagggcctgactatgccttttctactgtgacgtagctagggaaggacttagtaggttccaatcatcttgaagacttgccagtgaacagaccatagttcttaggcaagcaaccacaggtcccttgagtggctctgttattaatctgttctgagacatcgggctttcttaaaacattgaatgagctttatgtagaactctgtactgtatactgtttaaaatttttatgtaaatatatatcttatgtatattttatataattagtttttatttttatattatatttcatattatatatgtgtgtatatatatatatatagtgcacacaaacatgatgtggaggctgaatgaaaatgttctcatacgttttcttctaagaactttactgtttacatttcacattttgtgtatggtgtgaggtaggggtcaggattcattgttttctgcagatggatatccaattgatctagcaccatttactgaaatgaccgttacctggaaattaaatcatgtcaaaacataaaagcatccataattggccacaggtacagccttggatgtatgacagtgaaggaaatggttttagaagtggtagaaagcaaattgtcagatatgttgtagatgtacagtacctacaaagaaaggggacacccagagggaatactagccctctcacttactgatgtatttttgtgcctagtggagtctccagcatgcaacagacacaacaaatatttattaaaatgaattgttgtatctttccgccatgagataaatcctaatcatagaagaaaaccagatatctaatgccgctttcccttccaaatgtggacatgataggattgacatcatttgcctcatgtctgttgttggagcataacaagaatgagcaagtgtgtgagtgccaggcatacataactgaaaaaaaaaagcttcttccacaccactcgaggaaaataaaatacatatatacataactacattatatggcagactgtgataagagcagaaagagtcacaggggtttaaaccaaattctccaatttcttagtaagaatttcatatgatacagggcaaaatccatcatcattatccttgctaacaaatactgactccttgttatacatatgccaggctatttgccaagctccttaaatgcattatttatatcagtcacagttgctacccattagactattgggaagagccttccaataagctgtatcttttatgtaaacatagactcaaaaatgtttgcaagttatatttctgatggtctctcccctacccttttatcatcacaaatagaaattagtgagaccctataatttttttaagctaagggccagatgactacatcccagcttttcaagttccatattagttctctgtgaaactttagggttaatggctcgtgaacttagtctagtattcaggtcaaacatgcaactagtcaagcatgcaagcttgcatatgtgcagtcctttaaacttgtcctctgtcacttctttcccatctgtgtctttccagccttctgatcattatttccatcttccatgttaatctaaaggtcaactttctgctcttggaggaagaacatgcattcttggtgtataataaaattcaagtccctcttcctacttgtgattgtctttgtggctcatccaggcagcctcatcctgaatgtctatgatgtaagtcaaagaaaagaaaataatcagtcctgaatttggagggaagagatcataagcccagtacatagtcccaacaggccacagtgattgtgtaaaaatacgttttatatcttgtatttgatttgccacacagtttaacagaaaagtaactttatctattttttccaattaaaggtagtaatagtacaatcaataattcctcctgctctagtgtggtaaattaatgtctttctattgtttttaaatcacaaagtgagcattgctatagaaatgtaaaatggtaccatttcattttaatctatttaattttcctttcttgaattatataatggggttaaaacattgaatagaattaatagaatgagtatttaattaaggaataatgagcttctaaatgaatgctcaaagaaactgcttcatagtttatgcagaaatcagataatgggcttaacaaatactataataattgtgttgaatgttttccatatttaaagattttttttttctgtattctctcaggagtagatttaaacgtaacccagttccttgattaggctacactttgctttcatagtaaatcccaaatgccttcccatggcccacagggccctgcataaggtgactctaccacctctggagtctgatgtcatagagttctctctggctctccccttcattccagccacacccagcttgcctttgttctgcaaagccacctttggctcttcccgccacctggcctttgctcttcctctttcagatgccaggtatgttctcacccccttcacctctctaaggcctcctcttctttcagttctcagggaatttttccctgatgatcctctccagactggatcagatacccacctccacacatacacacacacacatacacacacacacacagactccccaagaactgtaattttatttcttgacaattaacacgttgttatacatttctttcccatctgtctctcctttcagcctgtaatctctctgaggaaatatatcatgtctgttttgtttagtggtgtaaccctggatggatggatggatggatggatggatggatggatggatgggtggatggatgaatggaaggatggatggatgatgaatggaaggatggatagatggatgatggatggatggatggatggatggatggatggatggatggataaatagatagatggatggcaggtaaatgccgttgtggacccatccaaggacatatgagggccacaatgcacatctctgagaattcctagcacatcagcccctttccattctacttgaattcatttgcccacacactaaaaaggtattctataccagccccttcagcaggtgctgcagacataaaactatcagtgtcatggaagaagctgcacaggtttgtctcacttatacatggcctaaatattaattttattaattcattcatccacccatccacccacctacccatccatccatccaccacccacccatccatccacccatccgtctatccatctatctgtccacccatccatccatccgtcccatcttcagacctgctcatgtgttgggcactgtgctgtttactaaggatcagggctgagtcatccattaggcaccattatcacagtgctaggaccctaaaatcgaaagaaataaaaagaacttttagggtaaaataaatttttaattcttttcttcacatcacaaaaataattttttctgagacagggtcttgctctgtcacccaggctggagtgcagtggtgtaatcatagctcactgcagcctcaaactcctacactcaagagatcgtcccacctcagcctcctgagtatgtgggacgacaggcacgtgccaccacacctggctaattttttacatttttttttagagagatgggaatctcactatgttgcccaggctcatcttgaattcctgggctcaagtgatcctcccacctcagcctcccaaagagctaggattacagtgttagaataccatgcccagcccccaaaataaattttttaaagcacattactctattatgataggaggggttgatgaaggcaaaggtgactggggtccaccagccatgacgcagctctgctggagcacagggaagatcagtccatccctggtcttctggaacactcaggcaagtggcagaatcaggtgtcagtcaacaagtcagtccctcttagtcttgcttctgtatggctttgtcccttcacattccctcaggcctcacctctgctgccagatcccacttcctatacttaagatcattcattcattcaacaaatatctactgagtttcttctgtgcacctagcaccatgcaagagactggagataaagccatgaagagacaggtgcacatagagcctccagcctcctcaaatcatgatttctcacagtgttttcatcttggcaatgacactcatctgctttgacagagcaacttctcacttatgcactggacatgacagcgtttctacctgactggtggttcccagcatcctctagccttagcccatttcatgcccacatgattgatacctggttttctaaggtacaggtgtcagaagaaccacaaggacgggttatgagctgacatccactttgataagcaggggcagagaaccagtcctttggctctggaccgcagcaagagggtgaaggaaggactggcctaagccatggggatctaaggtgggcaggagtggcagagcaaagattactggaaaccaggagacttaggtctgatctttgggtcactaaacgactttgggcagcactcttccttcttccttccttccttctctgtgcaatcatcttcatctgtaatatgaagggattagatcacacatgtgtcaccaagccccctcctgactacatggcaggtagcattaattgatcacagcattctttcctgctgagcccagatgtactgcaggcctgtccacaccaggctcaggcagcttcacccattcacaagggtaggtcatgtcattgacacctgcctgccgtccttagactgggactctatcctgcttcttgccccgactacatattggaattatctaggcaggtgaataaaatgctgagtcctaggctttaccccagagcctggggaatctgaattgatctggggagtctgaatctgaattgattccctgactgatgcctgattctgccacttgactgcttgtcccagaagaccagagatggactgatctcccatgcgctccaacctggctagaggaccccgggcagtttctctttcatcagcccctccaaccataataaccataatagattttcatgcgctttaaccctggggaatcctgaattggaataggactcgggaagtttttcaaagcctctgggagattctaatgtgcagacagggctgagaaccgttagtatagttttcttgctcaagaattctatgatttttgtgagaagagaagatagaagataggtagacattaaacaagaatcacacgaatcagatcaaaataattgcaccctggagttgtttctgtgttacagcagcctcagtatcccttctcattcccactattttctagcctccatgcatgttctaagaattttccagctctccttttatggaagacaactcgcccaggtttgccgaggcgcaataaacaaattagttgcagtccccgccctgtcccctgagaggcctcaggattaaggtttatgattaatgatttccaagtcaattaatcagccactgcttttgaaacctcatttctcaaattacttttctttgaacacaagggctttttgatatcaccttactgtctctagattcactttcctactaattgaaattccaagatatttcttctttttgtcagcttattggtgttacttgtttataaaatatttgcaaacacattactattcacctgtagtgtgtcagaggtaagcaccaaaacaatactttatgctttcggctcaaaggaatgtgctaatgaaagctcatgaaattctctatctatgagaaagttgatttttcatttattgatttattttcaccacacctacttgaaacaagaatttgagatgtattacaatagaaacacaggtacatcaaggctccaaacaattcatgtagatgatttcttagaaaatggtttctaagatcatattaaaactggatatggagtgggaaggatgggattggttttcttcattagggaaaatagcagtatctagcagaggatctggggtcaaatcccagtctctccacttacaagtcttaacgcttgactcatctgattatgttgttattttggggaggcaaggctgcgagaacaaatgcaaacaaaaatggcttgaactcaatgaaaatttgtttctcattcaatgatagttcaggacaggtgttcttggccaccaggttgctcccctccatgtggtgactcagggacacaagctcctccttccttgtagctccctgcttccctggggttttgtggtcctctgcattcaggtaggcagagggtgaaaaagcacagagaggaggcacagctgttcttttcaccctcccaccacagagcagcacagcacagccatggtcagtatcattgctgcccacattctgcaggagagaagttagtctcgtggcctcacctaagttcaaggaaagctgagaagaagagcatagtatcttccaaccgtaatcctcttatgttattatttatttttaagtgagatgatgtgtgtaacatacccaatgcaaagcatgtagtaaatgactatgtgttttcaaaatagtgaccattaccatctgctttgtttgcagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaagtaagggtgcttccaattgcctctttctcctcatgcgagcacggagggccccatgaggcagctcatagaatcattgagtttagaaggccacagataaattcccccagtctcctccttctgggaattaacaaaggaaaaggctcatggcttaagggtgcactcgtatcctcagcagcataaacaagcagccataaaacaaacctgttttataggttctaaaatacccaaacttatgtgtaactttaagaaaaccaaacttaagtgcattttttattttgttttcatttttgttttttgagacagtctcactctgtcacctaggctggggtgcagtggtgtgatctcagctcactgcaatctccgcctcctaggttcaagtgattctcgtgcctcagcctcctgagtagctgggattacagctgcctgccaccatgtccggccagtttttgtatttttagtagagatgaggtctcaccatgttgcccaggcttgtctcaaactcctggcctcaagtgatccacctgccctggcctcccaaaatgctggagttacaagtgtgagccaccatgcctggcccaaacttaagttttaaatgaaattctttatacatttgctaaggaattattaacagatatgccaaaatgagatgtgtgaaggtgtttttagagatctgtgctcaaaacgtgggctacgacatgacttcttaatcttccttagtgagctcaattattccttaaaaacacacacaacatagttattggtgtgaaaccctctgtgacccttgctaactcacacactgaccctctctatggcaacaagtagaacaaggaggaaatgtaattataaatgtaaaacctctagctcatgctggtaatccagaaatattagtgggggtggtagcacagaaggcttgctacaggtggccttggtattctgggagaaggcatttctacacagtttcactctttctgggaagttctggggagagtttctgccagagaccaggaccttcatgggaacacattttcttttctagtggatgaagccatttgcctgagcagcagggatcaattgtatttatagtgatagtaccagtgggcagagcagggaaatggctgcccactccctgtgtgcccttggccaagacacccatgttttctgtgcaccagtttcctcatctgtaaaatgagaatgttaatgtaacctccctcttagggttgttgttgtaatccattgagttgttataatgaagtactgtaggctggtggcttataaaccacagacatccatttctcacagttctggagcttaaaaagtccaatatcaaccttccagtagattctgtgtctagtgaggacccactttttgatagatgtccatcttcttctctctctatcctcacatggtagatagagtgaggcagctctctggattctcttttttttttttttttttttttttttttttttttgagacagagtcttgctctctcaccaggctggagtgcagtggcctgatcttggctcactgcaacctccacctcctgggttcaagtgattctcctgcctcagtctcccgagtagctgggattacaggtgcatgccaccacacccagctaacttttgtattttcaatagagacggggtctcaccaggttggccaggctggtcttgaactcctgacttcaagtgatctgcccgccttggcctcccaaagtgctgggattacagatatgagccactgcaccctgccaaatcctgttttgctcatatctattttccttgagctgtagcaaacacattttggggaggcctgagctccaggatatgtgatggagatgtctatttacccaagttttatcttccaaacttcaggtctggaaaattgtctgacagattttatagactcaggactagccacggaggacagccagtggctatgtcattctatgacttttacagcttcgaaagtgcaacagccatggacacagagggccagtgccagggtttcctaataactttgccattgcccaatacattagtgcttttatgtacttcgtgcattactgctagtccccatgaataatatacagtactataattgcttattcatacatagtacattcatatataggagtacattacaaacctagtctacatacacataagcacgtattaacaatcccttaattaactatcgcacatctactgttgtcaagtacacaataaaacctaatccatacgaatactgacccgtactagaaatccttaatattacgtagtacatacattcgttcatcggacatagcacattgcagtcaagaaatctcttgccaacatggatatcccctaccaaattttggcctctgaatctaccaatctccgagaaatcatccccgctcaggagtactaccctcctcgctccagacctataacacttgggggtgactattctgaaactatacctggcatctggctcttacttcagacccataacattaagatcacccacatgttacccttaaattaagacatctcgatggactagtgactaccagcctattaaccaaccttggcaacagagtgagactctgtctcaaaataacaacaacgaaaaaagaaaaaaaagaaaaaccagacttgcaggaaggagccattctcctctccctacattcctgtgctggtccacaatgcagtggctctcaaatgctagcatatataagaatcatctgcaatgttagttaaaatgcagatttctgggcttgccccagacctgctgtgtcagaatatgagagagaggtgtgccaggtggttctgttgttcacagggcacaccacttgtcaaggggcatggccttaggggaagcagtttccatcagcttgtccgccctccctgcaaattccaggggaagaggtgcccacagaggctgatgctcttgctgacttcagctttgctagtgagtggactttctttgctttggaattgggatgcagactctccctcaccccacattggctgcctcccaggtcagtaggaagggccttgagttctatctgtctctcagcacatgtgaggcagagccccagaacaccttctagaagccagctaggccatgctctctgctgctgtccactgtgccagccactggtgcaaccatcagggatgcattctgttgcaagtaacagaatgttagactaatagtggcttaactaatgaagggaatttaagaatttttataactagatgaaggtaggccagtccaggattggccaacagttccaggtggcagagagccagcagtggggtgcctcagatgcttttgacattttcctcttggacataaagtagctgccaaagccccaggcatcatatcttcccatgatgctgcatcctaatgcaggaaacaaggaggcagccaggcaaatgagagaaggtgctcttatgagaccctctcctcttatcggggcagaaaacatcctttctaagggtcccccggccaatttcccgtgatgtttcattgaccaatgacatacgttcttccttaacttcaaggaaagctgagaaagtccaaatctggcctttgggcctttacagtgcataaggcagaggggggctggtgattgctgttgggcagtcaagcacaagcaggtctgccctaaccagttagcaatccaacatacagaagaactatttggagtctcaggatgctgctggtttccagcaaggtcctgccacttaaaaggaccaaatcccagtggctctgacagatgagtgtcggcttcgtctttaaaaccttcagatcagaagcacccttagctgctttctaaaccgattctaaaaccaccagaaagttattctttcagctgaatataatcaaccctacattttaagtttattttctattctgtcctcaaagaaggtagtatccagaaagcatccgttattccccaaacctttcacaggcctaaacatagctattcattcagttctggatcctccctcttccagccaacaaacccaggtcctccatccttcccatgtgggtcaacttttccaggctttaaatttcccagggcagtggtttacaccctctcttgtcacttgaaaaaatattaattgaattgcctctctgtagcttccatcaggagtattttcaatttcctcctgtccctgacacagaggcccagcaacagacaaagcacattagtaagattgtgtgctttgtgagatcttggagggcttcttaatccaattacagcactccgaggggattaggaacagagacccatgtgtcagcagctccaggtggtctggccctgggcatcatacagctggagttagtagatcccaccttaggcaaatggaaataaacattagcatggccctgctcccttcctaaggccagcctcacattgtatggctccctccctcgctgctcccctccctctgtggcttcctgcatggcatagttcctctgaagccagcgttccgttcagggagtgtcagcctgggaacataggagaaacactggggccggggaaatgactcttgcagctcttgcttccccactcttcttcctcaccatcttaacagcttcttgttattgataccaacaccaggcctagctccatgggaaatattcaacattcatcctgtccgctgatctttacaacaatcctctgtactaggattttattgaagagacagctgagacttcaggggaggcagtgacttgctggtggtcccagagttatgatgcatcagggccaggacttgactgccacccatctttctatctaataaaaaaatagggaatttaaaaggcagaaatatccaagaatgttagatttttgcacaatcaaaataatagataattgtgttgcacaagtctagtgctagagaaaagcacaagaattacagtcaattcattcattcattcattcattcatgcaatatttatttagagcccactatggtcctgacactgtgctaggtgctgtgtattcactggtgaaagaaatggtctctgtctgcagcctcccaggcagcttatagttataagagcaagaacttttgctgcaaataatgacatccccaggaaagaaggagaggaggagggagggagggaattgtctccttgggaaaaaacaaccagttgtccccagccgaggaaaaggagctgagcggcacaaattggttatttccaagcattttgactgtctcacttgtcagcagatggctggattccccagaaaccccactatcctcctgcttgtgcatacgtctccggctgtggagaatcagatgtcagaccaaactaggccaagattgtgattagtgctggtgtggggtggaaatggcccttgggggactggggtgctctgcatctcactgctgttcagagggcccaccctcagcgtcgtcatggcccagcaagccaaaggctctgtcccctccaggatcctaattgagatgaatagctgtattttccaagcatggcagctccctggccctggtttgaggtttactttaccgaagttgcacattctggcatcacttgggatggacagagatccattattaggatccatagaaagaaggatagaatggtgaattactgctgtgttacaaggattgaaccgacacatcactgtgcagccactcagcactaagagctttgcatctgttaactcttaaaatcctattactgaccctgctgggagttgttctaggtgaagagaggaagtccagttacaaccaggaagcatctccagtgtgtgtatgtgggcacacactctcccatgtgtggcgtgcttagcactgaatacatgtcagccgtaattattatgaaagtgactttatttgcctaaagacactctgacccaacctgccagattccattcccacctcggtgccagctctttccccagcatcaacggtccttatctctgctttcattttcccatgtccactgcaacctctacaactgttgttgcttacttttagttgagtgtaaatcaaatctcttgacttatttagtcttgtccttcttgcaagaatacccattacggcatgggtctgatgggttagctgtttgttccagtaagcattaggaacttgatagaagcagtatgccctcatcttacctaaatgtctccccatgcaccgctgacagagacccactctgggaaatgctgcacccaccacatcatgtgctctcgtggttgggaaagagagtgacagacactcaattggcagcgccattgtattaccaatgtttatcatggagtttctttgacatcctctggtttagtccacacagtggctgggggaggtagatactatcagccccctttgcaaaatcacctagagtggtcctcatcaacgctgcccattgacactggggtaggacaatccaccattgtgtgggactgtcctgggcatggccttgagtctagtattgctgtcccccgcccggcaaatggttgtagagccctcgagtcaattgaaaatgctcccatacattttcacatgccctcagttgggccagggcccagcggcttaactccatgtggctcagactttcaaatccttttccctacatcatactctactagaaaccatgcacccaggctatacttgaagggacatagagaccctttaacttcatggcaagtgagtgagaaacattaaatataaaactttggttttcctgttccatttgatccactgtgatcacagaggcagggttatcttgctataaagctactgaggattgggcgttggagtctcatttaccagagcccccgtgggtgtcgggggtacggagttacaggttccaggcagggaggctttaggcatcaccattgccagggagttgcctaacgatatctcagagggaggctcactaaggttcaagtcactcactgcccagatcactaaggttcaagtcactcagtgtccggatcactaaggctcaagtcatgtgttgtcattcatttcttaatcaaaaacacaaaaacaaaaaaaaaccaacatccatacttaatctcacattttcatgtttcatattctttatcttaaagatagccccccagttacacaggcttagcctccaaagcccagctccatccctgaaggcccactgttgctcgtggaatttcagaggaagttgatgcaaaccacctgccttttgtggctggtgtgcatcctgagacccttctgtctgctttccagccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtgggtgagtggctccggaaccacagacgggaggtgggcaggaatggcttttcctttccagtcgcagaagctggttgtcaggagcagacaccattaaattaaacttgttaacaatctcagcaagtgggaggaaagcgtcatagagaggaggttgtggctgacggctgcagagggccaggctctttggtgaggatgctgctcccacctgattccagcctgggagaagagtagcttcagtgctgtgttcccaaatgaccagccgggtctgctggccctgagcacagtccttgaacggagagagaagggagccactctgggtgacctcctgcatctcagaaacttgcctactttgtcatcagcactgctttatgacaaaggttttgctaactccgtttacagatacaggtattgtggattcgcagattcgtagaggttcggtacttgctcaagcagcccagcttggtggtagaggaatcaggatggaaacaggacactctgcaaagttcatgctccttctagctgctcaatgctcactgactctgagctgccagaaggggaaggagcaaagtcacttcctggtgcttggaaatagaccattgggattggcgttctgcctgatgaggggcaggcaaaaattaataataataatgtcttcagaaatttctgtcttcatttcttaagctctgcccagtgcttagatagaaagcattttcgtaatgagatttaattaaatggtcgctatccacccgtggtgcatctaatgctcacaaataaaagatgccctcgttggtacatggtttcacaataaacttaaatcagcgtgcagatccaaatgcacgcctgtctctgcagaagaaagttattaatgttcctcctccaaaatctaatcttcttctcatatgaggtacaaataatcaagtattggacacacttaaaacgaacatgtgtctgattttcctgatttgaaacacctgaaaatgtgcaacagggactgagtcaaccactttactttagagcaagccggtggagaagaagcagaagttattttccaacaccaaaagtggatttatttttacggctaagctttctgaatgccagatgaactagacaagcgtgtgaaataataccaaatcctataataatgtgaatctgaaatagccattcttttttttcttgttgctatctgacaatggaaacatgcaatttaaacatcaaagagagagtctttcttaagtacttagatgggaaaactcgtagcttaacagactacaaggtagttggacaaaggtaggatgtctccaggtgagcttaagtgtcatcttgtatttctacaattggaggtgaaagcagggaccctggaggcaataaaatgagttaaatcaggttgatgttttggaccctgtgtctctgccattgctgggacaacttgggatgctgccagtcatgaaagagctaatgcaatgggtaggggtggatggaggtgtctgggacccaggactagatgtcctactaagatgggacagacagtgggagaggaaggtcaggctgggttgtttgattaagaccagctctgctgacttgggcaaagaaagaacgtgctggaggaccctatggatactatatacgatggaggaatatctgaagaacccgctcgagatagcacaggagctagggcatccttcaggctctaggtcacaggaacagacagacttgcagttcaggatctcacagtgagaataaaccagctccagctgttttccattctagtgtcactcggcccatggtcacattcccagggcagctctgccttgctggagctggggtcatgcacctccctgctccaggcaccttggctagtgatcaaccgggatgatgttcccagatacacagcacagagggccgctgactgagaaggagggatgaacatcctgtctggcaaatgaagcttactgctgggagtatggaggcagcccataggtgcagtcccagcaaactgagttaggaacaggattccagcctggggagggaggggtgcctgggagagctgagacattaaggaacatccaggccaagatttgagccatggggagcaaaggtcaccttactattaaacagcacaggcagataagggacttcatcctaccgctgtgtgagagaagaaggaggtcagagaaagcaacctagaaatgacttgaggtggcacctgtggggagaagctggaacgcagaaagttctgaggatcttcctgtttctctagccagtgtaatcatcacagctttggccttccatcacaaatgactagtacccaactcacagtgacttatgccaaaaggggtcctgcttacttgcataggtcagcgcacctaatggaaaagtccatgggaacaaaggcctccagcatgatggaattcaggtgctcagaacatattccttctctatatctggctctgctctcccctgggttgtctccatcctcagccatatttgcacatctgtagagggaagagggaagaggcaccagcaaacacctctccttgatcctaccagaggaaagcaacatcttccttcctaatcaatagcccagcccaaggcccaggttgagtcacaagcacaactctctgaaccaagcagaagatgagcaggacagattgtgccacgagtcctggtgcctgagcctgccacagaccccagcacccagctgtgagggcctgcaggggcggctacccgaggaagtgcgggaggctagtcccagaggatgggaacaaatgctgtgtaatcaggaaccacagagagcccctggcccaaaggtgaaccttgtgaaccccacagaaaatagagctgcagtgtgtctctgcagctggtctaagagttctagcatttacagattggcctagctgagtgatggcaggaccaatccctttcccagccgtggagcaaagtaaatgtgtgtgtgcatgtgcatatgtgtgtgctgcacacatttctctctctggcctcactcctcaggcatattccttcctgctgggagccacagcggcccacacgtgactctttctcagcctggcactggctggacaccccctttcccctcctccgttcttctccccttcactccctcctacccacctttccctcctttctctttcttcccctccacccctctcctctcctggagtaaagtcgggataacatcaccgacaggttgagctattgtcatgggagctctttgggaaaaagaggctcattaattatttgcagcctttgatcctgcacactgagaagtgctctcccttggggcctgtgtgtgcagaggaggagtggggctgcagagaggggccaggatgggagacacttttctaatctaatcatctgcgctgggctaccccggcttctcagacagatgcaacggccttccaagttgtgatgttactgctgttgtgatgattcttcagggagcaggcactggaagaagaaacttagctggaaaagaactcttccttcttctcctcctcctcctccacaaaacaggaatcaggtgtctcctgataacattttagtatctctaatatctttttcttcttcttccttgtgttgactgctgatgtgatacctctgttcttgtcttcttagtttaaaagaatttaaacaagagacacacaccaaaagaagtgcagcatagagtaatctactgcaacagaaaaagaatatgttgaaagttaggtgcagaatagcagtatcctctgagagagatgattccgggcaggctgctcacaacaatgaggcagcaaagacccacaccagggaggctcccttctgggagtcttccatgattattcataaggaggtgggaagaggcgttactaggaagctgttctgggtggtcttccgggtgcacatgtgcagcagctgtacaaggtcgttcataagtcgcatgtctctttagcatctaaaatctccacccagggctgtgtttttcacaattatgatgagcagagtcagtttgaggacaggtaaaattaaaatgtgcatgttctgtagaggggaaagtcgccactgaagacagctttgcttgaatgagctcactgactgtgcgcatcctgagattgactgtgttggctgtgcggtcaccacagttgctgctgtgtcccgagaacacggtcacttccttaactacctatccggcctcactcctcctccttcctctgtctctttgcctgtctgtctctctgctgctctgtctctttttctctccccaccccaccatctctgtcttttctgacattccctgtgactcagctccaacaaccccatctcatgtcacattagtcaccaggccctcgaaactaaaagcccccatgagagaccgggaccctgagatcctgcagcagggcctgcccatcctaatggccactgtcacctcctccctgagggggctccttccatggtcaacatgggaagccttctccccaaccccaaccccactgaaacttaggaacgcacttccagctaagtccaactcctgggccacgtcctgcctcgcatgaggaaatgcacttctcaggcaccactgctcctcggctgaccgcggccagacaccctttcatctccccagggaatgctcaagtcagcaaagggcgccttgatctccaaggaacctgtgactacaaagacaaggggtgtccaaacatcagagggaatcttctcactaaaaagcctgggttattaagacttgttaaaaagcccttcacattgtgttgttagtcaaatcaaaatgaacagcagtggtctagtgacagatgaaattcttctttttaatgacttttatcttcttatccttattataaagttaagatagtttctggaagaaacttttgaaaagacaggtaagaataaggaagataataaagtatctgtcatcatctcagacaaggaaatcccttttccacagcttggatctgtctccctcaatcacgtatgtgagtattctgtttttcattaccaaaattggcttgcattatccaccctcaaacctcaccatttttatttcccagtatacgctgaacagctttctgtcccaagaaatagccattatttttcgtcgctgaatagtgtgctattattccattacagggatatactcatctgtttatttattcccttgttgttgactatttacattgtttacacttgtttgcagttttttaaaacattagtgggtatgcttatagtgaaattgtttaatgcatcattaatatcctgaagacaagtccctgaaaatactttggttgagcaaaagtattactgtgtattgttaatgttttttggcatatacagaattctttgtttttatgtctaggcagtcaaatttatattttccatcatttctaaattgatgtcacagtttagaaagtccttctcctctccaagatcatgtacatcaggttctaaaacagatcaggttcccactctgtcgtctccaggtgagatgatgataagacttgcttccactttcagcgtagcaaccgttcctccaggtgcacaaggtaaaatatcctgatgatattcgagtatctctaatgaggagaggacttatgtaactgaacttgttagaaagagtaacccaggctgggcacagtggctcacacctgtaatcccaatattttgggatgctgaggcaggtggatcacttgagatcaggagttcgagaccagcctggccaacatgacgaaacgccatctctactaaaaatacaaaaattagctgggcatggtggtgtacccctgtaatcccaggtacttgggaggctgaggcaggagaatttcttgaacctgttaaacctgggaggcagaagttacagtgagcagagatggtgcaactgcactccagtgtgagcaataaagcgtgactccatcacaaaaaaaaaaagtagccgaaagataattatgcaaaatggaagtaactacatttgctaaaccttctcctacagtgaaatgaaacatgggaactaacgcttccatcagatccctgatttggttacattagggaggcagccggcagctaaatccttctgaatagctgggaggactcacttctttctctctacaatcaagggcaaccaagtagcaattcctattccaaacatttttcagacagaactcatcttgcccaggatctatagtaaacaattccacagcagagacttctgcctacactttgaatatagaagatatgtgttgaagaaaaatattgttcctacccatgtaaaatttcatatcactgctcaacacttttttttggaaagggtcattcatccagggagccctgcgagtatatgtcaagcattttatctgtggggactaagtttggctgaacataacaggaaaattcaaaatgacagtggctcagagcagacggaagttgattttttttttctcacataaagtaggtctagagcaggcatgacagttcagggacagtggcagccccacacggccccacacagggttctacttgctcactattttaccacgtctaggctggcaccctcttcctcatggtctgttatggttgctagtgctccaaccttcatatctgcattccagacagcaggatgggaaatggagaaagaagagggatactccctctcttttaaggagactttctggaagtcatccacatttttatttaaattttattggccaaaattggtcacagggccatacctagctgcaagggattatgggaagtatggtcatttgactgggaagcaatgtgcattgttttttaaaccaaggttcttcactaaggaagaaaggaagaatggatagtgtaaggtagatggcactttctgccatgaatgcctttttaaatggaacctttctgcttaataaataactacagggtacattttaaaagggaaaaatatcccatgatactagatatttgcataatcaaaataatagatgatgttgctaaagactagtgctagagaagagcatatggattacagcaattcattcattcatgccatggtatttatgtagagcccactgtgggcctgacgctgtgctaggtgctgtaaattcactggtgaaagaaatagtctctgtctgcagcctcccagggagcttatcgtcataagagcaagaacttttgctgcaaatgatggtgtccctataaaggaagaaagaaagggagagaggaagggaagaaggaatgaaataaattgcttccttgggaactaagaaccaatgatcccaagtcgagaagaaggagcagagtggcacaaattgcttcttcccctgcaccatgcccggctgactttcagcagatggctggattccgccagaaaccctgctttcgtcctgcctgtgcacaggcctctgcctctagggaatagggtgccagaccaaactaggccaagattttcacaacgccctgcagacatgggttttgagaatgatggtaataatatggctactaggatgattaaaatacctaacatttttatgtagaactttaccaaaagcactgttaccagtcttcttgtattttcataaccaccctgtaaatgagaacatcttgttctccctttttactgatgaggagagagaacctccctgagccgtggttaaaggaggaaagcacacaagcagggtttacagaggctgagttaatgtgaatcagaacgccggagcttcctccgtaccactgcgcctactgctgatgttggcttaaggctttttgaacatgtcttagtgtaacttcaccaagcttcacacttcctcaatccttgacatcattgtccatcttcccacgagactttgtgctcagggagagtaacaatcatctttatctccttccctaatgagccaccagagcttcctcagtaccattgagttagttaagcactttaggcacaggactaagaccttcagactttccacgggcctacaaaaatgtcagggacctgaatacatagtctattgactccaaaattcaaaaagaaagcagcaaaattgaaattaataaatatcaactgcccacggcatcatgacaactttagcaggctaaacctaatatttgcaaaagtgtctttacatttgcaaactatttgtagctctcaccttgcaagaacggtggataaattataagtgattattagcagaatatttcttatggcacagtaattccaaaagcaaaagtataaaaataatttcaaacatgtgataggaaaaaaatgtatttttagtgtgggtacattttagtacatttgatacagtttggggtgaggccaccaaagacagagaaaaatttttaagggctcaaatgtctggaaacagcccaatcccagcataaggactggtgcatgaccagtgctcagtaaccaggtggaatagattaatggcagctgggttgggggtgactgcatgcacacatttttctgcattaagtagacatgggttgaccgaatgcggtggctcatgctttgtaatcccagcacttcgggaggccaaggtgggcagatcatttgaggttaggaattcaagaacagcctgaccaacatggtgaaaccccatctgtactaaaaatacaaaaaaagttagccaggcatggtggtgcttgcctgtagtcccagctactagggaggctgaggcaggagaatcacttgaacctgggaggtggaggttgcagtgagccaagatcgtgccactgccctccaacctgggtgacagagtgagacttcgtctagaaaaaaaaaatgtagacatagcttgcattagtccattctcaaattgctacacagaaatgcctgagactgggtaatttataaagaaaatgatttaattgtctcatggctctgcaggctatataggaagcatggcagcatccactcagcttttggggaggcctcaggaaacttaaaatcgtggcagaagacaaacagggagccagcacttcacatgtccagagtagctgggccgaggtgctacacacttttaaacaaccagatcacgcaagaactcactatcccgaagacgccaccaaggagggattgcgttaactcccctgatcccatcgcctcccaccaggctccaacattggagattatatttcagtatgagatttgggtgaggccacaaatccaaaccacatcataggttttgttttcttttaatcttcaaacattgactaatgtctaccaaccatgaaaacatttacatttggccttgttttaaaccaatcccaggaagggtagccagtgctagcagggagactttagaaggatgtgcaggtctctcacagaactttccaagtccatgaaagttacattgaagagccattgccgtcagccaacccttcttccgaagccttgatccaaattgagcctattctttgaacacagaatatctgaatcagatccaaattagatactcatctctttgaaaactacaactgctttgtcctgatttctttggggctctgtcttttttaagtcgtttccttcctcctcatctttctgacctggatgctttttaactttacagtagaattcattcatgcattcaaactggtaaagaatacaacatagaataatgatatttcagccccaaaagatttgttaaaatgcccaatttccatttttactggtcttcccatgattcatcaagtccttttctttaacaccttgtttaatctaatattggagctcattcaaaggaaatcacaaaaaatgttgggaaattaagcaaaaaccatcattgactggcgatgggacattttattctgtatcttctaagacctttggaagaaaaaggcaaaaatcagctctcttgaaaatgcaaattttgtcatcactggcattctcagaaacacaggggttcaaaaatatgtagtagcctaccatttattgggaggaaggaggatttctaatcccaaaaccaggtttcaaaaccagatttaagagtttaaattggggtgactcccaccttttaaattttaatcagaagttaaaggccaaattgtaacatttctacctggggaaattaagagaaggccttcatcttctaaactatattattaacacttcatcttaattaaatgtggttactgacctcaataacaggatctgggatgaggtcatttttttggttcttgtttttaatgagttaagatttttttcttttttaagtcaacaaacacagagtttgaaatgtaaatggattgtttacagtggtgtctttgtaatttttaattaaagcggtgttgttccattgtaagtttatggtagcaatacattttattgcctattctgctgtggaatttttaattatttatgcaaatatattagcacagatgactcttgtttttagtggtcagatgttctgttatgaagatgctgggggaaacaaagcctcacaaattaaactatgggatttttaaagttttaagggcttcactggctaaaaatagaatcctggcttttataatgatccagagactgaagattttcattattcatgtcaattaaaggtgctcagtttggctaatatgaaacatctggccgtttgggtaaatggatgaaaggctattttacaaatcgaccacctttttaacatccatctacatatgttgttataaatttgccataggccagactttcattattgaaaacatggtttcaaattggctatatttgaatataattatcagggtccttcttgtcagccttagaaattaatcctcagaaccaatatagaaaatattgacaaatgttaatattgttccttgaccaatattttctaagctgttaaatctacttagctttttttttaataaacccatttgaaatagataaggattgctatataagctactaacatagcactgattgaaaaagccacacatttcaggattgcaacagaagtcagttgcatagggaaaatagctgatttattatctgagtttgtctatcaatcactaacaccagtcagccagcaagcacgaggagcttatcatggcattaaccctaacacgggtaatgaaaccacaggcagtgagtcatgtaactaattcaagaaatgcatttcatcatctgctcccaatctgctttccaaatgaatctcaaagcttgtattttcaagtgatgaggctctaaactacagtcctcctacaaatgcttaatttggggatttcctcatgcattccaatagcgttggcaggaatctcactagaagatccgaccttatatggctgcttctaagtattcttgggtccctgagtgtaggctgcacatgtgaaaggaggacctggggatttggattagggctatgaccggaaaacctctctctccattcattcatcccacacctgcaacatactgggtgcttttctaggcattgggggataaagtagccccagaaacaattaaaaatatctgttggccgggagcagtggctcacaccggcaatcccagcactttgggaggccaaggtgggtggatcacctgaggtcaggaatttgagaccagcctgaccaacatggtgaaaccccatctctactaaaaatacaaaattagccgggcgcctgtaatcccagctacttgggaggctgaggcagaagaaccacttgaacccgggaggcggagatggtggtgagccaagatcacgccactgcactccagcctaggcaacaagagcaaaaactccgtctcaaaaaaaagaaaaagaaatctgttatcatcgaaatcatattcctgtggaagagagaaaatgaatgagagaattaataaatacaataagtagcatagtaactggtgattaatgcaaagaaaggaagcagagaaggaaggaggggagccatcactctagatagagggtcagcagaagcctcaccagtgctgtgatgcttcagtgaagaattggaggaagtggaggtgagccacacagctatcccgggtggagaggtccaggtagaggaagcaagtgggaaggccccgaggcagagtgtgcaggattgtgcccagcgcacagcaagttgggggatggtgggaaatgaggccgatgctccggagaagatggggaaagtgttaagcatgctagtgggattaggaaagggggcaattaagggaaagggagacagaggcagagcagaggactggagtgtagggtagccatagtaatccaggtaagaggccatatgggtctgggcagggatggttgcagtgcaggcagtgagaagctgcagacactgaatttgttgttgttgtttttatttttgagacagagtctggctatgtctttctggctggagtacagtgccacgattttggctcactgctacctctgcctcccaggtgccagtgattctcgtgactcagcctctggagtagctgggattacaggcatgcaccaccacacccagctaatttttgtatttttaataaagatggggcttcaccatgttgtccaggctggtctggaactcctggcctcaagtgatccacctgcctcggcctcccaaagtgctgggataacaggtgtgaaccactgggccaggccctgaatgttttgaaggtactggtgacagggatttgctaaccaactgtgccgtgtgtgtgtgtgtgtgtgtgtgtgtgtgtgtgtgtgtgtgtgtgtgtcagagagagagagagaggaataaagattgactccaagatttttgtcccaaacaaatggaagcacagagggcacatctctgagctttgcaagctcgctggagaagtggcaaagtaacttgtgggaggaaagtacaggaattcggtcttgttcttgttgagtttgaggtagacaaagggagcacatgagctgggtatcagggggcgtttgtgctacagatagaagcctgggtgtcatcaacatccagatggaatttaaatccttgagactatgatccccaaagagggaagtgaacgtagggctgtggccaagccctgggacactctcatattgggaggagtggccctgcctggtgctgtttcacatgaggcactgcttcctgagaatccccttacagccttgcaaagaaaagtacatagccagccaggtgcggtggctcacacccacctggcactttgggaggccagggcaggtgggtcacaaggtcaggagttcaagaccagcacagttccgtacaacggtgctgttaacttggcagcccgaccgcaaatcagcatatcctgagtctatgcaggccccagggtagagtgtacattgtccccaggagtcgaacggacctgggccatcctgcctccttccatctcctgtcttctttcactagcatgtctgatccacttccctaacacagccaggctaggttggccgctttctgctatagctacaccaaattgctcaaggttacgatatagtagctggcatttactttgtcccaggcactgttccctgagccttctgcattagatcacccctcatttcacagcaaccctgtgggtctctgattaccccttttatacaggggaagacaataaggattaggaagattcaggaaattacccaaagaaattcacactcagattcacactcaggaaatgtgactcaatgacagccgtcgtcacctctctgctcttctgcctcccaaaccaaactgaagccagagaagcgtgccctgtgtgtgcaattaccagacccaatagcttgctctctccaacttctgtttttcagaataaaattgtttgttccatttctgattttagttgatggatttatgacagctttcattgctgatagccacagcaaaaatcattgctgccagatgcctgtaagagcatggggagggagtctggccagatctccatggactcaaggttgctccctggactcaaggttgcaggaggtccctagggatgcattcttcccggcttgctctttccatagcacagaggctcttcctgccatcatctgatgacagggatggctttgcctgctggacatccacctgttgcacgggttgatgatgcgaaatgtttttacagactccgtctgtcccggtttctttccatttaactctttcatgcccacttccctgtgcattctattcctgtgattgccttaaggagaacaaggatctgtcataaacttccttattttgccaaacttactataggcaaatagagactttcggacttgaaggatgtgttttccttatggaagcaaaggaaactgaccttgactctttttatttcatcctagattcaggctgtctctagaaactaccccagagcagctgcatgggaaatggcagacccctggtctcttacagccttgcaaagaaaagcacatagccggctgggcacggtggcttacacctgtaatcctagcactttgggaggccgaggcaggtggatcacgaggtcaggagttcaagaccaacctggccaatatggtgaaaccccgcctctactaaaaaatacaaaaattagccaggcatggcggcatgcacctgtaatcccagctactcaggaggctgaggcaagagaatcacttgaacctgggaggcagaggttgtggtgagctgagactgcaccactacactccagcctgggtaaccgagtgagactccatctcgaagaaaaaaagaaaagaaaagtacatagccaagtggccacaactgccagactagtgccagacttcctgagcacaaatccccacttgtccatcttccagaagtgtaaccttgggcagatttttaatctctctgggcctcagtgtccccacctgaaacatggggaggaatagtaatatctagattatggagtcactgtgatggatacagaataaaagaattcagggaaagtgtttagaacacagtgcacggtacatagcattaaattaactgattcgcatttttagcaaaatgagcataatgcgtagtcatttactaaaggtgtctctttgagactgataggggtgtttttctagaatatttggttttcatgccttgtggattagtttatttttattttccacaagccagccccgggtacctcactgcttaaatctcatgataacagtctcttcctcattcctggtaaaatccaagggagcagataggagtttctaaatattaagttttgccatctgctgtttgcttgcctgtaagcaagcactcagagatgacagtgccagtgaatgaatggcgaactgctattaaatgtaggagttgaacaactgatttatgaacgtttgcagcttggccctttggtggaggtaggcttgattttgcaatttttctagagcacacatataactagtcatattttctgctagtaaaactgttcctagtttgggcattgggattaaatttatcagtattttaagatgctctgcaaagtacctcacactatgcaaataacaccatgagttgtagatactctgtcacccaaacaagtttaggatctggttgaatgtttgaagtgaaatgaatcagaggagactgttcctgtgagcaaaagaggacgtgacaattcagaacctctaatcatacctagtccactatctgtcaggattcatggtcacaagcaacagaaaccagcatgggctatgttaggtggaataaaacaagaacagacagggttgacattaggcatcacagaatggatagaaaaccagaagacagactggaaaaaatgagtagccgccagatagaactcaaggggagggaaggagggattagggaccaccacaaagagaacagctgagttctcatgttaggcttcccatgcaatgaacatgacctgtgttcacccccacatcactcatgcaagagcatccagtttgctggagttgtctcatgtcccatatctactcctgctgcagtgggagagaatgggagtgggttactacctcccaccaacactgcacaaaacagggttttctccaaaagaggggttgggatgctatgagggatgataaaggatggggagcagtcaggaatgagaaacatccactccaaaacccttccacaagtgtgagtcttccacagtgctcgtgatgacctccacagcagacttgctgttatgactgtccccagctgccctctgtgaggatgggtgcttatgaggtgagaggtaaacatttgcatattcagttcccacactaaagagtgtctctgtcacaaagcaggaacaggtgacatgggccagcaaccaggtaaatctctgcagggcatgaagagccaagaatgctacagaacagggctgtggcttgcagagggcagggtgtggctctgggcagaccatcagggcaagagaaggcactctgccccaatacctccctttgggctggactagggagagtcaagccaggccctcatcttggtcataagctttaaggggataccgaaaaactcaatcatccagatagatgttttaatgcagtattttaaaaatcaaaactaatgcaaaaattagccaggcacggtggttcacgcctataatcccagcatttaggaaggctgaggtgggcagatcacttgagatcaggagttcgagaccagcccggccaacatgatgaaaccccgtctctattaaaaatacaaaaattagccaggtgtggtggcgcgtgcccatagtcccagctattcaggaggctaaggcaggagaatcgcttgaatccgggaggtggagattgcagtgagccaagatcatgccactgtactccagcctgggcaacagactgagactctgtttcaaaaaaaaattattgcaaaaattcataataagcaaaataccagctttttaagtaaagcaggatcattgttactgatttttcattttgtgtccagctcacatatgactcagcatggcgctgctgtgcgcaagctccttttcctctttgggcccatttcttcttctgtaaacttaaataggatcgcaaatgctgtgactctgtggatccctggatcaagagtagaaatgagttcaacctgcgtggcagatgctctgggccaagcctgtgcctacaacctggtggactaggcgaaagcaggtgccctttctgcaacagacagttagcaatgttgagtaaactgtgaccctttcacccatggaaacccacagctaggctccaaagaaaaagaagataaatctctgaatttaacaaataactagaatataaaatagttatgtttaaaatgattaggggaaaagaataggggccaggaagaaaggataaaacataatgaaatagaaaaggcagatgtgaacagtaactaaatagaaagtctagaaatctgatagagcattatctcattaatacttcggacacaactgtgagatgggtgtgatcatccctgttctatagatgaggaagggaggtcgaacctttcgtgagtgaaagagacggaattcaaatccagatatatttatgccaaagaacttttttttttttttttgagactgggtctgtctgtcacccaggatggcctgcagtggtgcagtctcggctccctacaacctctgcctcctgggctcaagggatcctcccacctcagcctcctgaatagctgggatcacaggcatgcaccaccatgcccagctaatttttctatttgtttgtagagatggggtttcgccatgttgcccaggtggttctcaaactcctgggctcaagcaatccactcgcttctgcctcccacagtgctgggattacagacgtgagccaccacaactggcctcaaggaacttctcaacagggaaacatttctttcctttgttttgcaagagaaaacactatttttttaaaaagtcatgctcagtagagtgtgcaggttcgttaaacacctgtgatatctttttataattctgtgtaagatggggtcttcatgtgcagcgggcccatttcatctctgttccccattcattcatgttctttgtgtctggggcttcttttgaaatctgtaaaggtgggaggaccagggaatccaatagagtgagcacatgaagagacgtccttcaagcccacactggatccacctggaactcccaccagggagttcactgggagtggggacttggcagctgccagggagaattcttaggcaagtggttactgtttgatgcttcaccctaaagttataaagatgcaacattttacagctcaacaagtaaacatttcccaaatacttaaaacatagattacctagtcactggtaaaacacagcaactggccttcatctccaaaatatatctagaatctccgcagttcttgcaactgcactacataaactttgtctaagccaccaccatcgttcacccagatgacaataattgccctaacttgtctcccattcttacaaggcaccatccacatcgcggtgatcctcttaaactgaagctcagatcccgtctctcccctgatgaagcccttcagtgcctcccatttcacactgaagtaaaacccagaccccctgccctggcccaggaagcccctggctggcctcggtgctgagcttcctctcctctcgctcctctggcagtctctcctccaaccacacggcctttcttcctcaaacttctttcccattcaggaactgtgcaaacatcattccctctgccttgaattccagtcgatccttattattcacaaattccatatttgtgagctcacccactcaataaaatgtatttgtcaccccaacattaatactcatggcgctttcatggttattcttggaggagtgcagaacagggaaaaatttgagttcacctgacgtgcacattcacagttgagctcaaacaaggccttcttttgctttgccttcttatttcagctctcatagtacaaataagtgccctttttgtgatctgtttagtgccgtgatttttatttttgcacgttttgttcgcaattttgctgtttgaaatggcgttgagcacagtgcggaagtgctgtccagcgtctctgggcacagaaggctgcgccatgccttacagaagaaacaggtgttaggataaccttccttcaggcatgagttacagctctgctgaccgtgagtgcaatgttagtgatcaactgtatacgttaaggaaggtgtgtttaagcagaagtgcacataagataaggccgtgtattgatgagttgacaaaaatgttgtgaccagaggcttgaggaaacctaaccgtgtattcttcccgagagcaatggtttttgagacagagtctcactctgtcacccaggctggagtgcagtggtgcaatctcggctcacttcaacctccacctcccacgttcaagcaattctcctgcctcagcctcctgagtagctgggattacaggcatgcgccaccatgcctggctaattttgtgtttttagtagagatggagtttcaccatgttggccaggctgatctcaaactcctggcctcaagtggtctgccccgcctcggcctcccaaattgctgggattacaggcgtgagccactgcacccagcctacagtagttttataggacatagctatggtgagtaacaaagatcaagtgtgcttgcttgcctgaacattcactacctgtctccccacactaaactgtaaaccccttgagggcacggaccatgttggtcttcaagtgggcctggcaaataataggcactcaatacatgtttgttagttaacgaatgaattgcaaataaattatttccaaagacagtttttaaccaggctgtactgtacaggactgtagtgtgtcctgttcaggagttaatatttaatatgtctttgcaaaggataacaaaggatttccatcagggactgactttaatataaagagtgcaaatgaatgctaattaaatatcttcacttaattattatttgatgcacttccttggtttgggcctcccctttgggcttaaaaagatacaagaaactgcttctgtttctttactttctcccagtgtcactgactaggcaccgttggctttgatgaacctccctgaggccaccatggggagatggtgttgcctggttcccagtgctgaggctctcaagacactgctttcttggaaagttgatgcggccaggagcatctgttttgtgcttcctcctgggcagacaggggctgctcttggaagtccattctgcttcttgctaactcacacaggcggtatgaggaggatgcttagccctaactgatcttatgatctagcctggaacactgagagctgggtttgctaacaagccgggtcagtaaccccaaccttcttacttcagtccagcgtcttgccctgtattgtcttctgttagagcacggttggcaagtttcttctataaagggccagatgataaacaatataggttttatggaccacacaatctgtgtctcagctactcaactcgaccatcgtaatccaaaagctgccacatctgtgaataggcatggctgtgttccaatagaactgtgttgacacagggagtcagagggccagatttggcccatgggccatagtttgccaacccccatggtacacccctaccagcattatggtatcttcatttgtgtgtgttctactctgtgctgcgagctctttaggggaaggcctgaatctcatccagtggtttcctctcaacatcttgtgtagtgcctgccccgtgacaagccctcggccaatgtttgctaaatgcatgacttataagacatggcccccaaagcacgggcattgtgaaacatgctaaccagatgaaaggtgacctaagccccagtggcagcccattcatcatcattctgcctcctgttgccaatattcaaaatagcaccagttgtttttctgtcaacaaatcaaaataatattcctgcatttgttcaacaaacagccactgagtgtgggagcagcatccagatgtcagctgggatctgcctgcctttgagaactaaataaatatgtgataagttgataagtcctgactgcatgccccgtagcagcccagaggcttcccaagatttctgcaaattccagaggattggagaaggaagccttgactttccagaggtcacatctggcttcaagcttccacttctgcaagctagttccatttcttagctgtctcaatctcctgcctgtgccagcctgtggcatcccatgtcgcccttctccccagtcctcccttggcacacatatgcacacacacgtgtatgtgcacacgcacatacacacacactcactgtcatcagaattggttgcatgtgatctaactcactgaggatgtttagaggcatggaaagggcagttacatcacatcacatcaaacaacttcaacctgagaccctggaaagccctcgattttccatccttctcagcatcccatccgtctgtatttctcacaaggcacatcatcccagcatgtacccagcctcagcacatattgggactcttctctccaatttctccctctcctctgcactttctctttttaaacagctccatggagatgtgattgacatgcaaaagtgcacaagttgatgagttctgacatatgtgcactcccttgacgctatcaccgtgatctagatcgtgcatgtgtctagcatcctcagaaacgtcctggactcctttggcatcctcctttctgcccctcctttcctttacctcagccccaggcaaccactgatctgccttctgtcattgtagattagtgtacattttgtagagcttcatataaattgaatcataaagtatgccctcttttttgtctggctccttctgctcagcacaattattgtgggattcatccgtgttgtcacctgtgtcaccagttacacagagacaaagaccttctgcagaaagattcaattctatgcagtccccacctcgaaagaacttcagattcccttttaacagacggaaacatgccagaagaccaaaagggctctctgtctttagaaacccatggttgttaaatagccatttttctcccgattaaaaatagctatttttcagttgcctcagcagctgcttaataagcacctactatgtgccaggcactgttgttagggacagagtgggaatcaggaaaacatggccttcctcttggggaatgatcagagaatgggcaggtgaactgctaaaaagttgcaacaggtgtacatatatttcttttgtttacaggttttgggaatgcaatcccatatttcctttttttacacattgaagtacttttttatgagcaatgcatgctcgtcacaaaaaaattaacaaacatggagcagcataaagaagtaaattaaaaatcacctttaatcccactgcccagatatggccaccattatatttcattttgttaattccacaggcgaggagtagaggaatatgttttgtttcattttgtgtaattaaacgggccacgggaactactatcagcttcctggggagctgagttgtgtttattttttttaagagctactaatttttgattaacaaggatgaatgtaatgtttaagaggaatctatttacaccctcttccccttctcaataaaacaacattcttccccaccaagtgtggagtcgagactctgaggatgtatggccctgagctgggggattctagggacatttttcatgtcactacctagacagtcgtgtgagtgctccagcagtgagggatctcggctgcaggttacattccttgccgaagccagggctggatgataattcactttgtcattacttaattctgtgatggctgaaacgactgagccagaataaaactctcagtccctgaaaagatgagagactcagtgtcaggatgtttaggaacagaaaaagcaagagggcagccgaatggggccatcgggtggctgcataaagaagtctgatgatggatgcagcgctcccaattcatttcttttctaaatgacatatttgtatgtttccttcatcatttcattcggtccacacgtatccatgcggtgcactctgtgtgccagtcatagaggccacatccggtcgtaggccgtaccccatgcacagctgtcctcttggcacagttgactgaacatgctttcgccgtgtgggagactgaagctatatctgtttgagctacaactaaaaccctggagtctctgcatgcctttgccaacatctggtggttccccaaatgtgtcaggttcttctctgcctctgtgctagggtttctaccctgaccgccacccaacaacccctgcgcccttatcctctcttcttcctcaggacgttactacgatccagccccacttcagcaccacggtcagcacccaccaattgcccagcactcctgctactgggttgctaggtatttcgcacatcagcccttctctgtgcctctgcccagtttgcttcctctgccctctctccctccaaataacagctgcctggctaatgtctgcgtatttgctggcagcagagtaacactgaggttgatgtccagctctgccattgagggttgtgggactttgggtaagttacttaacctctccagacctcattctctccaggtgtaaagggagataatacctagaggattaaataggctaatctagcaaagctcttagcacagtgtctggaacatagaaagaacccaatacatattaactattattgtaatctgtcaagaatcatcccaaatataccttgtgctaagaacctttcctcatcatttccttggggtgtaatacaaaaatctgacgtattccagaggcttggataccctccttggtactcacttggcatagcttccatcacactgtattttgtaattgctcatgagtgtgctagttaggataagtaataatagcttctgtgatagataacccctcaaatctcaatggcttaacacaaaactacattgctcactcctattacagtcgaactgcagatggtggggtgggatggctctgctccataacgttcagagatccttggcaccttccatttcatgaggctgcctcttcaaggtgtagcctccagggttgctgtggaagggaaagagagagcaaggagggtcttgcagggggtttgcagccaggcccagaagtgacattatcacatctaccaactttgctctatcctaatctagctgcattagaaactgagaagttcagcccgcctgtatgttcaaaaagaagataaaattatctctgaccacaggagtgcttctcatctccccaccaggccatgagatgctcaaggtcggtggccatgtgccttgggtctcttatccagtgttagctcccttctgcattccctggtcacctccagagctgagcaggtggcactgtggggaggggctttccaagcacagatgataggagatgcaaaggtacagagggtctgggagaaaactggccgcttcagggaaccacaagccacagcaacatttgcttgggctgcacacatattactgcataaaaatagctcgttaccaccttagcataggatgcatgtggaggtggggcagggatgagccagggcagcccaggagagcagagcttacagtcctctgggtagaggccagcatttctgatcctgtctgcctctgctatggagcctatgtttccttggttccaatggcaaggctaacaagagcgttcctccttgggtcatgtatctctttgaatagagctgcatccctaagccaaggaaacatattgtattgagtagtgctttaaagaacaggcaaggaatggaaattggcataaactttctaaaagacacgctgcagtatgtattaacttttttccaacagtcacactcttccatacccgtaatttcattcctaggaatatatctcgaaataatcagaaatggtgtcaaaaatgtatacactcaggaaacagatttatgtgcggagttgtacactgaagccttatttatggtagcaaaaagttagaaaacagccccagtgtccaacaataggaggctggataaatatattacagagttgccatatgatggaataatatgcagtgattaaaatttttgaagccaggagaaattgtttctgatataaactgaagtgacaaaagtgggacatccaagttggtaaacggtacgattccaattatacaaatcacacgtggagaagactttgaataaaatgtctaaggataggagcgggctttcaggctcctggaattatttggtgatttttcatgttttcttcacactgtcttgtattatcaagttgttaatgttgaacacatacattacttttataaacagaaaagtactttttaagaaacaaggggcaaggagactaagaaaaccatcctttcttggcagactccctcagaggtactatgtttcttttctacagttctctcaggactcaaatgcttgcctagaccaacatgcctctgactccataataggcacgaactcgcaattactccctggtacacaaccttttcagccaccgtaacatccattcaactgcacaaaatatgtcatctaaaacctcatccagataaccctgcacattgcacttttttatatatggagaaatgaaaaaggctttttgctttgtaagttccataaagacatttcttggcatctagaaaatgacaagaacccttcaacccagacttcacctcacacccatccctaactttggttacagttcaaaagtgttcatggaagtttgaaaagtggtttcccttttcacctgaagctgtgatttccagtgtggtctggaggagaaaactgcctcgaaggaagctaagggatagaaaggtgttttcaatgtcttctcttaggtggggttttcattcagtcaggttaggttgttaaggcaagagagataatgaacaaaaataacaatcttaccctcaaagatacaataaaatgcactcatgttctcatttcgatgccagaatatgaacaccgagatggttctccaactcccatgcaccaagccccttacaagcttagactcgggtcaggtcctagaaaagaaagtttagggtgtttagggaaatgtttgcagtgtacccagtgagtggatttaaccaaatctgtatctcagagcaggcaccactcccatatcccaccaggaagccattgtgagatatagtctgcccacagccccgctgccacaggctccaatgccagggaaagctgtgtctccccatcagtgcaattctaagaattaagtactccttccttgccaattacatggtcactatccttagaattgaatttaagctctgatagaaaattgttgaaagccttcagtgctcatttttcaccaaactgaactctataatggtactacaatagaaaaaaaatttccaaagttcaattggaattttttcccagtaacttaataataaggctccaatttcaggaaaatagtttcagcatgagtgaaatcacactgtttgttatgcagcatcaaagctgtcctccaacacagggcagaggccagtgctccctggagttgaactccaacaatcatttaaaaacttttgtttccaatcatttagaaacttgtagatttttctggcaacatccaagaataagttatctcacttagatgagttttctgtgaaactgaagctcaccacttcaagtgctatatctttctatatattgacttcatttctaaaacataggtttccccgattcttaaatagagtatgggaaaggaatttaaggtcatttgaggtaatcattcttataggttaataagtgaaccaagacaatgctttacctgattttgagttttttctgtcttttatgctttcatacaaaatgtcatgctctaatcactaaacctgactccagaaatccacctggaaaacaaagtagacaaccaagctttttgagaattttgacttttttaaaaaaagaaaaagaagcccgggcccggtggctcacgcctgtaatcctagcactttgggaggctgaggcgggcagatcacgaggtcaggagatggagaccatcctggctaacacggtgaaatcctgtctctactaaaaatacaaaaaattagccgggcatgatggtgggcgcctgtagtcccagctactcgggaggctgaggcaggagaatggcgtgaacccgggaggcggagcttgcagtgagccgagatcacgccactgcactccagcgtgggggccagagggagactccgtctcaaaagaaaagaaaaagaatgatattagcaggaagagagaattaagctttattgagcaactactaagtgccaggcatttttctgtgcattttatcatttcatccttcaaacaaccctaaagctgaccttactgtcaagcattcaccattcattctacatctgactctcaggagaagaggagggaatgttgggtcaagtgatccccagggttccttcaagcaccaacaatctctatgtctcccatcctaacttaaattttataaaacaaaggatttgtttaggtgggagagtagataagtctgccctagggctggttgcctctttcagcccccattcatgcataacaaatcacacacaaacttagtgactggaaacaacatcgttttcgtgtctctgtggttttaatggctcaggaatgtgagcagggcacactgggagcagcctatctctgtgcctcaatgtctgaggccttagctggaatccccaaggcctgggagctgatgtcatctgaatgcttattcagttgtttatctggcaattgttgattgctgtcagccagaacatctacttgtggcctctccacgaggcctgggctctctcacaacatggcggccaggttccaaaggtgagcatcccaaaagccagcttgcagtggtttctctttcgccttttatgatccagcctcagaaatcatacagtgtcacttctattgcactcattcatgaaggccgtcataaacgctaacccacactctaggggacaggaactagactccacctgtgaacgagaggagcgtcagaaatattagcatggccatttttggaaaatgctatagagccaaagtctgcatgaagagagaacagattgggaatcagaggtacctgagttcagattccagcttcattgctcattagctctgtggcatggggaaatcagtgaaccctttactgctgtgttatttgtaaaatgactgtgattgctgactgattatgtcaggctatacaatcatttctttggttgcaagccatggaaaccaaaccttatgaagagaagaaaacacatatgcaggcatgtgtgtgcacacacacacaagacatagagaagcaaagaaaaataggatgaagcaagcttcaggaatgccggaaaaagctgcttcagcgatctaggttcctgggatgaatggatgatatttttaggctctcacgatcaggacaaatcagctccaagtattttccatccttatgtctctctgaaaacattgtacgctcccagcatattaagtcctgggtggcctgtcttgagtcggactcacttcatcccttcactataggagagagaggcaccataatggaaagtctcagcaaggctacatgaagaatggggtaaactcatgggaaaatgcaggtgtccccacaaagaaggagaaatggataaacagcacatctactctggacatttgcaggactaagaaggatacaagatggaaagcagaatatgggtgtactgttcccgcttcccaatatgccatgcatgttcacgctccagaacttgactgtcagtcactcttcctaaaatatttcccttcctgcctccacccatcacaatcctgttggtctttctaggtcagtttcaaatactgcatggtccgtaacactttcggtgagtaggaagtaatctctttctccttgaattcctccattctattttataactttcttaggccattattacctccttctttgtcttagccatttccattttgctttatccaaacatttccaaacaccaggcaccttcatctcctgtaacctatctgctctctgtgtactgtcattcactgaatgcttttaagttgactttaatttgacttgtctttcttttaacttagcaataatatctgtgatatgccagctatatttttaccattcactttaaaacaaatattattgaaatgtttaaaataattgctgatcccctgttctactactcttccctattctggctgagttcctataagacagagatcagctcttagattccccgtgtatcatatccctgacatgccgcactgtgctattgatctggtggccgttcaataaaaagtcattgagtgaacaaatagaaagcgagaaagagggaaggagaaagagtgagatgaaataatgaagttaaagtgaactgagtgggactcatctttggtgagagaccctaaaggcaaaaaaaaaaaaaaaaaaaaaagagctgggaaagttgaattttgaggagaaggcaagaatactttattttccttctaccctaatgacaccttctctttggactcatcctcctgtgagttggcaaggggaatggggagcagcttaagcagcagctgccaccatgaccattattcccaagcaacttgcccagggcaccagaaggcatgagctccatgtttcccagccaaggctcttccagccagcagtgctgatgggaagaacaggcaagccagagtgccttatcaagtgcaagactcaccacccatagaggatccacccaaagccaccgggagaaccaacacatccctgcagacgacaaaagcgtccttttgctcatggccacatgccttgcagcacaagctcctctcaaatacttcccaggacctcaccgtaagggacagtcaaccagacgtgtgcttccacatgttcttcaaatgtgtttttcatttgcttgggttcaacctcattataatggcattagccagaggaggtagcatggtggttcaggtttctggaagtggggttaagccagtcctttcactttcttaactgaaattccccaacgcccttggcttactcacccctcagcatgctttgttctctttctgtctttttctgtctaggttctctatcatgagtgtcctcttctctgaattcatagcctttgtggcctctcttcctgctaaccatgctaggctaagtaacgcccacaccgcctccactccccaaagctgtccacatcctagtccttaccttatacagtaaaaaggactctgcagctatgattagatgaaaggtctttagacgaccttagatcatcaggatacacccattttcaccataaaagtccttataagaaggaggcagggccaagcgcggtggctcatgcctgtaattccagcactttgggaggctgaggttggtggatcacttgaggccaggagttcaagaccagactggccaatgtggtgaaacctatctctactaaaaatacaaaaattagctgagtgtggtggcatacacctgtagtttctgctactcaggaggctgaggcaggaaaatggtttgaactcaggaggcggaggttgtgatgagccaagatcatgccactgccctctagtctgggcaacagagcgagaccctgtctcaaaaaattaaattaaaaaataaaaattaaattaaaaaattaaaatggaggcaggagggtcagagtcagagaaggagatgcaatcacaaaagcaagtcattggagccacataaggaagaatccagaggtcaaggaatgcaggcatctctagattctggaaagagcaaagaaacaaattctgccctgaagattctaaaaggaacacagccctgccaacatcttaattttagactctgacttgtgggactataagaataaatctgagttgttttaatccactaggtctgtggtcttttgcatagcagacacaggaacctgagatattaaccttcatctactttctcttccaatctatgagggttcccccagcggactccctctataatcagtacggtccattcagcattcatccatgcacaccccaagttttccactctaggggtgccgtgtgtgcaccatttgagaaacacggcctctgcacaggaattgcatcataatcatccttgcatccaccatgttgcccacatgggctttatacatagcaaacaccctgtaaacatgtatttaattgcatagaaagccagtattccattgccatccacagtgagcctcttaaaatacattcttcatcagacccatttatatttgtccagagctagtcatgcatgatggtaggagaatgaaatgaataattttatttttgccatcaggaagtaaacattttattcatagactttgtcatcctgtgtaatagggtctgagtattcactctgcattttagaacatcagacatatggaaaatctatttgatgtgtagttctcagttcctgaccttatgtctttctcagttcattatttccacctctctctagtcattggatttgtagaaagaacagagatatttaagaaacattattcattccttcagagtcttggatttctccaaatagtccaaaaaatggcctatttttagatgattgaattatactagaaaggtggtgatcttgcccccagatgacatttgtcagtgtctagaacatttcagggggtgcgaggggaatgccactggcatctagggggcagaggcccgggttgctggtaaagttctcacaatgcactggacagcctctctgcaacaagaattatccaaccccagatgtcaggggggacaattgaagttgccgcttctccactctccccaattagaagtatctgcttaggtggagaaatcctgggctggaacaacaggctgcaacttggccaaatgacctctgattaaaagcaagagagctggcttaaaacctgttcaaggccatttcgaaaaacctggaggctttccctgactgcaagcttggtcttgggcaaaagtgccttatgactgctagaaaagctaagagcatctcaaagttcaagtgctggcatggaacttgggctatagcattgcatgctggccttctgcattcctcttggtgcctctttttaagagggatgttggcaaattcaggtgtgttcaagggaggcaacctggaaaaaaaaaaaaagagtgttgcggggagctgaagaaggaggactctggaagcacagaaacccagattcctccagccctgttactgccacttagcagccataagacctcgagaaattgactcaccatctctaaaccagagtttccttgtcttgggaattaacaggaagattgtaatgagttaaagttcatgtgtgaagcgcttagcaccgtgactgccacctctaagcactcaataaacagggctgtttatgcttgttattcggaacgggagagggctgcaactcgggcacctgaggcacaatgggaagtgctggagctggaaaaggaatgagtgatggacagactcgatcatcgttgtgtagcatttgaaggaggctgtctctggtgggctgaactacgatgaatgttagcaaaattctacaggcatactgggactcaacctggggaagccccgcaggctgctcagcatggatcagtgatcctcattctggccaccagcagaggtgccttgctacacgccaccaccttggggcaggtgccactggacagtagcctgcgtggacaactaaagctgtcccttctccactctccccagttagaagtatctgtgacttcagatgcagggagattttgaagctatcccattagaaagtcaatagtctgcctacctcattctttagcaaggatgccccataattaatcaagtgggctgaaggaataaaagcctcctgtgctcattgcattctgtgagcaaacaatagcgggaaacaaatgccagacgggctgtggtaggcataacagatgacatagtaggaattggtttatcttggcatcttggggggctttatcttagtgtaatcagtcaattagcaaactttcctaatggctgagaggcacactggctagcatgtgtgtggttgtttgtttgtttggtgttttggggttttttattttttggtttttttgttttttgttttttgttttgagaaaggtcttactctcttacccatactggagtatagtggcgcaatcttgactcaccacaacctctgccttccaggctcaagcgattctcgtgcctcagcttcccaagtagctgggattacgtgtgcataccactaccacctggctaatttttgtatttttagtagagacgggatttcaccatgttggccaggctggtctcgaactcctgaccttaaatgatccaccgccttggcctcccaaagcactgggattacaggcgtgagccaccacacccagctggccagcatgtttttaggtgcttagtagacattgcattctttctccagggttgccataacaaagtaccatagactgagcagcttaagtagcagaaatttaatttcttacaattctgtaggttagaagtctgagatcaaggtgttggcagagttggttccttctgaggcctctcttcttggcttgtagatggctgtcttctccctgtgtcctcacagagtcttccctctctgtctgtctgtgccctaatctcttctcatgaggacaccagtcatatctgactagggcccactatagtgatctccttttaacttacctgtttaagacaatcatactgtgaggtgctggagattaggacatccacatatatatttggggaaacacaattcagaccagaacaggcaccactaaaatttggcagcaccttttaaaagggccttgaatggaaaggagagaacctgtggtttacaatagccgccagagcactgggggctcttgcgatctcatgagaccaaactccaggtctaggcacacctggtttgggacaggcctgctttagcattgaaaacaggatctttgcccaacaggaaggttggagaatgaggcatgcatctaagaaaaaaatgcaagcaaaataaaaattcccacatattgccttaattgtctttacagaaggaaatatcccagggcaagaatcatcagggcatgctctgcgccctgcatttgatttcatgttttcaggagcacccctcaaggtctggagaagcacaggtgctgtacctgtacaagccagcaaggcaaagaggcctggttgcaagatgtgaggcaacattttatattttacttatgttattcaatttgtctacacatctatccttttctggaaaaagaccatattgccacttgagtttcagtattacagacattgttttcctctaagtgactagactctctgtttagctcgccacacaacatcatatctgccatgtgctgtcacacactaataaaagcatagaggagtatgtaaaacagcattgcttctctaaaaattcagccctattaagtttgttggtacatcacctggatttttattaaagtagtaaaaatgttccgcaaagtgactttgaagtaacagtacgattctgagccacgttaaagaaatgttaaggtggagagctctgttgctttcaaatactagtataattctggccaaatatccctgtttaaaatgatctgagcactttaggccttttactaatgtatggattatagttcaagccagtagctagggagctgtgtgtttgagcctccatctctaccacctagcagcaaacagatcaacctgggaaaggagcagctgcctgcacttcattcactgaggattcttccaaccctctctccgtctaacgggctggggtccttcatggacgcattgatagatgacagtgtgccaatccagcacacaccagaaatggttactccaccagggagctcacctcatcttctgccattggcctcccaccccacatttttccaatgaggttctttgagtccgacttatttttgacaaagccacactggtttgtaatgagcattgcattcttttatacagagttggggagggagggagattttgaagggggaaaacacgaaccaagtaggtagatatttgcatctctcaacttttctcgtcaccaaaaaaaaaaaaaatttcctcttcaaatttgtaggtaaaaagacgtgtttctttaactttacctctcacaaatggtatgttcatctatcggctgggactcttttagttaaaaaggaaacctaactcaaaccagaatgggggtggggaaagtgaattgatgtatctcacataactgggagatccaagggtggatgtggttttaaccagaactcgatctgagggtttgtgggaaatattcaaattagaacagttaagagcagacaccagccaatcaaaacagtccatgccagtgacgtcagccctgcatgtgccgtcagggtggggctatcaggaatctctctccctcttgactgccttcctcattgtcaacattactctcaaagaggctttggtcaggtttcaaaaggccagcagtagctctgggtctacagctccccagctctgcaccccagagaaatgcctgtccagtattctccaaaattcctgggctcatgctcacttgtccagagtagatctctagcccaccctatacccatcgctggccactggccccatccaaaactctggggcagtgagtggagggggggctgccctacgccaaatcaggtggtcttacaggaagaagtgaaaatagatgccgcagaagccacaacaatcccatccactgcaaatcacacgatagtaaatggcactttagaccccttctatagtttccagaaatgtagagaggatcacgttgctttagtgtcttgccccaagtgctattaatatccctgtccctaaaagattgatttttattatcggtagaaatacttaatagaaatgaaatctacgctctcggtcatagatagctggcataaaaattaaacaaaacactgtgaagcatacttctgaagtgaccgcatacctagctatgctgccccagtgagctcaagtgtgttttcattagggcatttggtaagcctgggggaaactgtttctgccccacaaaggaatgttctgcaaacattcagtaactaaccatgtgatgctttctacctctgtaactaaagctaaagacttttacctattgacttggattctcagctatcagtaggagggacagtttcaaaacattgtctatagagactgtaacatatgactatcacaagacagactcaggaactgttgaatattcatgagttaaatgggcaaaatgtttgacatcctggcatctttggatgtgtttgttttacatttagtagcttttctatagaagacagaaatgggaaatgccttcttaatctgcttgaaggagagggttctgatgatactcatctatcttcgatgagaatgggtctttatctttaattcctaattaacggttttgccaactacctttatctatttcccttgtgattttaagagaaaggaaaagtcttgagtgtgttgcctctgcccatctgtttctttacatcatttgcgagctcaggtacttgttatttgctgagcaaggactttccagctaggattggataaagcagtagctaggttcgagagtaagagttttattgctatcatttagagtatttcttcattcgttcatgcatgcctttgctcataaatacccccaccttattccacaaaagatatgaaatggagctttattgctatgagttcatgctggcataaatattaagctctgtgtaataatcacttgggctattcccgtacatagtgcagagttacttatggccaacgcaaagtctattttcccatcagaggttaacgttcccatttacttgatcagggtttggataatgcttcattcacagctgtttttcgcttgcaagaatccatctactttatcctcactgaccttaccctggcaggtggtgccaggatttcctcaggcagttgtttgttttagcattttcgagtatttatactggctgcggtaagggagccaggatcctggggcttgtaagtaccaggtcttggtaagtctccttcctggcagcagcagcagcgttagtaaaatgcattttccaatactatcctgtgtcttaaatggtatttttatccattagagttgagtgcaagcaatagaaattaactctgaagaacgaatgcaaaaacagtgtctttgagggctgtgtgtcgctgacaggcaggcgggtccctcaggggagccctggtggacagtctgatgctcggtgccaactgtcagcccaggccaggagtcagagttgggagagattgtgatgccttggcttgggtcagggcccacttcctagctcggggatggtcaaccttgacaacagcgtgtgacaagggtggagtcatagcaattagggtgtttttaccaaagtgaaggaagacgaaatgccttcctgggtggggaaaaaaacaacagatgtccactaccctccccttttgcagtaattttctctccatatttgatgactattctatcagatattgttaaaatctttccccagtatatgcaatttacctttaatgtcatcttcttggtacagtcttccattttgctgagttcattttgttttccataaagctaggaaaacttagacttgcccacttttttgttttaatagactttgttttttagagcagttgcaggttcacagcaaaattgagcagaaggtacagggagttctcacatgcttcctgcccccacacatgcacagcctcccccataatcaatatcccccaccaaactgggacattcgttacaactaatgaacctaccttgacacgtcatgatcaccagaggccatagtgcaaattagggttcccttttggtgttggaaatcccgtgggtttgggcaaatgtataacagcatgcatccaccattgtaataccatgcagagtagtttcagaactctaaatatcccgtgtgctccacccgtacatccctccttcccgccaacccttgccagtcattaatccccactctgctgtacctcttactggctttttttatgtcttgagtcacagtcttgctctgtcacccaggctggagtgcagtggtgcagtctcagctcactgcaacctccacctcctggactcaagcaatcctcctgcctcagcctccagagtagctgggactacaggcacgtgccaccacacccggttaatttttgtatttttagtagagatggggtttcactatgttggccgggctggtctcaaatccctgacctcatgatccgccctcctcagccttccaaagtgctgggattataggcatgagccaccgcacccgccctggcctctttaatgattgtttacttgggtaggtaaagtcttccagtccttttcattctctctaaaatcagaaactctttggaaatatctgaattttcagatcaacatcattgcctgtaaaactctttaagaccctctttgaaatggggtaacagccattaaaaaaatgagaaggccagactcaggctggacatggtggctcatacctgtaatcccagcactttgggaggccgaagcaggtggattagttgaggtcaggagttcaagacccgtctggccaacatgtctggccaacatggtgaagccccgtctctactaaaaatacaaaaattagccaggggtagtggtgcacacctgtagtcccagctacttgggaggctgaggcaggagaattgcttgaacccaggagacggaggttgtagtgagccaagattgcaccactaccctccagcctggatgacagagcgagatactatctccaaaaaaaaaagaaaagaaagtgaggcaaatgaagacttgtagtgattgctttactataatcccctaatctcccctgacttcttccccactttttgtatatattttccatcttctcccattgggttcagtctgaactgaatctgtctgaactgcctggttcaccgcacgtgaaagtccctgtctccactttcttctgtctcaggaaacaggctcagggcagctgagaaacaggcccaggccatcctgctgaaggacgacaccatcaggaagaaacaggtagtgacatgaaatgggcacctactatgagccaagggctgactcttggtgtctatttcttcatttaatgatcacggggacgctgtgagctcctttcacctctcactgcctcaatttccttacctgtaagtggcgacgataattccttcctccaggactattgtgagagtttgagagctagtttggagaaaaagtaggccaattaaccagctcccctgcatgcaaagcttgttatttctctgtgacagaggcagctctttaaaatcttaccgtgcacgttctgcaggacacctttccctggatttttctttcacgcaaaccccattcagttcctactgtgctctgcttgcctctcctgttgttgagaggctcaggaaaaacaactggaactaattcaccactctggcttgatgaagtcacttcctgctgctctgggcattggcctctggaacaatcaaccgctgtctggtgggaattctattaacatgactgtgactgtcttactttggacagtcttactttggattgcccccgaagcagatgctgagacaagggttagggtgaaaatagtttagttggcagaaaatcccataaaataccagcgggagagcaggaagtgggacaggagaggaacacagcccacacactctgcattgtccatccagccaccactatgcgtacaggagctgaatcccagaggaacacactcctgggcttattccatccaagtaatatcgtaggctgggggaggtccccaaacgccagtgagtccttgaccccagtcattgtccaggctcttgactgtgagaagaaattcaagaatgagtcagaaaatagtgaaagtatggtttattgcaaagcaaaaagtatacactcaagaaaggtgagtgtgagcgttttcaagagtgaaggaatcgctctcaagggggattggggttgctacctctatggatttctttaaccaagcagtggaatgttcatgaagattcctggaaaaaggtggagatttctcataactgaggtgtcacccatttttgcaccaaatatgggtgttcctggaaccatcgaggtgccggtgggtgtgtgatatagtatgttaacgagcatatattgaggtcctagggaaaacctaagtgaaatccaccaccacgatgggtccagttggtcttagccagcttggcccacactcttgttttttcagggtcttatcagcccctagcttctgcagctatttcaacattttccttttgctaatcatgtgaaactactgcctggaattttctattcttctatgaccaccctgtattcttcttgtctcatggggagcaagggagctgaggtataagtaccccagtcattgggtgagggttgctcctgagagaggtgctgattctcatcgcattcagcctgctgcatagatgagcaaaggcctttggctgctggtgcaagttctctggcaaaggaatgcaggtgctgacaggtgcatttggcctgatatgcactgtagggggatggcttccagggcaccctcaatgcctcttaaaatcattctctccttaaaaccagcccattcatctcttgggggcttctgcctctctttcagacaaattattgcagagagtccagtagccaagtagaattgcattgagcaggcacatttgacaatgacatttgattccagaacttgtcaagctttgttctcagaatatgaccagatcctaataatgtctgtccactgttgagggaccactgcgtaccagaccctatgtgggatctgtgaagtctattacctcattcagtcatcccagcaaccctgtgagggatcccccactgtctccaatttctgcactaggagagggcgacatggggaggttacgccacactccacgtcactcacccacggccctctcagtaaacggtggacacaggatccgtagcctgaatgtctgtgtcatggtcaagctccaggtcttttccagcgccacattttccagcacaacaactagattagtaagtgttcgcttatgaggatgtactaggagcgtagctaccgagcgcttcctgcataccacgtgcagttatacacacctcacatgtaagaatttaaacccccacggtgacgctaggaggtatgcacggttacttccattataaggtgaggaggctgtggcataccatgttctgtgccatgtcctcagataccattataccagatgccattccttaagcccctgagtaccaatcccactccctctccatcacacacagccactatggaatacactcacatcagcgtcagttggccccactcactgtggggcagaatttccctggtctgatgcctggcatctgcccagaaggcactgcagcataggggacagtggggtcagactccactgtaggaatctacatctccctgcacacactgtgaggccttgcaagggctactgcacatcagcgagcctccattttcctcatattcaagatggaatcaagcttgtcttcctggcgggttggtgaagatggcactaaatgagaagggaacagggtaggcaccaaatggttgctgctgccgaatttgggaccggggtgctggtggtcatctgagtgccagctctgcctgaccttgatccagtacatacgtacacacacacacacacgttcacacacttgtgcatgtacacatgtgtacatcatgcacatacatgtccacacattcacacaccactcccacatctgcacccacatgcaagtactcatacatgcactcatgcacacacatgcacacacattcacacatgtgcactcacacatgcacacactctccagtaagctttttggagttcatcaatattacacccaagtcagcatttattgagcacctactgcataccagcattatgccaagcacaagagattaggggaagttgggcgtaatggctcacgttcataatcctgctctttgggaggctgaggcaggaagattccttgagcgtaggagttcgaggacagcctgggcaacatagtgagaccccgtctctgtctttaaaaaaaaaagacacaaggggagcccagaaatgaaacagccaatgtatcatttcaggcagaccatctcgttttcacaggaagcagcaaagacagggtgccagacacctttgccacgctccactggcttccatactctgagaaaagagggaatccgactcatgagagccagaaatgaaattgatgcaatcccaaacccagggccagtccatcctggaaggtaagccccatggggccttgtgactgcctcttctttcaagcaaggtcctgtcataattttctccctggcacaacctttatggagtgggttataactgtgcctgaaatggactggcctctggcagagcattcctcggtgtgggagccatcaggccctcaggaacgagtcttcctgccaccaggaggtttcatgtatgcacctgtatcatcagtagtgtggtgtttctgtatcgtcagaactcagcacaccatttctggccagcatggttgtttgatgtagactgagaagtgggttcagtaatgagcacctggcacactcaaactctgctagggttgggtggccacactcctttgaggcttgaccaatgtcacctgaaggtcaccaccagtagccatccagaacagtttaattgggggttggcagtccatctgcagtgacacactgcctgtgtcctccaaaactcagtggattggagaattgagtcacgatgaatcttgtaacccatacccagagccctgaagaacgcaggttgtttgcacgcccagccacaaagaagttgccttctcttgatctttgaagcaattaaatgtcatttagagaggagaggtttgctgtttaaaaatattttttaaaacagcttgagtttattcttgtaaggctgccattgggtctgagaccccagaggagcagtgcgctgccttgcagttactccgcagtgggcaagacaggcatgttttgctctgggaagagttgctgaacacctgtctgagcaagggactctttgtggctgtctggtcgttatgtacaccacttggtcctacctccaagtagcttgtggtctcctgggagctgtaagaaatccaaaccagcaaacaacatagtttttgtttccagtgttaaccacctggcgaatggtccagataggaatgctgtagaagctccagggaggaagagactccaggggctcaagtggtttagcagggctagcaggactagcaggacaagacagagtttgaatgagatcgttgcatctaagtggaataaggagaagctgataatgcaagaaggtcaaccatctcacacacatctagggaccgtggggaaacccattttgctagagtagagagattggatgaggaagtacaggctgcaccctggagccaagctaagtaaactggacttcattctgaactgggagtggaggggtccatgtgcaaaagagcactgtgggaggatccaggggacactggagccctggagcttgttaggaagcaagctactcattcccagggaagaaagaggaggactcagagtggggaggagtgtgccacatgaaaggtgcccacagtattcaaatcccaacttcgctgcctgctaattatgtgaaccgatgctggctacacaatctctctgagccttgctattctcatccctgaaatggcaatagtaatcccagcctcaaacaatgatagttaagattatatgaaatatcatgcatgtagtgccagctacatatgtacagtgtccaaccccacaaaggggatccctgttattcgtagggagatggtgtagcagtgttgccctagagccaattcatagcagtttgcaggggccagttgttaccatctctttgtagctgtgcattcagtgacatcgtgggagtaactcgaaactggccacattggaaatacttctatcatggaattagacaaacactattaattcaagctttccccacctccagagaatcagatgttaaacatttgccagtgttcctctggcaaagaaaaggaaaatagccagaggtaagtgaaatcaaatgagagaagtctaaccttgcaaaactgagccaactgcactgatgtatcctgttgtctgtcccacaccctcgcaaggcttttggtctttgtccagcagagtcaccacgtcttattcaggttacagtgctgagctatttggaaaccaggctgggggggtggatttcaatgtcatcttactaaaaaagttcactaatgaaaagtgtattgctaagacagcagcttcatatttctcccagtctttatcagcagccatggattgaatcgttgacttgattttactacactgaggtcccactgaggaaggccaagttcctaaatcatgcacctgacaggtgccatatttctgagcacagagctgagctgtgaccttctagtttcacagtaactagagctgggtgacatgcttaataaagggagtacatggtgcatttttaaaatatggaatgaaggtggaatcatgcagacatgtcagtctgaaactggttaccagaagcaaggtgatcaatcttcctgcctgtcttaggatgctgatgtgagaagcacgatgactttcacttggcagaaggatttggaagtatctgggcttgataagctacctcatgccaaggaccatgctctgtatacgacttcatcttttcacccaccctatgagtgaggttttagtgtctccatttcacatatagagaagtaaaagcttggaaggttagcacctctctccatgtcccacagatactaaagggctgagccaagatttgagtgtgcttttgtctgattcgcctctgcttggccctctgtctccaagctgctgcttagctggaggctcctcagtgacatcagctcactgtggctccctctgcctggaatgttctcccttgcccaggccttcatgtgactgtctccttttcacttcagtctcactatcatctcctttgcaaggctttccctgatcaccttcgctaaagaagccctcctcaactctgcccacctgtcactggtcactccctgtactgttgcccaatgggacggctttcagagcacataccactctctgaagttatcgtattgtgtgttaactatttttatgatctcccttcctcttgtagaacagaagctccatgagaacaggaatttcatgccttgttctctttcatatatgcagagtaaagaagaatgtctgacatataatagctacacaataaatattgaaagaatgaggggatgggtggacagatgcatagatccatggaagaatggatggatggatggatggatggatagatggatggatacatgaattgatggatgcatggatagacacatggatgagtgatgaatgcctgggtgggtgatgaatgcatggatgaatgtggaatgcatggatggatgatgaatgcatgggtgggtgatgaacgcatgggtgagtggtgaatgcgtgggtgagtgatgaatgcatgggtgagtgtggaaagcatgggtgggtgatgaatgtatgggtgagtgatgaatgcatgggtgggtgatgaatgcatgggtgggtgatgaatacatgggtgagtgataaatgcatgggtgggtgatgaatgcatgggtgggtgatgaatgcatggatgaatgtggaatgcatgggtggatgatgaatgcatgggtgggtgattaatgcatgggtaggtgatgaatgcatgggtgagtgatgaatgaatggatgagtgtggaatgcatggctgagtgatgaatgcatgggtgggggatgaatgcatgggtgggtgatgaatgcatgggtgagtgatgaatgcataggtgagtgaggaatgcatgggtggatgatgaatgcatgggtggatgatgaatgcatggatgagtgtggaatgcatgggtgagtgataaatgcatgagtcggtggatgaatgcatggatgaatgatgaatgcatgaatggatggatacatggatggatgaagttgtacaagctcaaaccagctcagattggaggaagcgtcttacttgaagccccctgtgactatgttggggcttgtctcctaccatctcactgaaggagcctatctcctaagctctctcctagacacctgtatccttactttcccctcccttcccagcctgagcagtgtcagcgtcaggagcaagatgattgatgaagtgtcagcagggacacaaccagctgggtgagcaggggctatattgtaacctgcagccaggagctgctcccttgagatggcctttgggtacaactctatatggcttcccagcctttcttccagctgcaggatcatcctacccctgggactcccttattggtgtcctcattaggccaatcaatgcaaattaagccctgattcacagatagtggggatatacagtcaccacgacacatatggcctctgtcatccagtttcactcagtctagagaaagaaagagatgaataaacagacccttttagtataaaagctatgatgaaagtgacatttgaggtgaaaacactacaatataacagcagcagagagaaaggcacatcagtcaaagtcaaggaaggaagggacagctgggctcagacttgcaggtagaccagggcaaggatgttcaggcagaggaaatgggataaacaaaggcatggtggccaagagagctagatccgttcactcaacacacaggcaggactgcaacgggtcttgtgtatcctgtggatctaatctatccttaggcgtcagtctgggaaacatgagttccgtcttctccactaatctgggaaggagggtcaagtggtacctctgtctccacctcctccaggcctacacagtttgtgactgacatactgagcaccaggtctgcatcacccaccttatcacatgtgggcacaggatctctgccgggggcaagcggtatgatgtgtcctggtcacggtctggctggtgatttggttacatccagacacggaagtcgacctagaataacctaagacaaaggcagtcgtttctctggctgacattgtcagaacgttaaacaaccaaaaacagcaacaaagtgatgggccaagcaggcaagtttgggaacagctttaatgactaatttctaatgagagtttcaaaacactaattttccagaacagagaatcaagttgtgctcatttataacccgtcatctgcaatgagacagaggatatttctttctgtgttgtcagttaactttctgagctggacagaatacaaactagaagaggtgggccgtaaatcagctcctttggaactgataaatggatattgtacaaatcctgcatttgcattggctctgaggacataaatcaattctcatgatcttactttggaaaaaaatttccctttgaagtcagactgagcgatttatgtagcattctttcctgactttatttttctcagctttttaatgattgtcttttcactttctgcacttacacaacattgtaaagtgttgcattttcatgtagagaaaactggaccttggtctgaatcttcccacaagggataattttataacttttttgctcagccattgaataacaattgcttttggaaagattgtcataatgtatcagttagaaggcaccttagagaccatcatttcacatgacctctgttttttagatggggaaactgaggcccaagagtgacagtcatgtgctgcaggtcacaggccaagtttgtgacaagaccggggtgtctgttcgggttttggagaaacaaggaccctagatagggtccattcattcattcatttatttatttatttgttcattctccagacaaatcgttatcttggccccttctgctgcagccattgccactaagaaggcaggccctgcaggggagactctgcacgtcttttgtttgttgagtatttgctaaacgggcaaaaaatggaagaaaaatcaaaacatcactgttggctgggcacggtggctcacgcctgtaatcccggccctttgggaggccgaggcgggcagatcacgaggtgaggagatcaagaccatcctggctaacacggtgaaaccccgtctctactaaaaatacaaaaaaaaattagccgagcgtggaggcgggcccctgtagtcccagctactcgcgaggctgaggcaggggaatggcgtgaacccgggaggcggagcttgtagtgagcggagatggcgccactgcgctccagcctggggcgacagagcaagactctgtctcaaaaaaaaaaaaaaatcaccgtccttttttggcgttctgtcagtcaagagtattctgaagactatcgagggaggagtgtttggtttgtgccttgttttgttctgttttagcagccctggaaatcatggatacctcccttccttgaagttatctttcccatgtataacagctgtattgatttatgagatataattcacataccgtacaattcacccatttaaaatatacaattcaatggtttttagtgtagtcacagagttgtgcaaccatcaccgccctcgattttagaacattttcagcaccctaaagagaagccccatcccccttaaccgttaacgtgcttccttctccccactgctctagtgaccactaaccagcttcctgtctctgtgggtttgcctagtacggacatttcatcggaatgaaatcagctaacatgtgatatccttaatggttttgtagcagaaagacatctacgtgggaagggacgctgctgagtgtttagagaacagacacattcatcattttattgtattttctcaactttagaacagttttcaaacatgtggaaacgttggaagaattttatagcaagcaccctttgccccatcaccgagattctcccagcacatcttcttctgcttgctttatttagtgcacacctatccacctgttccagagatcaccactgcggcagtgggttctcaaaggagaaccttccaaccttcccgcattgagaaagaaaaatatcagttttactaaatgaaatatcaacattggagattttataagccgagaatgttagtacatcaacattagaagccctaaaaaataaaattgcattcaaaggccaaaaaagtcttaggcttgctagctctccaggaaaggcctgtgtgttcaggacaggaggactaaggaccaaacaggtttgggaatgacagatcccttgacggaactggctgacaactttgctcaccagtcacagcagggcagcccagggagtgaacaggggcgttggcggggagggcagccattcccgcccgctgctaatgggctcgcttctcaaaggagcttttgggattcaagggtttaagtatcaagtttgactgatggatttggagggaagaattgaaaactgcctgagggaaggcgctttgctttttcttttgtgaggcaaaagcttttgaaaactgtgactgtacaaagagccacagctcctctgaggagtctgttatgcggcaacacatactcagatgtggacagcagtgagcacgctgcctggaaagggggaacagcaccgcgggcaggcttcagagccacacaccacgtctctgtctcagagtctatcctcgaccacagggtttaagtctttgatgtgcacactgggccctggagagaaggtgcctgttctcacgggctgaccccacaagcctgtgagccgtaagcggtgtgattcgctaacagttgaatggcactggctatgtgtgtatgtgtatgtgtgtgcgtgtgtgtgtgtgtgtgtgttgtgaagatacatttagtttgagtccctatgaaacgaggagaaaaggtcttgacaaacaacagttcaatagctcctgccaatatgtgcaatgcaattctttttagtgagtgaattaggcttgataagaactacattaaagcttctgttggaagaggaattcaaaatgctcatctttgtaatttacccactcagtcaccagtgtttaccaagtgccaatggaagcctggagagaagagaaagcaaagataaataagcgtgtctctcggccttcaaagcactgtgcccagcaggaaggaaagcacacaattacgacatgccgtttttattgtatatatgtttatatattaggttgggccatgtgaaattgctgatgtgacgggttttgacgagagaaatggcaactgtgtggttcaacctaatatttagatagtattgtcttagctcaggctgccataaccaaataccacagactgggcagcttgaatacagacatgtattactcacagttctggaggctggaagtccaagatcatggttctagctggttcagtctctggggagggctctctttctggcttgcagacagccaccttcttgctgtgtcctcatgtagcctcatttccttggggcatgtacctggagggtggggattagggagcatacagggtctccttttataaggatcctcatcctatcagatcagagctccatcctcatgacctcatgtaaccttaacttcctaaggagaggcccacctccaagtactgccacaatgggggttagagttctatcaacatccgaatttggggggaacagcaacaaatgttcagttcacaagtataaaatggatatattatttatgtgcatatacatcatatactgttacatatcatagataagacatgcatattatacatatgtgtatgtatatatagtaaatataccatctatagtaataaggtttcacaaagaagagaaaatggaaatgtagagatataaaggaaatcatctttgtattactagtctttttattgccaaaaaaattttatttgcaaaacaaatataggctcatggtaaaaattttagcaactgagataggcaaaactaagaaagatgtaaatcccactagccagataccactactcctaagacccaggtcagacagcgaggcatcactgttaagagcatgggcgctatggttggacaactctatcacttactagctgtgtgtcctggacccagctacttagtccctcaccacctctgtttcttcatctatataatgggtcagtaatcccacccacatgaagttattgttagacttaaataagctgacccatgtaaagtgcttggaaattccctggcacaaagcaagtgctcaataaatattatctgtgactctattattatcatcatcatgatcataattattaccgcaactgccactagcattcccttccaaggtattttctcagccagcagcagcaaatctgtttgggattgtatgtcaagccctgtgaaaaagaagggtttggcacacagggcttcatacaaagaggggttttgaagctgacctggccattgccaagtcattaccgtgcttgtgagaagggggcagcgagcctgccacatgtttgcatgtggaccctcacggtgctatacacatacctacctactataaagatttacttcgtatgtgttgtcatcttgtcatgctgtgttcatcatggcttttaatgtctacgtagcattccattatcacttttgatcaacagttccctgattgattttttatttttctatagtaaacattgaaggagaaaatataattgtcgctaaatatttcagccaaataagtctgagctatgcattattctaaggccctctctcagatcttcacaatgcaaatctgagtattaaaggctctgagaattcttgcgcaaagggggacctcatttgatgttattaacctggcattccccagttttggaatgtgctccctatagctatttctttaagctaaataattagaggaagaatttctgggtcaaagaatatgtacagttccaagagattttcatttgtttccctctagaatgttgttttaggaactgacaaacttggagatacctccttctgggctaaactgtgactttttaaaatcacaattcgatgaaaagttcaacacactaaaatatacggtggtattcttttaaaaaattcatacaattgaactgggtacaaaggatcacctgggttttttgtttgtttgtttttgttttgttttcgttttttggtttgtggtttttttgagcttttagattcagggggtccatgggcaggtttattacctgggtctattgcgtgttgctgaagtttggggtatgagtgatcccatcacccagacagtgtgcatagtacccgatagttttcaacccttacaccccttccatgctcccccttctagtagtccccaatgtctattgctcccatctttgtgtctgtgtgtactcaatgtttagctcccacttagaactgagaacatgcagtatttggttttctgtccctgtgctaattcgcttaggttaatggcctccagctgcatccatgttgctgcaaagaacacaatttcatcctttttcacagctgcatagtattccatggtatacacgcactgcattttctttatccattccaccattgatgagcacctggattggttccttgtgcttgccattgtgcattgtgctgtgataaacatacaagtgcatgtgtctttttggcaaaacaatttatcttcttttggataaacacccagtagtaggattgctgagtcaaatggtagttctgttctaagttctttgagaaatctccaaactgctttggacaggggctgaactgatttacattcgcaccaacagtgtataagagttcccttttctctgtaacctgggcagcatctgtcattttttgactttttaataatagctattctgactggtgtgagatggtatctcattgtggttttgatttgcatttctctgaggattagtgacgtggagcatttcttcatatgtttgttgaccgcacgtatgtgttcttttgcaaagtgtctgttcatgtctttgaccattttgtaatggggtagttgtttgcttgttgagttgttaaagttacttatagattctggatattagacctttgttggaagcataatttgtgaatatttctttccattctataggttgtctgtttattctgttgatagtttctttgccaatttttgtttttggtgcaattgcttttggggactttgtcataaattctttgccaaggtcaatgtgcagaatgctatttcctaggttttttccagctggattcttttctcgtcttctggcaagtcagtttagaagaggttgatttattcagaaagtatccattttctttttctagacttcagacaggaaaatgtaaaatgagcaaaattctcgtgtataaactagctcaaaggtttgtggaagatttaaatgctgcatgacaggtagcaggtagtcgataaatgccagttgtgaatattgcttttcagattaaataacaaggctgaaagtaaatgttttggacaggctagctattcttcatacatccaacctaaaggtaatcatcctggtttatttatttattcaaaaaatattgaaaaattcacactgtgagccgggtcctaactagccctgaggatagcagtgaacaagacagtgtggagtttccattctagtgggaagaccggcaatgaacaagccaatgaatgtctgatcacacaaccggtgtgattacagcttacagctctttcccatgggagagtcaacagcttaatgggatggagagtaactggagaaggccaccttagatgggctggttaggagggagatgatgtgtgatctgaagagtgataatgaaccagccaaggggagaggtgagggggagaaaccaacagctaatgcaaaggctgggacgatgggagagcctggctagctttggactggggaacagggtgagttgatggtgggaggtgagcagtgatcagtccccaaagccacaaaggttttgaagcctgaaagggacatgacgtacattttttaaatctcactctcctgttctgtgagcaacagaatagaggacccggaaactgtagtagggttctgtttctacactagtgctaatgtagaacctcctacatccagaaagatgatagcagagctgagccacattcttcctggcaactgatgttcccacacgtagaaacagctggcatcctcatacagagggaggcttgcaggcccaggatacatctcatcccccttgctaatctcagtacttgacacccctgacctcaccaggggcaccaaacccaactgcttcctgcagggattcagctgcacttgtcatcacagagccttgaaatccctggggatatcaactccttggaattccaggctgctcttccacttgcttctgacacattgacttttctgcccattcactcacccatctttaaccaaggcctgtatggccagacatgaggccactcactgcctacatgaagagggaaagacaaagtgtatccctgggagctcgctaccttgtgtgaaaattacaacatcagatagtaaatgccttggtgaagatacgcatcccaagggcaggaagctccccaccttgatcactgcaaactccccagtccctaacagaatactgggaagatagaaggtggtcaaagcgtatgtatggaatgaacactggaaatcagtacacagggctgggaatgtgtgattctgagcactcagtgatggaaataaccctccagctccttcacagaacagccagcagcatcacctgttttggtgatggtgcctccggatgatgatccgtgagcgcacactggactcgtgctcctgggtgagctctctccttgtgaaacccagatgcttctgtctcccagggaccctgcagccctcccggtaacctggcctccatcacgaatgcagtctctatagacggttgtctattaggatgccactggagagggaggtcccgtcatcacctaagctaagcacagctgcctctaagtacctccttgcttggcagccggccagaccacattcactgagcttcaagtcataatgcgaggctcagccatctatctcactgtggtccccgctgcagctggcttcatttattgacttcttgaaagtggcaatatccatgctcagcttggtctgagctggactcagagacccaggtgccagagcaaaggccatggtgtgtcggttaatcacccaataaaaataaactctgagaacaaatacagaggggtgattaactttcccattctggtcttctgacatcccagtttgctctcccagtgagcgtgtttctttgagataaaccaccctgggaaactgatcacctgtccagacaccaccatgccttggcgtaagtggacaaaagtggaacgtgacctgcaagcagcgcagcctgagacttaggcagagagccccctgccccaggttccatgctgctgagggccttatcagaaactctgaagcagagcaccagactattttattctgctttttgctcttgtaataaagtgttattagtgtttagtcaccagattaaaccccaaagccttacctcccctcctgtgaccatccatgtactccaaatcatgaaccaaaaaacagggaccaccaacagcccttaccaaaagaagactggaagcacaaaaaagcaacttaccatgaatcaatttaaagtgaagaccaaagtgtgactcaaaactgaaaaaatatatgtatttggttaagatgtaattgttaccgaagcaccaggggtttggtctgggtcctgctgttcactgcacagaaagccaatcactgagacaagacaaaagccagggaagaaggctttaatcgggtgctgctgcagccaaggaaatgggaggtcagtctcaaatccatctctgaaatgaggggttgatgcaccagagaggaaatgtaaccgtgtttgggaaaacatggatgaaattggaaatcatcattctcagtaaactatcgcaaggacaaaaaaccaaacaccgcatgttctcactcatagatgggaattgaacaatgagaacacatggacacaggaaggggaacatcacactctggggactgttgtggggtgggggaaggggggagggatagcattaggagatatacctaatgctaaatgacgagttaatgggtgcagcacaccagcatggcacatgtatacatatgtaactaacctgcacattgtgcacatgtaccttaaaacttaaagtataataataataataataataataataaaaacagggattaaagcggggcaaggaagagaagttggtcagtaggaagcaggtggtcctttaggcaatcctgatggatgaggggtctggctcctcattatccagaggcagtggtctggtaagtttcagctccttgattttatctgggagacctgatggttggcttcttgagaaaggaactcagataagacaattgtaactttctcaagttttaaagtctggaaggaacaatttctgtggttattcaaaaaaaaaaaaacataagcgtcagttctgtgggacaatttgatcactttattttggagaaaaaaatgatgaatagaagtttgtttataagtttaaccccaataataggctagtctcacagtgaacacagatgaaccaagaattgctttgcttttgacataatttttacaacatcccacggcagtacatgccaaacttcaccttgtgctcagcttatgccctgcatttataaagagattgtctttcctaaccattcgagggctttgtccatttcccaaaggacctctccccagtcctttgccagtcaaatcactctttcgaagcagttgtaaatccactgtcctttctcttcttcaatcattgattcccttctctccattgcgttttcacttgtcatggatttacttatgattcctttttttcttcttgtattgctttacttgtaattagcaaataataattgtatatatttatgaggcataatgtgatggtttggtctttgtatacatagaaactttgatcaacatctcccccttcttcagccctctccctgctgccatgaatttgactcttttagattccacagatacatgaaataataaagtatgtgtctttctgggcttggcttatttcacttagcgtaattcttatactctgagtatcctcgtagaaccctacatcttttgtgagattgacagtcatactttgtgctggactggtgcatctttgggatggttttgtcactgggcgataactcatgaggtctgctgaccaggtagataccaggagtaagcaggatatttggctgcaagagagaattataggcctggtcgggagttcattcaggatgttgtaaatggaatactggggtgatgagcagtccttgtgggtcttgttcatatttgtatatattcaggcctaggaatgcagggaaaaaagggataaaacacactgaatgaaaagagtgtgaacaaatggatgaagagcctcacaccaagtaaagcttacgttgctaccaactggtaccaaactccaagtcgtcctgttcttttccaagcgccatttctgctgcttagaaaaagccacccaatctggatacatggatgtagcaaatttaaccttagacctagattacctataggatcagacttgatcagtcattaataatgataatgaaaattaatcatgaaagctatcttgtggttgcaccttaaagcatctgtgtaatgcttttacccatactaagagtgttcaatccctgttttcacctaggattgataagtgtatttctggatttcagaaatcggatagcttctgaagtctcagcctgttaatatggtaactaaatatgttaaggtcctagtctctcaatgtttaattactgtttaattttttatttcctaatttactcaatgtgtatgatattgttaaatttgtggctttataccctgaatctctttgtctgtatttctctgtattgcttggcagtcaatttggtcaaaagcaacaacgaaatgacccttacgaagtgtcaaatgtccctttatatgagatataaatgtctttgcaaagacacttataaagttgtgaagacgttgtttccttactctaatagctgctgtattcacgtaggtttcaaaaatggggtgggggagggcagtggcagtgagcgcctagcggaaactatgtcaatcacccctggaaataaatctgcaaaatggactagcaagccctgactaggaagagcccggccacagcaaaatcttattgcaggcacaaaaaggtcctattgcagcagttgggagacctttggtaaattctaacaaagaattaatggcctcgaacaagacgcccggtatgacctttgccagaagaaactaggagcagacttgcttgcctggaacaggtggtgaggaggttttcagagaagatgtgtgcagtccctggcaagtagctggtgcccaggaaatgtcagttccattgtttgccagggaaggctcggtgcacgtggggctcacacacaaaggaagaggttagagagtccgcagaaaagggtgggagctcaaaacagtggttcttaggcgtttgtctgcaggcacgctggtaattcatgctgaccatgcccacaatcagtggcacctagctgtggccccacccctttcctgcccactattgaaagtgactacatggcaaagagcgcctatttcctagactaaatcattctcagacttaagttattagtgagcgctgttagactcaagttccttgatatctacatcacaactgagtagtttatctcagtggtaagtctcgaagtttgacttcgaagttactaagagccttccaataaaagaacagtttaagccaatattgtttcaccattgatagtgatgaagatattaaattcacacacatgtgctgtgtgattttaaacctttctcaaatgtgtatgatttttataagcagaaatataattttaagaaagctttatatctatgtaatagggttcttttttttttgggaaatattgccatcctgtaaattccagtcctatgttcctgagttattccccactaaggaaagcccagctgtgggacatagacctggtttccacctcagagtttaaatcattattctcagaatggtggttctcaaactttggtgaatcagagccacctggaaaacatgttaaaaatggaaaggtcccatcatatcatcaacagccctgatcattctgatacacacccaaattggagaaccagtggcacaaacaaatgcccaaccctcgtgggctattcacaaggcaaacaaaaatcaagctatgcttgggaggcagagatccacattggaaccacacttctgctgctggaaagctgcatgactcaggcaagctcctagaccactctgagtctttgttttctcatgtgtaaaataaggtggtaatatctacctcccaggttgatgaggcaatggcagacagtaatgtatatgaatacatacatcgtacgccacctcctcagtgatcaatgaatgtgcgcttccagttgtagacacaacagcagaaagttaatgctgaaaaataggaaaacactcacaatgcatgatttacgatgtgagggagcctgctggcatggcccttgtcacgagagtaattaaataaccatttgtgtaattactaatttatatcctgtctccctgctggagtgtaagttccaaaaactggagggaatacactgctgtcttcccaacaccaagcgcggtgcctggcatgaaacagacacccagcaaatgtttattccaaatgagcgagtgaacagtacgtcacattaaaaacgtgtgtgtttatgtatacatcgatacataggctggaagcctctaggcaaaaatgttaatagtgcttatctctggaagtggattagggtgattttaatttttttcttttttctcctccgtattgtctgaattttctgcaattaacacagaggaccaaactagcatttccttgggtaaatgcgagtggagttggagccaccccctaccactgtgcctacaagagcatgttttcttgtgattccagcttccttgggggtttcaatatgtagtctctagaattaaaagggttttgggccaggtgtggtggctcaagcctgtaatcccagcactttgggaggccaaggcaggtggatcacaaggtcaggagtctgagaccagcctggccaacatagtgaaaccccatcactactaaacatacaaaaattagccgggcatggttgcacatgcctgtaatctcagctacttgggagcctaaggcaggagaatcgcttgaacccaggaggcggaggttgcggtgagcccagattgcaccactgcactccagccttggcaacaaagggagactccgtctgaaaacaaaaagggggggtttaggagaaataggaatttagtgatttctaaagataagtagaatttgttcttattcaccatttccttgtcctgatcatggactatgcaaaaaagagctcacacaacaggcctgagactgctgttcctagaaagacctgcctacaaggttggcctcagctggtatgtagaatcttggatgtggggagggctcccactctcttagctgataagagtgactcactgcacctaaactgcttgcgcgaacaaatgtggtttatgctgaatatctgttttccccctgggagtcaagaattttgctaatgccatgtggagggtgtctacgtgaccagccccccaaaaaaaaccctgaatgttgagtcttcggtgagcttccctgatggagaacatttcacatatgttgtcacaacttgctcctggaattaagcacgtccggtgtgaccccactgggagcagactcctgcaagctggtacctggtttccccaggatgttgccccatgtgccttttttctgtgctgttttccctgcgtattttccctgtgataagttttaaccattgaatatgacaatatgctgtgttctgtgggccttcctggcaaatcactgaacctgggagtggtcttcgggacccccagcacacaaacccacctaactaagccccctttgacagcatgtatcagatccaaggcaactaaagggatgggaatgtctggagcagcatagaagtgggagtttggctgggacaagagagacaggtggctcttttgagagacctgcctatgggggagggatgaatgagcactttagaattctgggtcacccagcacatgggtcaaccaatgcatgttaaagaaggtttctactctcattcattccctcatgcatgcattcaacaactgagtacctacccactcagtgtgtgcgggccactcttctagattctatgtatgaagggttaagtaagatagatgaggtcactgccccttggagctcacattctaagttgtagagctggccagggaaggaggcagacttcagagagaccatccagagtggcttctctagggaacacagaggccttggtgttggagctgagatcctacaaagcacaagacacacatgagaaaatctaagacttatccgatgaggcaagtagaaatgtgttgagaccagaaataatttactaatttcaaggaatgaaaggaaggccagcgagtctgtaacttagggaggctgaggaaagaggtagaaaatgcaggtagaaagtcaggcaggtccagatggatcctctaggaccttagagaccatggttaagagtttggattttattctataccccatgggaagtcattggtgggttttaagccggggattcacactctgtgatttaacactggctgctctttggagaatggactgtagcaagcagaagagaagcaaagaatcaggtgcattgcagtggtctacacaaaagacgatccctagtcgtcttaccacctgcctcctacaataaccaaagaaagtggacccacaccacagctacctcggtccactgcatgtgtggaaggtgatgattctcttgggcatgatatatattacttgttgtcatggtagggatcagaatgtctgtaaaaagcaaagttttggtccatgtgccatcagaagatgccagctgccatatgccagtcagaattgtcatgtgctagagcctcatgcagatgtccacaggatttcaccaggagctctgggatgcctgggaaggggatccagggaagggactggagatgtcaagagctcctgccctgttctcagctgttatggagtcacagaaggtcatacctacatgaaaggcaaggcaagaagtatcccatcctcccaaccccaagaggccctgcccaggccactcactggacaactcttcttgtccacatctgctggttgtggcaccccatccctgggaaatttgctaatttcaaggaattaaagaaaggccagtgagtctgtaacttcggaaggctgaggaaagagatagaaaatgcaggtagaaagtcaggcaggtccagatggatcctctagggccctagagaccatggcagtcctttctgtttactgagactgctttctttggctctggtttcctgggacaggaagagaacagtaccctggactgtgatgggctgtgactgtctaactaatctaggattctggaattcactagccattcaattttatccatacattttgtcagaagatttgaaatatgccctttactttacactcagggccatagctacatgagctattttaagatagtgtatttccttcaattgggagttctgtctctttctggttctgcttttaataataaatacggggtccagtggactgaaattaaatagggtgtgaagaattcccctactgtttcccttctttcctacagttttacagggttgtttgtatccttcagcaggaatataaaaataccctgtatctcctctcctttcgtagtttttattttctacgtttctcatagtctttcctatcctactatatatatgtgtgtgtgtatatatatatatgtgtgtgtgtgtgtatatatatgtgtgtatatatatgccatatatagagatagatccatcttccatctattactatatctataatctccctatatataaatttgatacgtatataatctgtgccatgtctagtgctctgctatattgcattgatccatttggctattgtgcactaattgcccaatattactttatgacatttttaagtctaaactgaaaggaaagctatgctcagtcatgtaatgttggcaaccatgctgcgcaaacatgggtcccctacatcaggggtccccaacccctgggccacggacggccccaacccctgggccacaacatcagattgttattggagcacaaatcctattgtgaactgcacacacaagggatctaggcggcacactccttatgagaatctaatgcctgaactgaggaggaacagtttcatctccaagccatcccccacctgttcatggaaaaattgtcttccacgaaaccagtccatggtgccaaagaggttggggactgctgccctacctcacagaaagcgagtgaccccaagaagcctgcagaagggacttgtcaaacctttgatctctttcaccttcccaccaatacttgagcccctgagggcagaggctggcagcccttggctctggaagtccttccaggtcaacagctggccctggccacttgcctggaagctttcttccctgctctgagggggccctgctgagagtgagcccgccttccagggtggcgcaggccccagtaacccccactgcgctgcctgcgactcgaattctgttaatcagtttgccttgcgtctcccaacaccgacacccagaagaggccgaggcttggcaagcactcagagcagcttctgtgaagctacattacaggctgaaatgagctcagcttttaatttgattttttttttcctgtaacaagcaaagttcacattacagataaattgcccggaaattccaatttaataaggcgtatgcatttttcaggcctagaagcattgaaaacatcttgcacgctagtatttttacactgaaaggtttattaaaaagacagctttgaaaatgtcagaaatttacatagcgcgcctggccgattggtcaaaaagcctgattggacaaaagcgcacggaagccaggaagcgggagagcaggctgttccgtggtcttgagctgttctccctccacatcgggaacgatggctccaccgttcattgtctccacccagctcttagttcatgttacatgggtgctcagcaaatgagtgtccgtctgtcctcctctgtctgcaggtgtgtttctgagtaggagcagcaagctgtccttccagggcatctgtggggcaggcatacctccttgaggtctcccatgggaggaggcaccaaacaaaataagcaaactggccaggtgcggtggctcatgcctgtaatcccagcactttgggaggccaaagcaggtggatcgcttgaggtcaggagttcgagaccagcctggccaacttggtgaaaccccgctctactaaaaatagaaaatttagccaggcatggtggcaggtgcctataattccagatatttgggaggctgaggcaggagaattatttgaacccaggaggcagaggttgcagtgggctgagatcgctgccactgcactccagcctgggcgacagagcaagactccgtctcaaaaaataaaataaaataagcaaacagaggggagcagaaagagtcctgtgaaaactcagttaaatagcacagctctggatacttgattatttttttaaggaggaaaaagagtgagacattgtcctgtaaaatcacccaaaccctggctttccctggaaatgtggcgcaggcaggcctaaccgtgctgagtattgtttctgaggactgcctccgagttcatgtctctaagcattttattgaatacaactgcttctttgacaagaaacaagcaaacatgctaattgtacaacaaaattatggcatcatgggacaaaaaaggaatgacagagggagcatcaaagagcattgcttgtacgccaaacatgaaagccaaatttatttaattcagtttttatttatcttctaaactgagttgagtaatcaggcaatagaatgcggttcatttaaaactttcattatttcaaatatgttgaaccactaccaatcactcctggatcaacaggaaacttgctacctgatgagttgccttttttcttttttctttttttttttttttttttctttgctttttccatccccatgattgttccaacagaaggagaaaagatgtaataaacctttaccgggcaccgtctgcgtccaggcactctactcggccctgggggtgcagagcacaccaccccagccttaggcatgaaaaacactgtgtaccgagaagcccagcccctggaatccagcatgctggtgctacattccagctctgtctcttattaactgggccgcttttgacaagttgctaagcctctctgattcttggttacctcaaccttaaaacaaggatgatacccacttcatcaggttgtcatgagtcacaaaaataaatgtagtgatgctcttaaagggtttagcaccaagctgggcccaaggaagcattctgtgtgtctattgaccaacttttacctatcctgacaccaaggagcttagagtttagtggagatggcagagccgtcagggcccgtgttaggctcccaaaggcatttttaccagtgcatgtgcctcgcacagacctagtgaggtgattaattctactgggaaagtcacactggatgaacgagaggagacgtatgagtggggtcttgaaacagtaaaaatttgccaggtggaagcataaatgactctttaaatgaaagcctggtgtttttaaagcagttcattctcatgagtaattcatcgcttctgttttcacaaaatagtgaaaggatcattgcagcagcaagggcatgtggaagccctgcgttcgcctcatccgttctccccatctgtcccctgtcacagttgcagcatcaaaacattgttcccctaggctctgctgagtcggatgtttctgaaacattccaggggaccgtgtgagtcacatcagggaggacacacagggccatgaccccagtgagccattaacacacccatagcctgactctgcaacggctcccccgagggcgccccgcacaagaccaagccctttgtgtcagcttcagtttgccctcacagctaccccagaacaccactgggactgtccccgagtcacagaggaggaagtagaaacacagagaagtagcttgccaggctcactgttagaacccaggtcctttcctctccagagtccatgactctaacactcatgtgatgctggcaatgtgaacggctggggggaagcagcagagggtgacagcaggccttggcaccagagatccagcctgcgaatcccaaccatgccccatattagccaatgatcttggcaaagttcacatatctctaggcctctcagttcctcatctgtaaaaggggaggaataatattatcaacctcccagggctggtgtgagggctgaaggcatagatgctggaagctcctggagcggtgtccagccggcgcaatgtaaggctcgatgctgctgcagctgtgttactattaatattaaagggaggctgcaccccgaggctgttttaggaaagaacaggccagacgccttccaggaagcatcagcaggagcctctcctggcgtccttctgcagtttgggggtctggtacatccactttgcaggacaaaaacttgatttgattctcaggtcagttcacatgaccccaacacaaaaaggattgataccaacccagaccgcctctgtgtgaattaaatttacaacagcgctgtatcagagcatctgtcaatgctgactggaagcccaaagacctccagatgattggttctgagactccaggagaggctgggaacactcggaggggctctggatggtggccaggcgagggtggtaggtgaattgctgtctgtcctgggtcgccatgaggcttgtggtgactgcatagatgcccattccctttgtcagccagcaatttcttattccctggctccccttctcaacaacccaagttgaccatcccttcttcagtgaccacagcctcccccaggtaacaatcccattgcagcccccaagatgacctttaagtcatggacaagggcagttcttcttctccttggccacacaggaggcatccctctggcttccacctacatctgaataatcccacccaccacacttcgattcaacttaactctatcctcagaggccaccttttctcagaattcgtatcttcttcgaagtaagatccttcaggtgaaacatacctgctgaccacccaccctgagtcactaagttagctgggaagcagcagttttgagtgtgggttcagggtcgcagctccaaggtcagaccacctgggcccacgtcctgactctacgatttgcgtagctgttggtttgtgcctcagagtcctcatctgtaagtggggatattatacctactataataaattagtaatgccacggtaacaaagtattgcaaacatggaggctagaaatttattctcccacagttctggaggacagaagtccaaaatcagtctaactgagtcaaaaccaagacgttggcagggccacgttccatctagaggtctaggggagggtccttcctgccactccccacttctggtggctgcagcattccttggtttgtggccacatcactccaatctctgcctccacggtcgtgtggtcttctccttttctgtgtctcaaatctcctctgcctccccctgaggacacttctgattgcatttagcaaaccacaaacaaccccaagataactcaaaataatctcatctcaaagaccttaactcagctctgcaaagtctttgctctatgaagtaacattcccaagttccaggattaggaggtagatatctttttcccgtgaagactcggggttaacttgctccaagcccttcagttggagattttcaatcctgttggttaaatcaggttttaaacatccttagacccaaatctggccatacaaggcagagaaaatcaacttcatgcatctttaccagtgtaaagattcccatgtcacttcatggggatgtacttcaaagatgggtaggaaatggcagcaaagtgccaacagcatctttctggcttaggtctgcaagtggcacattatccaagccacccaattcaaagaaagctgagtcatgcccagttgagtctccctgatagataagactattatttcttactctatgcatctatattgtttaaatctcaaaagagcaacctcaaaacaagtaacattttaaaatcttggatggtttcccattatccaaagtcaaaaccccttaaaacagtagttcaggttctctataatattgtctaatctgtttctcaaaactcattaacttttagttcccttaaagaaactgtttcaaacacaaccctctactttctagtccctaaatatctgtatattcaacaaatatttagtgtcgcatatgggctaagcagtgttcaagcagctggtgtcacagcagtgaacaaatttcttgccctcgcgtaacctacatcctaatgagtgtttctgttccatctgtaatagtttggctgtgtcctcacccaagtctcatcttgaattcccacatattatgggagggaccctgtgggaggtaatcgaatcataggggcgggtctttcccatgctgttctcgtgatagtgaataagtcccatgagatatgatggttttataaagggaaacccattttgcttggtttcactctctcgtctgccaccacgtaagacatgcctttcaccttccgccatgattgcgaggcctccttagccacatggaactgtgagtctattaaaactctttcttttgtaaatcactcagtcttgagtatgtctttatcaacagtgtgaagatggactaatacaatttgttaactcatattctctcttcctggtttgtctgtcctctcactctctgatgacatcctatctattcctcctgtcttggtttggatgctgcattctctgtgaggtgcccaatattgccctggatcagaggtagtgagttcttcctccaagcattgatgtgccctgcttgtaccttcacaacagcacttctcccactagtccacatacgagatacatctgaggtgtgaaagaaacaagactggacgtggactcaggatttgggctgtgaattctgctttgcttctgtgagagcttggcagatggcaagaacatcttcctcctgggagtgtcaagaggaataaaggaggcacacatgcaaagtgcttaacacaaagcagacccagagtcagtggcctcttgactttgtgaatgagcaactgtaacagaaatgatggttttggatttttgttacctaggatccagcacctagcctaggagctcatgccctgcactctgtaaatgtttcttgaatctactttgaatgcagagtctgacattgtggggatttttttcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggtgagtacttgacaaagaccatcaagggtatacttttctgctacaaatatacttttacatttttaaatttcttctgatacacccaggggtgttcttgggaagaatgtaagtgtgtgggaacagcaaagtaaatgtttaaatatacacatgttgagttcagtaatatctccaagtcccagaatcctcagatctttttggaaagtgaataatgtctggtgagaggtcagagcaatgaactcaccctgtcccatcttgggcaggcgtggaggttagaaagccacgctgatgtgctttgtcttggtgtcatgctctcatttgcaaagaggctcttggacttaatacaagttgaaagtaagtcccagaggacatcactgaccctgaccattgaattgttcttgtagcttttatcctattatgacacgctgccaaggaaaggcatcaggtaccctcagttagtggctgcacaaccacaaagcaattgctgttcgttcaaaagatggtaatgcactatccatatgccagcccctgattagatgctgggggcgcagcagtaaacaaaaagaaagctgtcctcatggagctgacgtgcagaaaggaggcaaagttcaaagtgccacgattgttctctgctcctttgagatcagactgtagggcacaagggcagaaggagggcaacctcttaggagagtgcatggtaatctatgcaagatggtggcctggaccagagactaggaggggatgagaaaaagagagttcctatatactttgaatgcagagctgacaggatttgccgttaactgagatgaggggattccagttggtttggggacatgttaagctgcaatgtgtattgtgtcaatcacacaagaagttttgttctccctattattcctaaaagccagctgtttatggctaaagattcagttttgagtccttccatatcaagatgaatatttataggtgcccattgttatactcaacaagggtgaactaagagttctcagtcctggtcctcgtatgccggctactcacacaaaccattaggagacaagtctaagaagtgagcaatccatgtgacacacaataagtagagagtgcttcaaaataaaggtgagccttggggttagccttgaaagacgggtaggattcggatgagtggcattacccagaaatccaaggcagaggaatcaaaactagaagggggcacagcacaggaggtaagaaaaggaaaaaataactgttgtgtctgctataagtgcgtatgtaggaatctatttggatgtatgtggaaaagtcacatcttcaaagccagatgattcatttgatagaacagggaaccaggagaccctgaaacttcttgaggaggaaactgacacgatgaaatatcaggtagacaatgttcagcaactgagagctggaccagatcttgtgcttggtcctggagactcatggatgaataatacatggtccttgtgttcagagggctcatgaattatttggaaggttagtcaagtacacagaagatcacagtagagtgtcctaactgttctgatggagctaagcccagagaagcccctgtccagcctggggggtagtcatggagagctgcctgagagaggggacatctcacctgcgtgatgaaggatatgtggattaaaggtagggcatgctagttctggtgttgagttagttggcagcttctgattggttagccttaagtttcgtttttctttaacatagtcatttataagaaatagctcatgttggctgggcacggtggctcatgcctgtagtcccagaacgttgggaggctgaggtgggtggattacaaggccaggagtttgagaccagcctggccaatatggtgaaaccccatctctactaaagatacaaaaatgagctgggcatggtggcacacacatgtagtcccaggtactcaggaggctgaggcaggagaatctcttgaacctaggaggcagaggttgcagtgagccgagattatgccactgcactccagccggggtgacagagtgagactccatctcaaaaaaaaagaaagaaatagctcacgttcagttttgcttatgtttgcaaatcaagcaaggttaaggtgacttatgacacctaactggctttttctgcccagtggttcttcaggcctaatttccattttaatttactttaacaattgatatgactgaactgtgtcctctcaatgttgacgtattggagtcctaatccctggttccatagcatgtaccttatttggaagcaggcttgttgcggatgtggttagttaaggtgaggtcatgctggagtaaggtgggccctgatccaatatgattgatgtcttcctcaaagggggaatttgaagacaggcatgcacacagggagaacaccacataaaatgaaggcagagatcagggtgatgcttctgcaagtcaaggagttccaaagattccctgtaaacttccagcagctgggggagaggctgggaggagagccttcctcacatccctcagcaggaaccaaacctgcagatgcttcagtcttggacttcaggcctccagaactgtaagacaatagatttctgtcgtgtaagccactcctttgtggcactttgttatggcaactctagcaaagtaatgcaagatttaatggagtcattacctataaagcatttggaacagtaccttgcttgtagcaagtgcttaacttaactatttaaaaaaaaaaaaaaacaggtaaagcattctagtagaataaagatgtgagaagttgggaagttggtcagcattagtggaagctagcatggcaggttctttgtgtgcaaagataagggcagagaagcgtgtggataccggactgttctaaggttggaactgggtcttgtgctgaatgcccagcacctaccatggtgcctgacttagagcaggcactcacatgcctgtagaataagtcatgaaatcaatcgtgaaatgctccacatgctatgccatggactttggccttgaaaatgtcactcacttgcctccagaataaacattgtgttttacaaagatacacaggcacagtggctcatgcctgcaatgtcagcactttgggaggctgaggtgggcagatcgcttgaggtcaggagttcaagaccagcctggccaacatggcaaaaccccatctctactaaaaaaaaaatatacctcccctccacaaaaaagaaagatacatcctatagcagcatagaaaatggacgcggtgatggcaagatgtgaggagggaggcattaggcagctgccgcagaaatacaggtaagagaaaagagaggaccaagccaaggtagtgaagttagttggggaaaagtcagcctgcagtgggtaaatgtgttagaaaccatagcaggtatcttagttgatggggtcagagtctgcgcaagcataacataaacggaccagaggggaagaacctagataacatctgaaaggaagaaacaaatctttgtcaagagcttatactgaacatgagctagagaaatgcaatattcaggtttctggtccagaaatcaggaatgactatttcatcaacgtaaacagggagtgagtttcagaggactggtccttcttgttttcggagggtgggtgttgagattacgtcccagaagaagctggcaagatagaaatggaataaggagagattttgattagggagttgcccatgcagaagagatgcgacttatcagaacagaaaagctttccaaaaggaagaggtctggacagagtactgagtacagaatcagggatgaaaataagccaagattgtttaaaattctgtgtaaaatgaaaagtatccattactgatcagctaaagtaacaatggcagggttctgtagtatgtagaagtatctgtatctgtggagaaatttctcagcaaagaatgtcaagaagcatggatgaaatatagcgtagcatggctggcatttctttgtgaaattttttgtgcaattataaatccaaagaaactagaaatgcggtatacttgaattgttaccagaagcgagagccttctttacatgtatgcagtaatcagttaagtgacactgtgtgcgtatataccgtgtcccgaatattaagaagaacaaaaccaaaatttgcagattaagaaacagacaccaaatttagttggctttctaaaagtcgtatcattaggatagcatttttctacctttagtttcttgcatttttaacagtctttaaaatttctgtgtggaagcagcaatctggtctaaacttccgccataccacttactagctatctgattttgaagaaataatttacaatgtagtcaggacctaatgataccttacagctgtttctcatctttgagactcattgagtctcatctatgttttctcaacattcagcatacacctgtatgaactgtctggctgtgtaactgtgaaagcttctcacagactgtgagtctcattttctacatatacaaaatgaagaagataattcctacttataacgttgtgagaaatgagtgaagtgctgtaccctctagattctccatcaaaagccatattaaatgttcactacatgttaatcccacccaggtgggggtttcagaaaggaaagaatagagccaggaatgatccttccatgacccaagaaatatacagcttgaaatccacttgttgtctaactctgttaacgctaatatcagacacggaaatttaaaatctggtaccacagatgtttccagagagctaaaatgtccccaaaggtgtaatggtaaatagaaaccaggttggcattaacatacaaaaccatcgttaggaataataatctcgaacaagacccaaaggacttacagcaaaaagaacataaattaaaaagcccttataaatcagagcaacttttatttaaaagctcctttttgcctcaccaaaaacttacctctagtattatgtttaacccggaaaagccaacactatctattagatcaaagttagtaggccaagcaaggtggcttacacctgtaatcctagcactttgggaggctgaggttggcagattgcctgaacctaggagttcaaaaccatcctgggcaacatggcaaaactccatcccgaaaaagaatacaaaaattagtcatgcacagtggcacatgacttgtagtcccagctactcaggaggctgaggaaggaggatcacctgaacccaggtaggtcaaggctgcagtgagccaagatcacaccgctgcactctagcctgggcagcagaatgagaccccgtctcaaaaaaaaagtaaatagtgctaactgatctctcaactttatccaaagtgagcatttgtttttattagttttatagaaatttaatttatttgatggaaggagagaataaggatttttggcatataacactaggaaagctgaaccaaaataaattgatttctccaaacaaagagtaactcaggaatttatgccaaaacatgttgataaaatatatggcttcgggaacttccatgtaggatacagtacggaagtgtccccactgtgaaactagaaaaatctagttaaattataaaaatcagataatataaaaaaatcttaattgtaaaggaatcagggagctgcagaagcattgacaactagataaactaaaataccaaagagggaaaagtcatttcaaaaagaaaacctttttttttctctgggtgcattttctgattctaggtgagagtcaggcttggcccatgcagagagcctaggatggagggaaagaaattagaaacgagtgtcagaatcacagggagcttttgtgacaaactggaaacttgaggggctgcttttcctctgtggacaaatgccctaaaggacagagtgaaatctccttgggtctcacagaaaacagagacctaccaaaggaagcaagctctcctcaaatacatagccattctctcatttaagatatttgccagattttgaaggtacaaggagttaaaggatggggtgtgggatggctggagagttaagatggtaaccactgaagggaagaattggatttcctggagcctttcagactaagatactccagactttcaatcaaaatcccagtagggccatgcccagcaacaggagtaagccagaagttgactcagtcttgttcaacttgcaatgcggcctgacccttttcaagcccttactaagttgatgaagcaaggctccatctgatacagtttggctctgtgtccccacccaaatctcatcttgaattgtactcccataattcccatgtgctgtgggagggacccagtgggagataattgaatcatgggggcagtttcccccatactgttctcatggtagtgaataagtctcatgagatctgatggttttatcaggggtttccacttttgcgtcttcctcattctctctttgcctgctgccatccctgtaagatgggacttgctcctccttgccttccaccatgattgtgaggtttccccagccatgtgaaactgtacattcaattaaacctctttcttttttaaattgcccagtctctggtatgtctttatcagcagcatgaaaatggactaatacatcatcctatctgactaatacaggagagggaaaaactcatagcaccatatgtcatctggagcctctccaatcttttttttaataatgcccaatttacagttttataaaaattacttgacctgtaaagaagcaagaatgtgtaagtgatgaacaagagaaaaatcagactacagaggatccagatatttgaattagcacacaagaacattaaaataaacatgattagtatgttcaaggagacagaataaaagatagattcaagcagagagaattacacaagagatctgaaatctttaagaaggaatcagatagatattccagaactgaaatacatattatcatattaaaaactcagtaagtagacttaacagcagaacacaggatttttaacctggaatatgaatctatagcaaacaccacaagggaagcacagtgaggataaagaacgggaaaaaatctgccaaaagactagtgtgtggaattggagttacagaaggataggagagtgctaatggagcagaaaaaaaaatttgaagatgtaatgtccaggaattttccaaaactgatgaaagacattctccctattaaatcaaaaagtttagcaaaccacaagctggataaatttgaagaaaaacacacctcaaacactgaaatcaaactgatgaaaaacaatatcaaagagaaaatgttaaaaatagcctgagaataaaagaggcatttacctgcaaatgagctacaatatgacttatggctgacttctagatagaaataatggaatgtggaaggcaatggaataacatttctctgagcactttaaagatgcctaccaacctagaattctttagttctcaaatttttcccttcaaaatcaaggtgaattaaagacttttggggcaaaaaaaaaaaaaatggaattgtattgcaagcaggtttatgccttttactgaagagaatatttcaggcagagggaaaatgatgccagagaggcatagaaacacaagaaacataaataaaaatagaaagttaaatatgtataaagtaaaaaagtaaatgaagtaaaattgtaaggacataaggagttaaaaatatttatagaactaaaatgcatgacagcagtaacagaaaaagtgagaggctataaacatagttaaaacagtttctgcagcattggagatgtagttaaagcaatactttgtattagactctaataagtcaagtatctatattgtataacccttagggtaatcactaaaagaatataaaagaaagtaaaactaacaaattaatagaaggaaataggtttgactaatccaaaataagaaaggagggggaacaacattaaaaagatggccaaatagaacaacaaggtgatacagtaagtatatacctaattataccacagtaaaatgcaaaatgtaaacagattaaatatttcaagtaatattatcagactatttttaaaaatcagcaaactggatgctacatacaatagacacactttaaataaaagaacaaagaatggaaataaaagaaaaatataccttgatagtacagtctctcctaaaaacacatgaaagtattttttaaaacaagcttgtccaacccacagcctgtgggccatatgtggcccagaatggctttgaatgcggcccaacacaaatttttaaactttctttaaacaacattatgaaattttttggcgctttttttatagctcttcagctactgttagtgttagtgtattgtatgtgtggcccaagacaattcttcttccaatgtggcccagggaagccaaaagattggacacccctgtttaaaacaagaaacatgacaagaggtaaagaggccatttcataatgatgaagggaggtatcaaaaagaaggacatcacagtcctaaatctgtatgtactggacagcacagattccaaatatacagagcagagaaaactaaaaagagaagtagacaaatctacaatcattgtgggagtcttaaaacatctctcatatcagcttcaagaaaaaacaacaaggagtaaagctgtaaaagatttgaacaaaataattaacaaatttcatcaactaacatatatagaactctgaactcaacaactgagttcattcttttcaaattcccaaggaaaattacctaaattgtttgcatgcagagcatatagaaaagtctaacaaacgtttttaactgcaattatttctagtatatcctccaatcacaatggaattaaactaagcattagtagcaaaatataaccagaaacaccctaactgactgaacataaaacagtacacttccaaataactcataatcaaaaacaaaaatagaaatatgaaatgtcaaaacttgtgggatgcactaaaccagtgctcagaggaaaattctagaaaataggaaacaaatatacaagacaaaatcaacaaatccaggctgggcacggtggctcactcctgtaatcccagaattttgggaggctgaggcgggtgaatcacctgaggtcaggagatcgagaccagcctggccaacatggcaaaaccctgtctctaccaaacgtacaaagattagctggatacagtggcatgtgcctgtaatctcagttacttgggagcctgaggcaggacaatcgcttgaacccaggaggcggaggttgcagtgaaccaagatcgcaccactgcatcccagcctgggtgacagagcgagactctgtctctaaaaaatttttaaaaattgaaaatcaacaaatccaaaagtttgtcctataaaaagattgaataaaattgtaaactcatatcgaaactgttgggcaaaaaaagaaaaaaacacaaattaccaacactgggaataaaaaagggaaaatgactatagccatcaaaaagatacaaagatattatgaacggcattatgcaatatatttgacaatttggacataatggacaagtttccccaaaattaaaacttatcaaaaataacctaaaaagaggctgggcatggtagctaatgcctgtaatcccagcactttggaggccgaggcaggaagatcacttgaggccaggaatttgagaccagcctggccaacatgacaaagccccttctctgctaaaaaatacaaaaattagctgggtatggtggtgcacgcctgtaatcccagctgcactctgtcccaaaaaaaaagaaagaaaaagaaaagaagaaaatcttaactagcccagtgcttatggaaaaaaaaaaaatgttcttgaaaaccaaaaagaaaactacagatccagatggctttgctacatgtttccaaatatttaagaaagaaaaacaattttatacaaacccttccagaaacagaaatagaagaaatacttaatccctctttttatgagacaaggtttttccaaaacctgacaagatcttacaagaaattaaaattgcagaccgatctcactcatgagcataaatttttaaattcttaacaaaaatattaatgaatcccacaaaaatgatatgatcatctcaagagttgcatttgaaaaaaattcatgttgatttctgatttttttaaaataatgtttagcaaactaggaaacttttttagtctagttttaaaaaaaaaataacagaaggagctgctgctacagcaaacatcttcctcaatggtgaaatagtaaaaactttttttgtgacctcagtcccagccagagcgagaaggcaaacaaaagaaatactaggcttaggaattaaaagtaagaaatctctttattcataaatgatatgcctaaaataatctaaaagaattttcagagaatctattactgattttagtaaaggtcatcaggtataagatcagtatacacaattaattgttttatataccccagcagtaagcaaatggaaaataaaattctaaaagatactgtttgcaatatcatcagaaacaccaaatagcaaggtataaatttaaagaaagatatgcaagtcctctacaatgaaaactacaaatgactgcctaagataatttttgtctccctatttaagcccacattaacggagagatataccatgttcatggattggaaggctcaatggtattgaaatgacaattcttttcaaaccgacctgagggattcaatgcaataccatgcaaagtcccaatcccagcatggggatcggggcagaaattgatacactgattataaaatttatatggaaatacaaggagtgaaaaatggccaaggcaatcttgaagaataagttgtagaacttacactaccgtacatatatccagacgtattagaaaaccatagtaattgaaaccatggtatttgcacaaagatgggaacaagctgaccaatgcaatagaatagagaattcaggaagaattccacacatacccagtttctgattctaacaaggaaaacacaacacagcagtgcaggtgagaaagcatggtctttcaataaataaggccaagttgattgaataaacatattttttaaaatgcatcctgaccccctcttaaaccatatacaataattaattctagatatattacagatcaaaatatagaaggaaaaaatgcatattttagagaaaaacatatgagaacatatatgtcctttgtgtaagcaaagcttttcgtaattaggatacaaaagtactaaccacaaaagaaaaaaaaaagatagattacattgaaattaagagctttgattcttcaaatgacacagttaagaaagtaaaaagtaacctacagagtagaagatatttataatacaaagaaatgctgcaggcctggtacagtggctcatgccctataatcccagcaccttgggaagccaaggtgggcagatcacttgagccaaggagtttgagaccagtgtgagtaataaagcaagaccttatctttacaaaaaataaaaaaaattatccaagtggtgtggcacacacctgtggtcccagctacacaggaggctgaggcaggacgatcacttgagcccaggagttcaaggctgcagtgagccatgatcacaccactgcactccagcatggaggacagagtgagatcctgtctcaaaaccaataaaaaaaaaaaaaaaaagaaagaaatcctataatctgtaagcaaaagacacaacccaaagaagaatagataagagacttaaacaaatacttcacagcagaaaatacacaaatcctaacaaatgtatgaaaagatgctcaacttaattaaataaagatatatacattaaattatacaaatataaattaaaacacaaattaatcaaggaaatacaatgaagtgcagtacagcagcatacctataaaatggctgaaatgaaaagatgaaaaatacccagtgctggcaatggtgtgaaataattggaactctcctacacagctggtagaagtgtaaattgggtacagccacgttggaaacatagtatcaactaaagctgaacatacatatgccctatgttccaggaattacatgcctaggtattatctatccaacagaaatgtgttccccaaaacacgagtgccagaatatccactattcataagagcccaaagttggaaattatccagatgcccagcaaaagttgaataataaattgtgatacattcacaaaatggcatctgtacaataataatgagtgaatgaactgcaactattcacaacatcatgggtgaatctcacaaacatagtgtgcagcaaaagaaggctgaaacaagaacacacatgctaaatgactgcatttatataaagctcaaacccaggcgaaattaatcctagccagcagatcaccttgtggatgggtttcttgatctggtagtactagactacatgggtgtgttcagattgtgaaaattcttcaaactgtgtgtttgatacatgaagatttctatgtttcaataagaacctaacaaaaaatgcatggctgcagagagagagcacgtagctagtcctgtaaccattcacatattctcaagtaccttctgagcatttagacagactctcagcatcttgttccaaggaagggcaatccctgtttgctgatgggccaattttgccaggaaaggtgagtgataagagttctacataaggaacaaagcaaagcaaatcatgttccctgcagtccctaccatgctttgcaacgggcagaagtgacaccatcgttaacttgctacacacagctcaacatactcagtttataacaattttaagatggtagcaaacgataactttcctttaaataccccttagaggatacaaactgtcagatcagaatggagtgatgtcaaaagagcaggactgaaaacctgatctgaggttaacagaaataaagagccctttggacctatttgcttggggccccagagctagtctagataatttctagaatcgtgcttcataataattttgataatgcctaggttgcagatgacttgaggaggaaaagacacgttgtaaccaacagaatattcaaggtactttctttaaacttaaaagaaaatccttggctagattacatttcactgagtttagttgagcaaagaacaattggtgaattgggcaacctctcaagccaaagtaagctgagagagactccagcgcaggcatgtagtggaagaagatttatggacagaaaaaggaaaatgatgtacagaaaatggaaatgaggcacaaaagcagctggattggttacactcggcatttgccttatttgaacgctatttgaacagttggccctttgattggctcaaactccgagactggcacgagagtaggtgacagtctgtttacacctccattcagattatagttcactatgtacagggaaacctttaggcggaacttagcatatttaagaaggcagctttaggctaacttgattttacaaactgttatcagtaattttaatgcactataaccagcaaagtggctcacgcttgtaatcccagcactttgggaggctgaggcaggtgggtcacttaaggtcagtagttcgataccagccaggccaacatggtgaaaccccttctctactaaaaatacaaaaattagccaggcgtggttgtgcatgcctgtagtcccagctactcaggaggctgaggcaggagaatcgcttgaccctgggaggcagaggttgcagtgagctaacgccactgcactccagcctgggtgacagagcgagaccccacctaaaaaataaaataaaaataaaataagtaattttaatgagctgtaaattacctaagaacattgtttcaataaaacagaaatgcttttgttttgctacatcaaaactggctgtggccaaatgacttgatgagtaaagcctttaatcctatagattaataagttgtgacctttaatgctggcattttatctttagagatgaatatcgtcatttgccttatatggtccagattttctgaaaggtcaaaatagtgccttcagagtacaggcactcttttatggaagacttcaatgaacacagaattgctgccctctcttaagaaaggataaaataaaaaaaactgttaaggaaaaacccaagcggtagagagaacattcgggaatgcaataaaatggaatccctttggggatgtgctggcagtggagcaaggcagtagcaattagcactggccaaatcccagtgtcaataccactcctgcctacaggtaatcaccagaaaggtcaaatgttagtcgccctgtcttatgtgggctgaaaactgtcacaggcgatttctcgtaagggttctggaatcccactggggacggccacaggcaggaaaggcatcgttggccgctgcttcttggctcactcactccacgctcactgctcagaattctctgagactggtcttcctgcctccttcttactggtaacctaatctttccccctcctcttgcttgaaaattgtgtagggttcattgttccatgattgttattgaatggggctcttatgctctcacagaagacctaaatgatgactgcaaacaatgaagacaaatattttgctccaggaagcccaaatgccctctcacactctgccaagtttaaagaaagacgaaaacaaaaggtgtccctgttagttccccctaaggctcagggcatatgaaatagtttgaacctggcagcccaaaccatctctacggggcccgtattaagtctttatatgattatcaaacgcgtcatattccccatctatttccatttaaaagaacgggggagtgatggcttttaaaacaagccaaattaccactaaattcagcagcatgttttcatgacttagcaacttatataaagtatgtttgagcctgccagtgaaaaatgtgatgtgggttgccaagaagacacacagatatagaaccaggcataacagctgtaaaattaaaatggaatagactaagataatgatttttcataggctaagatatatcatgtcccagcctgtcttctccttcagtcctctgtaagatagatgttccaataatgccagctgattcaaaattgaaatattgttcaaaatatgcttagattgattttttttaaaaattgttattcagccccagagtgaaatgactactgaactactgaatttatagcccccaaactgagggtgggaggggctctgaactgaacttcagaaagatacctcagcctgtggtctttctcttttcatagctcaaccaagctctagactgcaggggggatatagtaagattatttagattgattctacttaaaagatgctagtttggataaaatgaagccattagttatgatggcaacccaatcaagccagtttaacaccccttatctcagctgtgatattaattgaggaggaaaaataaattgatgacccagccatcattccgccttacttcaagcactcgcaaaatatcagtcatgttgaaaatactacctacagtttgtcactgacaaaatggcccaataaaagaactcttaagatctggtaatagtgaggtgtgatcagagccattggaggggcagcacactgggtccactgagataatggagcctagtgccatctacacctcaggatgagttcagctccgcatcttagctgtgcaatgatagccgagagacttacactctctcagcctcaatttccccacctgcagaatgaagataatgccatctgcctgctgggttgttagagggttggaaatcatgaatgcacaattcccagtactcctaagcatataagaaatgcttaagtgaactgacttgaactgagtcatggactgatcttctaagcatgtcattacagaatcatgagtgctgaggcaaactatgaaaaggcacttatgaccaccgtggtggtgatctgagcatttttctagggaatggatgggccatggacccccccacttggacaaggatgctaaatccaattagccagaaaaggtgtccttggacgttggcatcaattcatggagcttgtctctggctgaatgggcaggtggaagcctgacagcaggacatttctacattgatcaggcaaatcaactatcttaaacagaacattttcattcattttttatgcaaaagaaactgattttgacattaaaatactgtcagtgatgcccatctcaaccagttcatcctgccaaagtgtcttttagctggtcccccactggagtcccccttccccagctttatattggcattgccatctacccagtcctcaagcaagaccccttcctctgtgaggctcccaccccctcagcctgctcagcctcctgaagtcagccctttactcttgcatcctgcctgccttccctgaggcccttgccacggctgctcagcctcctgaagtcagccctttactcttgcatcctgcctgccttccctgaggcccttgccacggctgctcagcctcctgaagtcagccctttactcttgcatcctgcctgccttccctgaagccctcgcaatggcctccatgacagtcctggcctcctcactcaagtccattcctgcctgtgcgtctgcatcctctgctttgtatcaaagccattctcctgctttaaagtctttgaacttctcacaaaatagccacaccacttcgtccccctacaacaaccttcatcctctctacaaggtattctcatttctagcacactcaaatgccatctcttcatgaagccttctgatctatccccaggcagttaattatcccaagccacaagtattttattatcacctctcttcctgtgcttgtaacaccatcccacatctgcttacatatctgttcctgccatagcattagcgtttcaagagcaggcacctgtaccattgacattagcacatttccatccaggcagagggtagagtcccagtaaatggttattgactgaatgaataaaatgaaactgtcatgtttaaacatggcctcaaaattaattatttccctttttttcttttatctaaagtcagtggaatggaaaaaaaaaccaaaaagttgaatttttgtacaacagtttagttttacattattgtctcttctaaaataatttttcagcccaaattatgtggataattgcttcagttctacatcaagtatagtatacacggaaacctggcgttatattattgcaaacttattttccaccagactttttgttggcttactattaacatttttctatatatatatatatacacacacacaaagagagagagagagagagagatttctgagatgaaattggcaagatctctattagcaaagcaataaaactgatcttaagtttaaaaacaatgagattctcagcttatagagctgatttgtaaaatactggtgctgaaaaaccatattaaagagaacacaaagtataaaataaaacaaaggataaccttagaagactcctggttcacttacagctttctttttttttttctatttttatcttaaacaggaggtacacgtgcaggtttgttacctggctcactctcagttttaaagcaaaggtgaaggtacatttagagtcctgttcagatgacataagaggcctggcatgtatttgctcacagctgcttattgaaggttcaacagatgcacagctacctagagggaatttggggccatagattgtaccgctcttgtgtccatgctcaagattgctcattagctcacatctaaattgtggctcctctcagatgggcccatcttcctgattatcctcccagaatgtgggcctcaggcttccttgggacactagccaaggtccctctctatgtccctggtatgggcaccctgttctgagtcccagctctgcagacctctgccccaccacacactgttttctccccaagggttagattaggaaggatttgaatttagacagagccactactctcaaaatagaagcaaacttatggaaatacaaacatatatgattacatttacaggaagagccatacatatttgttttttaaatcaaattataggttggcacaaaaataattgtagtttttgccattgcaagtaatggcaaaaaaccacaattacttgtgcatcaacctaagaattcaaacatatgctgagcacttattatatgggcttcctgttttccctgttctctgtcttcctacatttcattgttcacacagacaacctcactttgcacactgtttccaaataaaaccacttgtactcataacttccaaggtaagacatatgctgcatgcctctgggcctacctctgggaagatttgggacaagtggctggaaaagtctactactttctaagacttctcagagctaacttctgaaagtttgtgttgagatcctaacattctgtgcctatgaaaccaacccatctgatatggtttggctgtgtccccacccagaatctcttcttaattgtaatccccacatgtcaagggcaggaccaggtggaggtaactgaatcatgggggcagtttccttcatgctgttctcatggtaatgagtgagtctcacaagaactgactgttttataagcatctggcattcccctgcttgcactcactctgtgctgccaccctgtgaagaagatgcctgcttctccttgtcttctgccatgattgtaagtttcctgaggcctccccagcaactcggaacggtgagtcaattaaacccctttcccttataaattacccagtctcgggcaattctttatagcagcatgagaatggactcatataccatctcactgtggcaagaccagggatcctattcttctaatgggaccctcttgggagaggcatttggagtcttgtcttactggtctagaaattttgtaacatgtatatctagtcctttgtgttccgatgtggatagcagctgatgaggtttggctgtgtccccacccaaatctcaccttgagtggtaataatccccaagtgtcgagggtggggccatctagagtaatggaatcatgggggcagttttccccgtactgttcttatggtagcgaataagtctcaagagatctgatagttatataaacgggagttctcctgcatgagctcccttgcttgctgccatgtaagttgtgactttgcttctcattctccttctgaatgattatgtggaactgtgagtcaattaaacctctttcctttacaaattagccagtcttgggtatatctttattagcagtatgaggatagactaatacagaaacattattcgtaatagacaaaaagtggaaacaactccaatgtccatcagctggtgagtagataaacaacatggtctatccatacaatggattattattcagccataaaaaagaatgaagtattaatacacactgcaacatgtacaaccctcaaaaacattatgctaagtgaaagaatccagacccaaaaaactacctactatatgactccatttatattaaatcttcaaaataggcgaatctgtagagacagaaaattgatcagtagttgccaggggctgggagtgggcatgaagagttagtacaaattggcccaaggtttatttttgggggtgatgaaatgttctaaaagtaggtagtggtgatggtcgcacaactctgtaaatgtactaaaaattaatagtcgcaaaaataaagagtaagaaaaaagtaaagtagaattagaaaaaaatatttttaatccctgcataattctgagtttaacatgttcatggttattgtaaagaaaattaaaaatagataaatgtattattttaatgttaattacctagggaaataatcaccacttacatttttatatatgtctttctaatttttctctaatcatatgtagatttttaaattaggatcacactatgtttttagttatgtctattaatgacaagatataaagcacttatatatatagctactgaacaacagaacctgtgaaaaaaaaatctcagtgttttttagctaagtggaaatcctgtttggtcaaggtttttcatgaaataaaatccctgaaatttaaatagacaaaaaaacacacacacaaattgtaatcgcaataggtttgttaaccaatgcacacagcaaatcaatatgccatgacaccaggttgcagcagagaaacaggtttaatcatagtgttaatggaaaggggtcatgatccagaccccaagagagggttcttggatctcatgcaagaaagaattcagggctagtccacagagtaaagtgaaagcaagtttattaggaaagtaaaggaataaaagaatggctacgacatcgagcagccccaagggctgctggttgcccatgtttatagttttttcttgatgatatgctaaacaaagggtgaattattcatgtctcccctttttagaccatatagggtaacttcctgatgttgccatggcatttgtaaactgtcatggtgctggttggagtgtagcaatgaggatgaccagaggtcactctcatcgccatcttggtcttggtgggttttagccgtcttctttattgcaacctgttttatcagcaaggtctttataacctatatcttgtgctgacctcctatctcatcctgtgacttagaatgccttaaccgtctgggaatgcagcccagtaggtctcatcctcattttacccagctcctattcaagatggagttgctctggttcaaacaccttgaccacagggtcacagaacgagaagatgggagggaacctcaaagccatttccccaaggaagttgaggcttgggtttttgagggctttggagtgggcagaagtgtggagatcaagagtacagggtgaagtcataggaaggggagaggaagcagctgtgttctcatgctgatcctgttcccctgtgggagacttccaactggtggctggaattctggggaggtgtgtctgaaaaacatcttaagtgtctataggaacaatggggatgcaaatcaattcttaaacagtcttctggccttaatgtcagagatcctatctaggggaacggtggggaagcaaatgtcaggatctagtgctactgtaactgaggaactggttagccactcactgcagcagagtccaattaacaagatccaggcctggtacaagaaaagtgaatttatttttgaagctagcttggaaagacacaaagtgtcctgctttaagtgtgctgcttcatctttggagcaaaaagcagacatgtttataaggttaaaggggaagtgagcaagggcaggaagtccccctgctagcctggtgtcttatctaccaaacagctgagttggcatacagttgagttggtgccttcctgggcagaaataagttgtaaaagtggccaagtgggcgtgttttcaccatgtcctcctgaggccaccccagaagtgggagttccgtggagatgtgctttgatctgcaaattgactgtcaattctggagaagagatcactggggcacgtagatgaccttgccttgtagggaatgtgtggtgagggggaggtgagaggttattttgcatttcaaaaagggctaggtaggaagcaggctgaaaggggaaaggagaagagaagagaaaaaagtaattaaaccacctcagaaaaatcagggtacttggttacggtacatgacctactgcaacaaggaactgggccagggtgcagcctgattaacgctgaattataactgtatttgtacccagaacctggcatgcaattcccgtcaaccctgtggggatggtttcaaaacctgaccctgtttctcattgcatccacacccacagcgtcaaagcaatgccaggagaaccacgcgtggctcatgtttcttggaggagtcctggttcagttctacaggcttcccacacaaagcaatatactgttggccatgtaggtaagaaaagcacaggaaactgttttttaccctttctaccagtgtttagtaccaaccacaagcaccaaaatactcaaacttcgagctctgtggctctggctcttatggacggggaagtgctttacaattgccaggcattccattcactttatagaatagccagaaagctccagggatggggatgccctgccagggggccacagctcttaaacaggtgacatgcttgtgactggaaagaggtcccgatccagactccaagagagagttcttagatctcacgcaagaaagaattcagtgcgagtccattaagtgaaagcaagtatattaggaatgtaaaggaataaaagaatggctactccccgtagacagagcagccccaaaggctgctggttgcccatttttgaggttatttattgatgatatgctaaacaaggggtggattattcatgcctcccctttttagatcatagagagtaacctcctgatgttgccatggcatttgtaaactgtcatggtgctggtgggagtgcagtagtgaggaccacgagaggtcacccttgtcaccatgttgattttggtgggttttggccagcttctgtactgcaacctgttttatcagaaaggtctttatgtcctgtatcttatgctgacctcctatctcatcctgtgacttagaatgccttaaccacctgggaaggcagcccagtagatctctgcctcattttacccagcacctattcaagatggagttgctctgatttcaatgcctctgacacactaatgttagagcaccttggacattttccttaatctgagtgtctagttttcttttctagaaaatgagaaaaaactagaatgtagacccccatgtgctcaaagcaacagcctgcctggtttgcttggacttttcctagactgtatgataacaggtgctcgattcctctacgtaaatcttcaccttttattaatcatattaccctgcttctcttagaaaacgcacagttctgccctccctacaccaagatcacaaaaggctaagtgtaagtcatgagccaaccagaccaagagtaacccaggcaggccaggtggccaacttggccatctcataggcagttatcactgctcaacttgaagaaatacaaggttaattattggagtttgaaatccagcagtggaatccatgtggtcctatcgtggtcatataatgtgctgaggctcttacaagttgtcagtgctgagtgggaacgacaaagccagaaacaagggcaagcagaggttgaatgccaggaagaccgtggcagggtgccaagtccatgaagcaaaagcaccgccatggtctaaaaggcatagtcctctagagcaacagagccagtaactcagatccaaaggaaagaaaatgataaccctttccccctcaagacttgccattgtatggcagcaggagggctgcttgcaaaataaataacccaccaacatttgtaggttggagatctctcagtcaagagtgacaggctgtcactgaaaatgggtcggaaggaaaactgtcattcctactaagcaattttaaataggctttgtttccagatatctgtgcctacaagtcctcatttcctcatttggaaatgggatttgatatggttgtattaggaggtaaaattaaaaatatctccttacatcccattcacactgctgcatgatggaattgccaaccttgtaaccaaaacacatgtctttctaataagaagtcaatgacacaagagaaaagagattcctgcagctaaggtttgctcctggtattttccccatgatatcacccaacacaatgtacactctgtgggtggagaaggatggggggtgactttttagcttgtatacttatttgagaaccttaaatgagatgcctattaaactatccatgtatacaaatagactcaatattaagaaaagaagtagtataagactgaaagacatgcttaagagaaaggagggagccatacttcaggaatggagaaatgaagaaaaatctatactggctaaagtcaggttagctaggagggaacatatgaggaaggcccaagtcttatgctgctagaagccagggcagaggcagtaggctggaaaggaccagtggtcatcttggaaatatgtgctccacttgaagccatttggataaaaaataagaattcttagaacactggacatcccagaaacacgataaattagcagaccaaatgccagtctgcaactgctggttaaaaagaaaaatccaattacttataacactgaatataggtcagcagaaactcccggcatcaaagaaactctgaccataaagacttagtgtatatttttacaaaacacttcacagggccttgtggatcaatcatggattcaattttgttctacaaattaaaatcaagccatgtttaaagcaatctcattaagtcgcttgccaacgggtgcacacagtaccacactcctggtgtgacatgaccattcttatcattcatttttggaaccctcctttcatggatacaccacccctcacctcacttccctgcttctgccttacctgtgctttccctgtggcttacctggattatcacaaccagatcccctgcagttttcagccttgccaacatctgaacatgtcaaagaaaaatgggcaggacagagtttgaaaggcaaagcctttattcaaggctacaataagggagagagattgaactaactctgctgaaacaaacaatgggacgatttttaagagctgggatgagctaatggaaaagtactggaagatgtttgtggggaggttggtccatgtgattaggcatctgtgtttgctaatgggtgtttactggagttaggctccaacccttccacagagactgagagacagagacactattcctttccatgattacatttcaaagagatgtcaggtccttgagaaaagtggtcctgggttgcaaaactagcaacaggttggaagatttacatctcacagggacagagaaagaatttacaattgcaagtttctaaagtaaatgcttcaagaaaagagaagtcaaggcctatattagtccattctcatactactgtatagctactactcgatactgggtaatttataaaggaaagaggtttaattggctcatagttccacatggctggggaggcctcaggaaacttacaatcatggtggaaggcaaatgggaagcaaggaccttcttcacatggtgtcaggagagagaagtgctagcaggttaaatgccagacacttataaaaccatccgatctcatgagaactcactcactatcaagagaacagcatgggggaaaccacccccatgatccaatcatctccctccctcaatatgtggggattacaattggagatgagatttgggtggagacacaaagccaaaccatatcagggctctagagtctgaaagaagcccatctaaagtgtagtccagcacaggggaaggttatggccctcttggtcaagcctatctatccttaggaggtaaggaagttcttctagccttgcctcaaacccagggtgagcattagtatatggtgattctcctggtggctgagccacaggctccaacactgttccccagtcatgaggctctaaaccactaccccacagaggcccatttctataataaggtcctgctcccaagcttcctcctttctctccatccttatccctcccccttccctgcctggcatggtcttgtagctggaagacgaggcctcagctctggggtctcatttctgcttcacaaacctccatcagcacagactgtccccatgtggagcccagccccctgctgttatctctgaaaaagatctactcaactctataatcattttcggctactgagctattcgtcctacagaaatagtaaatgctattttactgtgcatggccggtgataccagcaagcctaggacattggtcccagcgcctatcctgcctattgtcctactacagggacaactatgactatgctagctggaaatgatgattccttgggtacccagcctgactatgacacaggctgtcatagtcatttccagcaagcaaaataggaacaggaagctaagaatctcaaatacatttagaatgacctagtcaaatgccatttctttttttttttctttgagacagagtcttgctctgctgcccaggctggagtgcagtggtgcagtctcagctcactgcaacctctgcctcttgggttcaagcgattctcctgcctcagcctccagagtagctgggattacaggcacgtgccatcatgcccagctaattttttgtatttttagtagagacagggtttcgccatgttggccaggccagtgtcaaactcctgacctcaagtgatctgcccacttcagcctcccagagtgctaggattatagacctgagccaccacacccggcctaccatttatttgtgaaaaaaaaataaaaaattccacttacatgggttccccagagtcgtcagattcatagagacaaggagtggaatggtggctgccaggggccaggggaaggggaatggggacttggtgtttaatgggtcagagtttcagttttgcatggtgagaaagttctggagatgaatggtggtgatgttcccacaacaatttgaatgtacttaacaccactgaactgtacacttcaaagtggttaaaaattgtcaattttatgttatgtatatttcaccacaatgaaaagaacagctcataagaaggaagctgtaaatagtaataataataacctggaattatggtttagggattatagcttgctttcatggttaaaatgagagcctgtaagactcaagctatgtaataaaaattctggtggagaaagtataggttaatgcttgctctagagaaggaggcctgacactcacggtgtccatttgagcctgtcctaaatctctctggacctcagcctcaccatacctacaatgaattggcctcagatcttctgctctgatcttgcaccaagcctgggcttgcaatctgcgtgtctgtggactcttcaggtatatttctgaatgcaggtgcgtttctctggaggcaggggccatgaccttcagcagattcccaattggaaactcacctcccaaccacgttgaagacctgaaagctggaatggttcatctgtcagcagtccttacagctcctaacattataaagacagaagcccctacaaactcagccagacccccacatgtttagaagttagacttctctgatccttaaaatggctaccatgagaacatggcccctgggctccctccagaagggagctgcaaagagggagtcccattctagctccatttctgggtgttttgctcaaattgacctgttttccctattgaaagagaaaattccggccaggagtggtggcttatgagccaagatcgtgccacactgcactgcagcctgggagacagagcgagacgctctgtctcaaaaataaaaaaaaagaaaaaagaaagaagtaaaagaaaagaaagagaaaattcataaaggagggaccccgtcttcactgtgccttggttttgattcttggttatgagtggttccatggtggtggaggctgctgatggaaagaggaacagaggggtgagggatttttgctgaaaatctagagaatacttagaagcccctatatttcctgggccccagaaatgattggagccaaatgggcttgtgaggaattttgaaattttgaatttcacctgaattttggatgtgatttttctctatcccgtgcatagaaactgagagaggctctttccctcaggattttgtgaatcttgtctttaactcatcgcccaaagtaacaaactcatcttactaacttcagaaaaagacatcaccagcctggcctgggaataacacataggaaattgaagacagtagtatacttaagttcacaaaaggccaattcttatggccgtatttcaaatgctcataacgccttctcatccattctaccaaatgacttgtcttcataatatattcagagtgaaaaaacataatggattcttccgagatattcaattagttcaataaaaagagaaaaataatttttcagtaaagaaatttaactaaatgactaaaactgacagtgaaaaaccaacttcaaagtaattatgcatttcttttgagtttgcgctctaacgaaagttgatgatatgccaccattagaaatagccatccttcaaatgatcaattgcatttgtgttgctattttagcagacatttatttgaatgtttactctgtagctgtctttgggtgttgatatatttaaatttccaccagccccgctaaagagtatcggctcgcacttcttcatgactcactgctcagcttcctttaagctggttttttccccgttaacagaaacctcttccaaaagtgtcaccagtaacattctccttacaaaatccggttacttctcttcacttcttatcctcgtaggggtcatgacacatttaattatgggtcattgactcctcttccaattctctcctgcaaaactagcatctgctctttaaactttggggtctctcaggattccgtattccacccctctggcattctgaactttcaccctgggtaaccactttgttagagaagtttcaaagccatctatgtgttgatgacttcccaacccctaactcagcctgggcacttccgccaagctgcacaggtgcattgaattcaaggggtcgttagcacaatcaagactgaaccgctggtcttcccacttcccactgcactctgctcttcgggcagcctcatctgagtgcttgatcaccaagaaaagacactgctttcctgctcgagctgcacacatcatgcctctcttcatccatggctggtccgcctgcctgcagggtctcacatttcctatcaatccaatcgtgtgctttctgaagataagtcagatcagattgttcctggatcactgcctttccggaaagcctctggtggcctcgtgcactctgtagaattggtacaggtcccttgtgatgctactcaaggccctccaggagcccatgccatcctcagtgccctcagctctggaggagcagctccaccacggcaccccatgactttgcatgtagagccacatggggagggtatgacctgcagctgcgctgagtcttggcagaacaccctgcggtcccccagccagtttctcattgccttccgggttctgtgaggtgcgggggctttctgcctgcccctctcaggacacagctgctgctgtaaaactgctgagaagcagcttggagttggctctactgcaacatcccttctttctgttgcagttgtccattcccttttattctgccatgacctgcgccaaggccatcatgcccacgcctgcttctactgtctaagtaataagctgtctgcatctaaagaggtctccttgcttctttgctaggacttgcctgcgtcctgtatgccaacttcaaatactcactacccttctaacccccgtgtaacctgatagcctaactgcaaacttaatatgcgtttcaaaacataaatatagtacaagagaaaataaaattatacttggaaatctggctaagtgaaaataaggattagaaaaataaaagaaagccataggttagattagtactgtatagtattagtttattaaactgataagaacagatctgtacttcatcttagccaagaggccaagaaacgattgtactactgtataaaattatggtgctgtaattttagaggtgcttcaaattattttgggaataaggcaaatctgtatacttaaaatgtgtgacctatgaatttggctctaacctttcttgcagaaaattagaaactactaacaaatggtttgtcccaagagcaaacctctaatgcacaaatgattaaagatgaactcagagaaaaatgaaggcaagctgagttttattaacattgtttaatgtttaagtgaaatacattattagggctgggcacaatggctcatgcctgtaatcccaacacattgggaggccgaggcaggtggatcacttgaagtcaggcgtttgagaccagactgaccaacgtggtgaaatcccatctctactaaaaatacaaaaattagctggacattgtgttgcacacctgtaatcccagctacttgggtggctgaggcatgagaatcacttgaaccgaggaggcagaggttgcagtaagccgagaccacaccactgcactccagcctgggtgacagagtgagactcaccaaaaaaaaaaaagaaagaaagacattattagattggtgattatgagggccattatcttaaaatagtatttcctaaaatgaaaaacatttcaggaagtagctgaaatatcaggaaaaaaacaaggctttaaaaataaggtccaaagattatatgatgattgcttctatgcccctgtagccagctagtgatctcatttctcatcactaacccagctttctaaatctgtcctgtccagcagggtcagccatcccagcccccagtggcaccatcagccatctgagactctttttcacccccagaagaaaatgtcttggatttaatctttccctctttagtcaactcctcagttagagtagagctacagcagtgaaaccatggccatctctcacggagactccgtcctccccctgccaccaacatgtgtgaatacctggctacttatgtaaaagatttaatttgataagtgaggaaaagtcatatttatctccattctttgaatagatttcagtgtgtgagaatgactttttagtgtgtgtcagaagcttagtattctaagggtaaagtattaagcctaaagaacttcaatcagaagtcttaaggccggatgcggtggctcatgcctgtattcccagcactttgggaggcctaggcaggcggatcacgaggtcaggagtttgagaccagcctggccaacatagcgaaaccccatctgtactaaaactacaaaaaaattagccgggcatgatggcaggtgcctgtagtcccagctactcgggaggctgaggcaggggaatcgcttgaacccgggaggcggaggttgcagtgagtcgagattgcgccattgcactccagcccgggcgacagcgcgagactccatctcaaaaaaaaaaaaaaaaaaaaaaaaaaaaaaaagtcttatatatgataaagggctttgtaaaccactaaactttataccaaaaaaatctattattgttagtcttgtttgcaactattaataacaactgagaaatgggctgggcatggtggctcacgcctgtgatcacaacacttttggtgtctgaggcaggatgattgcttgacgccaggagtttgaaatcagcctgggtaacatagtgagacaccgtctctacaaaaaatacaaaaattatcctcttagatgtaaatgctaaaaaaataaagttagccaggtgtggtggcgtgcacctgtggtcccagctacttgggatactgaggtggtaggattgcttgagcccaggaggttgtggctgcagtgagccatgatcgcaccactgcattccagtctgggcgatagagtgagaccctgtctcaaaaaataaaataactgcaaaatatactaagtttacaatgcaaaaagtgctatggtaaattgctctcgcatataccagttgcataccaacatcttccctttttcccacaggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacagtaagtctggctaaagcatttctgcctattcttccagctttcagtttattttctctttcccaaaatgctgtttctctactgttctctcaagtattctcatttggttcattttaagttattggcatattataaatactgagaattttcccaccaacaaacaaatgcaatttataaaaatattgaatatctgtttcaaacacagacattttctcttctgcttcctctctgatattttctatactgtacaccctgtgttgtatatcctaacctgtctgctacatacactatttagtataactccaatattctatctttaaaattttcatatatttagggggcacaactgcaggtttttacatacatacattgcatagtggtgaaatctaggcttttactatccccatcacccaatagtgaactttctcttaactaatctgtagtttctgccatcccagagttcccagccacaagactgtgattctttgttcttcctctttctcttccttttttcttttaattaaactccacagattctttgtttgtaactagcttacaaagaatattggccaacctgcccagtctcagaccttgaaaagataggagtctctgcttctccccagctatctcttggctcagctgtctttccagtctcagagacagagaactgtgttaacattaactttcaccagcgcattggagaggcttttcgtggtgtacctgctgtcataaaagactaaaggaaagagaagtgctaggataagaatctttatagtcttcaacctccaaccttccatagtacgctgcagacctcctcagacttgacttggtttaatgatgaccttgggttttttttcaaatccttggccaccattgactttgatgtcttcttccatgcatcttctttctcctttataaaacttgcaagcaatgtctcctcccacaagtccttccacataggcaggtggaattcaaaacttaacccaacttctatcacttgccttattaagactgaaacaccaacatattaatatggagtatccctatatccacaatctcacccactttcttccccaaatgtaaactaactaccaagttcaccttgtcttccaataaagtaaaagaaaaaagaaaaagaaagacattagacactatgtcttcaataatatacttatcctgctgttgaccccgtcagggttcccacttcttatgtcagtggtagaacttttgagggagacagagaattacgcatttcattaggttttgcaaatgtattgtacaattgtgcataacattttctatttaaaaatctcatatctattgttatagccctatctcatatctcatttttttagtgccttttgcttgttattgattctatttgcctgtttgtctattttattgctttttaaataatgaattctgttatactgattatttttaattaaaacagaccttctcttgtttgaggggttagtgttttatttgctagtttttatggctatagcctatttgaataatcatctccagttctttccaattggaactttctcattcaagagtttcttttttgggggcgtgcagaggggggtgagcatcaggataaatagccagtgcatgtggggcttaatacctaggtgatgggatgatttgtgcagcaaatcaccatggcacatgtttacctatgtaacaaacctgcacatcctgctcatgtaccccggaacttcaattaaaaaaaaaaagaagaaaaaaaaaaagattgtatcctctactaaaggaagatgggaaaatgctgtttgatttaatctgccatctcactaggtgagcatcacattagtcattgctgctcctgtcaccttctggtaatgatcatgcttcatgtatttttatttccctgtcattactctcttgttttttctcctggttttacctaatagataaatgccttctaaatgattttgttgtctcacagtttttttttctgaatatttagccctgtttattcccagaaaggggcacttaaaaatacatatgaccctaatcatgtgagtgactttatctcaaggctaaagaataggccagctggtgcagccactgccaagtgtcacccaggggcctgggtgatggtggctattgccaccgcacatgacatcagggaagtggaggggaagcttaaagatccagtctctatgttgcgggttcccacccaaatgtagagctgtggacagaggattgatcaaaaaaaacaaaaacaaggctggactcagtggctcacacctgtaatcccagcattttgggaggccgaggcaggcagatcacctgaggtcaggagtttgagaccagcatggccaatatggtgaaaccccatcagtactaaatatacaaaaattagctgggcatggtagtgtgtgcctgtaatcccagctactcgggaggctaaggcaggagaatcatttgaacccaggatgcggaggttgcaatgagccaagattgcaccactgcactccaggctgggcaacagagtgagaccctgtctcgaaaaaaaaaaaaaaaaaactaaagacaaaaaatgtaggctatagaacccatctccatgataacacattagggtcctgcccacattgagagcaggtggattttcaccttagctttctagatgtggaacgcagtctttgtcaagatggctttttcgtgtaataaatttgcagggaggagttcttggtaatcaatcatcttcatgaaaggagctctccttgaaactgattataatcgcgccgaggcacagaactctggtgatggaaacactctgtctctgtgttgttcattacaggagccagcagccatgtgtggcttctgggcacttggaatgtggcaggtgccactgaggatctgaactggtattttcacttgatgttaatgaatttaaatgtaagcattcgcacaattataaatgaaaatgcaatgcctgtttggtgtgactttcatcaccaaaacctcactcttttattggaaaaagtctcatccactctcaccagaaccctccttgcctttacagatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtaagttgacctaactccagtgcatgcacaaacaggaaattgtaacttcactgggttcgtgaagccagcattttcccatatacctttccaagaagatgtttcccagaagaatcattcatctttagtgtatgtctgtatgatagaacatgttatatgtaaaagtgctcccactgatgtttaaaggcatcttaacaatccctgccagccagtctgagggattgtgcaaaggtgttcattgctagcctgcaaactaggtggtaagcaaaacttcctacagctgccactcaacttgagctaatgaaaatgcgcccagattagttaactagtctatcagaggcctgtttctctctacattatgcagaataatcttttgcaaggttaaaacagatattatgagactttctgagaatagtcgtgagaatttatggatggagggtgggctgcagggaaaatgataaatgcataatttacactgttttttcactggctagtaataatgactataatatcatgaaacattgtttttaacaaatgaattattatgccaagtagtatagatgtgaggataaaattaataaatacatgtctcagatattccttatttatgaaatactagtccaatgttaactttagccgttattcatatataactgttaccatccaaaagccttttgggccttgcaatttaccttttgagaacgtatcggtgtaattgtgaattaggaagttgggaaattgacagaaaaagaaaacagaaggttttttatcctactgacagtggtgagctgccaggaaatcacatagtacaacattggacattcacgtatataaagctctgtgcaagaccagagtcctgtgagtagaaggaaaaatgaagggccaggcacggtggctcacacctataatcccaccactttgggaggtcgaggtgggtggatcatctgagatcaggagttcaagaccagtctggccaacatggtgaaaccttgtgtctactaaaaatacaaaaattagccagccatggtggcacatgcctgtagtcccagctactcgggaggctgaggcagcagaatcacttgaacccgggaggcggaggttgcagtgagccaagatcatgccattgatctccaacctgggtgacagagcaaggctctgtctcaaaaaaaaaaaaaaaaaggaaacaagaagccattatagcatttcactggcccttcagactgggcatttctgaaagcgaacatatcatcttcccctcctgacctgcccctctgcctgacttgtctctgatgactgtaccaccaccatcatcatcaccatcatctccatgtctccttcctggtcttcccactgcaaagcccaacagagtctaagggtccaacactttccatccatccctgcctccaccctcctgtctcaggtactaatgtcacttaacctcgattatctcactggctttctaactttatcttctgcaaagagagagagaaaatagaaatcaagaggccacccctcggaggcttctcctgagtcttttctgtaaagcagagacaatttcagatgaagggttagagatgggagtggggactgagaagaaattaggaaaccttgtcaaagcacagataattcggctgtacagcaattgggctaaacgttgagcaggggtggtccagaggagtttgtatactgtcttagtccattcgggctactataacaaaataccataaactgggtggcttataaataacagagatgtattgctcatggttctggaggctgagaagtccaagaataagatgctggcagattcattgtctagtgaaagcccacattctggttcacatatggcgccttctccctgcattttcacatgatgggagaggcaaggcagctctctggggcatctcatcccatcccatccatgaggacactgacttcctgacccactaatttcccaaaggcccaccctcgtagtaccatcaccttggggatcaggtttcagcatataaactttggaggggcacaaacttcagagcatagcagataccatgaatttatagcaacacattatgcttgtttgcccccttgctttgctgacagatatcctagacctagatttctagagtgtaggaatgttcccttcgtgagggtatgctgtctggggcctggtttgctgagtcatcactagcaacctgcaagtcactcttgcatagtatcagctggggagatggtggtggatctcaagtctggctgcacaacagaagcacctggggaacttttaaaagtagctacccatacctgagccctaccctatggctggaagggcagcttagacatttgtccattttaaagcctcaccaggtggtccgaagacactgggaaatcaggaccgtcctggtgagtgactccaacgtttaggtacaggctcctggacattctaacagtgtcctccaatcttgtccccaccctaaagacgtgctggttccttcggttcacaactcaataggaaacaggtggaggagagtaaagttaagaatacaagtgtgaagatgtttgctaccgatggtgccagaaaacctggcaccatccctcctccagagaggagggtacggtgagatgacagaacacatccagtatgagaatttctatagcaccaactttccagaaagtgtttcagaagcttacagaattaaaatgtgaaccagacaggaagttaaacttgacaaggaagagaaaccaactaggaagagttggggatggagttaactgacactaaatttggcctgagcttctcattggcttgccgtacacaattgccactgtgtgataagagcaacgtgttaattgcagtggtagttcctaaatgctgctgcacgtcagaaccacttaggaaacattttcaaactacgaattcctgagctcagtgccctagaaactttcatttgtgctctagattacgacttgagcttgaggaatagggcgttggggaatggtaatgaatggacgcatggacagacagatggataaatgaaaggaaacatatttctccctcttttcttttgttctttttttcttctttcctttgtctttcttttctttttttcctttatttgtttacttatttatttatttttttgagacagagtctcactctgtcgcccaggctgaagtacagtggcgtcatctcagcttactgcaacctccgtctcccgggttcaagtgattctcctgcctcagcctcccaggtagctaggattacaggcatgcaccaccatgcccggctaatttttgtatttttagtagagacgaggtttcaccatgttgtccaggctggtctcaaacccctgacctcaggtaatctgcctgcctcggcctcccaaagtgctaggattacaggtgtgagccaccacacccagctccttcctttctctttcttcagaaagtaaaatattacaggcaaaggtaaaattgcctatgtttctctgcccaattttattttctgttctctctcctcagaaacaatagctaccatgaattagctattcatgtgtgtgtccagatgttttatccttttactacacacaaactgacacatacactcactcacacacattcacacatgacacatacagttctattttgtgcagtttgtaaaacctcctgtaattcatattatattgggcataccattctgcgacttacttttcttcctacctgtgttacattcacaaggtccatccacgttgctctaattcagcgttcagcaaactttttctgtaaagggccaggtggctttgtgggccatattagtctctgtcacatattcatctttattgtttgtttgtttgtttgtttctgtcttttgtaccaccctttaaaaacgtgaaaacccttctttgcctgggagctatccaaacacggacttgaggttagagtcagcccacagcgttccttggctgaaccccgctctgctccatttactcctcctgctggaggatcctgtcatttgaatacggtgcagtggattcccttatcagcagacacattcgaatcatttactatgaccaacgctactacagtaagagatctacgttttccaccagcttctggagtgagcgccagacagaccacaagcccagcactgcccaaagaccagcacttagaagccactgctctacaagcaatgcttgcagctaggtgcggtggctcacccctgtaatcccagcactttgggaggccaaggcaggcagatcacttgaggtcaggagttcaagaccagcctggccaacatggccaaaccccgtctccactaaaaatacaaaaattagccaggcgtggtggcaagcacctataatcccagctactcgggaggctgaggcaggagaatcgcttgaacctgccaggcagaggttgcagtgagccgagatcacaccactgcactccagcctaagcgacagagcaaaaaacaacacctgcagagatccaggagcaactggaactcaagaataacagagtttggataaatcggagagcagtacttcctatgtgattgcaaagagataaaaattctatgtgtgtgtagtgggaatgcatatacacacgtacatgtatgtttgtgtgcacgcacgtgtgtgtacccagaaagtagacaattaagggggttacatcacacattgccctctgtaaatccaatttctgaacatcaaagcctcactccgtgacatctctttgaagaacaaaggcactgcaggaccctgctcacggttcagctactcgggactggaaatgagtgttttaaatggagaccagagccgctgtgcacctgcttgttaaaatacagatttccaggcccatccaacctatggcatcaacatcccaggtgacaggggcctctagctcaaagcccagtgtttggttatttttatacaatatttttataataatacacattctgctaccaacactccccatatattaagtattagtaaacattgaatttttttttttagattaaaaaaaaaagacttggcagtatttttttcttaccaacaagggattttcttgtggtcctcactttgagactcctgatctacagatgacaatcatcagcaggttgccaaggatttcccacttctcatctctcaactgagctcttgggtcaagttaatctaaggcagaattgcctgataatccctaaagaattgcttcacagttggtatcattgataaaagacaggcacaggtacactagctgtgaaataccaaatgtgctttatgtgctcgtctaaggggagccatcccatctagcatctgatgattgtatctcactgtaagtaggggcacctgtgtgtaaagtcgaaattattcccacagtgaaactctggatctccttgtgtagctggaaagtattcagttgacactccaatggtttgctgtacaaagacagtagtttcagcccccaaaaaacagttaaaaacaggtgttaccacttaccttcaaaaacacacttggtctggtcatgtgtaaaaggcataagattttctaatattgttcatttaaatgttagagatgcctgccaaatgtcatgatttacgttttattatatacctagtccaagacattcttcctaaccaaaaagggatggacataataagacatgtaagaatctgggtcagaggtagcaggaacaggtaaccaccagtgcccaaccactcaaatgcataaaagcagacatcaaagtggccgacccacgtgtgctaccatttatatgacattgagaagaggctgcacagaagtgagcttaaacccttaagcaaggattggagaaggaggagggtgatttcaaaaaacactgaaattagtagctttctttttttttgtttgtctgttttgttttaagactgagtcttgctctgtcacccaggctggagtgcaagggcgcgattttggctcactgcaacttctgcctcccaggttcaagtgattctcctgcctcagcctctgaagtagctgggattacaggcacctgccaccacgcccagctaatttttttgtatttttagtagagacagggtttcgccatgttggccaggctggtctgaaactcctgacctcaagtgatccacccacctcagcctcccgaagtgctgggattacaggcgtgagccaccacgccaggcctgaaattagctattaaagtacataacttcctaactcagccatagtccttacaagaattttgggagcaaggaaatcagctggtagaatctctttgatgtttctttaaagcagggtcagcaaactctaagacacagaccaaatctggtctactgcccatttttgtaaataaagttttattggaacacagccgcgcctatcatttccatatcgcctgtgcccgttctctgctgcagtggcagagctcagtagctgccaccgagaccagctggcccaagaagccgaaaatattaactctctggcccttcccacttcaaagcatcattcataaaacttcagtgtgatgtaggagaagataatcacgtcacattcatggcaagaaaaaatactcagatccaagtagactggcagcaaccaaacatgctgatgtgtggggctgttttctgtattttcttcagtggtctggcagttgtcccattttctagatgagaaaactgatcctcagaaaggtctccaggtgagtaatcagcgaggccagcattcaccattgactgcctcccttacagaaaaggataataacaacatttcagtttagtatgacctgatcctgtaggtggctttactgcaactgagagttgaactgaaggatctgcatttctttctttgacatctgaaaataaaggaaataaaactactgatattgaaagtaataaaaaatgaaaatgaaatgatttttactgtcagttttttttgttttgttttgttttgttttttcacagagtcttgctgtgtcacccaggctggagtgcagtggcatggtctctgctcaccgcaagctccacctcccggattcacgccattctcctgcctcagcctcccgagtggctgagactacaagcgcccgccaccatgcctggctaatgttgtttttgtatttttagtagacatggggtttcaccgtgttagcctggatggtctcgatctcccgacctcgtgatccgcccgcctcggcctcccaaagtgctgggattacaggcgtgagccaccatgcctggcccggttgttgtagtataaagtgcatgtcagtggcatgaagtggatgtgtaattcttcccctagcaccctcccagtgaggcaagccggcattgccattaagctgtttctgtggtttttctagcacgacttttatggtatggcaagtctcaaaaaaagaacttgtcgggaaaccatttctgaccattgctttctgcttaattaaccagtattagcaagaatgtaaaaggacagatcaggtgaactatcttaacaaataccaaaagtaaatgtctctatatggagggtaagatgtagacaaactcagacacaataaagaaatttaaagaggggagtgggcagggcacagtggctcatgcctgtaatcccagcactttgggagactgaggtgggtggattggataaggctgggagtttgagaccagcctaggcaagatagtgagacccccatctctgaaaaaaagaaaaaaaagccccaccccatgtcagctaaaaattaacattaaataaaatgtggaccaggcacggtggctcacgtctgtaatcccaacactttcggaagcctaggtgggccgatcacctgaggtcaggatttcgagactagcctgaccaacatggtgaaactcatctctactaaagctataaaaattacctgggcacggtggcacacacctgtaatcccagctactcaggaggctgaggcaggagaatcgagtgagcttgggaggcagagggtgcaataagctgagatcatgccactgtactccagcctgtaggacagagtgagaatccatctcaaaaaaataaaaataaaaataaaatatgcatgcctggctgggtggggtggctcatacctgtaatcccagcactttgggaggccgaggtgggcggatcacaaggtcaggagttcaagatcagcctgaccaacgtggtgaaaccccatctctactaaaaatacaaaaattagctgggtgtggtggcacacgcctataatcccagctactcaggaggctgaggcaggagaatcgcttgaacccaggagttggaggttgcagtgagccaagactgcgccattgcactccagcctgggcaacagagcaagactttgtctccaaaaaaaaaaaaaaaaaaaagccaagatgagcaaaagatagccagtaaacacttttaaaattttatttttcaacgtattgtttgcataaaacaaaatgcatccgttgcaagtgtacagtttgatgcattttggtaagtgtacagaattttataccacgccctagtcaaaatacagtttcctttgctattgatcccctttccgcaatccaggctctcattgatctgctttctctaataatggctttgtcttttctagaatgtcttaaagtgtaccagtattttgttcctttctattgcgaaacgtattatggacagacacggcctgcaaaggcattaaacccaggtagagtgggctgtcttcggcctgcagacggccgcggtcatgctttgcagaggagctgtggccccttaaagtgacatgacattatggacaatgacagttgatccttgggggctttccatgcaccttgcgcatgcaagctaagggctttacataaattaaataaatttcctcaagtaaccatctcaatagccctgggacgagtcacttatgttatcatctaaattgacttaaaacaggaatttgagactctaatttgaaaacaagagattggagcctatttagtggattttatgcagccaaagatgtttcttgttgttgttgttgttcttgcttttaactaatttgcctcccaggagacagttgaaatgtctagagacattttgattattatgcctggcaggacgccactagtggcatctagtggatggagggtaagggtgctgctaagcgtcctcccatacacaggacagcaccccccacaaagaattatccaaccccaaatgtcagtagtgctgaggctgagaaaccccactctgctctctaaccaaaattagacacagaaagtggagacattctaccaccctgacaacatcaatggcttttgcccatttaaaacaagaaagaggaatatgtatccaacccaaaacaacatcttaacattctttctaataggcttttgcaaaaatagttcatattttataactgtcttgcagcatggggtataagtgtaatcattgtaaaaatgaaacctaatcattgtaaaaatgaaacctaatcatggtaaaaatgaaaagagtgcctcaaaacatctgaagttcttagcagagggcagcctgtcttcagtgggcacttttggatggaggcaggactagggtatcagtaggagtgagaacaaaggtcagaaaaatgagtacacagcacatgtatactgattaatttctttcttttttccttcttttgatggagcaagactgtaacagaagcctgagagtgaggaagggctttgccaactattactgtagacacagtagtttactcaattttatgaactcttagtcctgggctggaattcacgcctctgctggaattgcacagacaaaacgtgcttgcgaggagtaaggtggcaacaaaagaaaaatgcaggcaaaaacacgcctcattttgaaaccggatctgagcatcctagagccagagcctctcccagccaacattgctgagttgagcagagtgacagactccacactggagccagccccgcagctggccataaggaggagccacgagcaggtgctgggaagacaggctcttgaacgcacactatgctgatgtctctttctgtgaagttttctacatgagtgacgttctcaaagtctgcaacacagtctgccatgagatgccttttttcctctgggaacacaatgctactttcgtgattggctgagtaatggcccccaaagatgtactcttcatcctaatccctggaacctgtaaacatgttaccttatatggcaaaagagacttcgggcaggcacctgtcatcccagatactcaggaggctgaggcaaaagaatcgctcaaacctgggaggcggaggttgcagggagccaagattgtgccaatgcactccagcctgagcaacaaagtgagactctgtctctaaaaaaaaaaaaaaaaaatttctcagatgtgactcagtgaaggattttgagatggggagagtatcttggattagccaggtgagcctgatataatcacagagtccttataagagggacaaaggaagagtcgattagaaacagaccatgtgatgacagaaacagagggaggtcagaggtgaaaaagagaagatgctgcagtgctgcctctgaagatgaaggaaggggccatgagccaagggatgcaggcaacccttagaggccaggaaaggcaagggaacggatgctttcctagagcctccagaaggagcacagcctggtcaacactgatttgagccccataagactgagctcagtcttctgacttccagaactgtaagagaatagattcgtgttgtttgcactttatggccatttgttacaggagcaacaggaaattaacataccatgtttgggccaggtgcagtggctcacaggtgagcctataacccccagcactttgggaggccaagatgggaggatcgcttgaggccaggagttcaagaacagcctggacaacatggcgaaactccatctctataaaaaatgcaaaaattagccaggcatggcggtgcatgcctgtagtcccagctcctccggagactaaggtgggaggatcgcttgagcccaggaggcaggggttgcagtgagccaagattgtaccactacactccagctggggcaacagaatgagaccctgtctcaaaataaaaacatatcatgtttgaagaaccaccaataggtatcttgctctgtgacttgtgatccttaagtcaacatatatatatatatatagtcacaggaagtcgatacatatatgggataatcaccaatctctaagatacatagcatgctcataaaatagccaagctctgtgctgagagacaaagacataaggctcattggtaacggtggtaatagcagctctcggtctgagcgatgtttggcatctgaagtcaccattagcattttcagagaagtccagctttttaccatataaccattcattctgtcttccaatgtgatccttaaggaaaaaaaaaattcccccatagtcgtgtgatgtttaaaatgtgtttattataccttgcctgtcatttttctggcttttagctaaaatgttttgaattgagtggtgatattcccgacttaactctgaaccctctctattcaggtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaactgctggacagtaa

SEQ ID NO: 766 - DNA, 1169818 bp, Homo sapiens; identical to SEQ ID NO: 765

SEQ ID NO: 767 - DNA, 1169818 bp, Homo sapiens; identical to SEQ ID NO: 765

SEQ ID NO: 768 - DNA, 1169818 bp, Homo sapiens; identical to SEQ ID NO: 765

SEQ ID NO: 769 - DNA, 554233 bp, Homo sapiens
caacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtagggaagaggggctgccgggcgcgctctgcgccccgtttctgcattcggatcgcccggcacgggcagggtgagggggctttcggggggtcggggcctccggtcgcggcggcgaagacagatcggggctcggtagggaggtcattccgagcccagagatcctaggcaccccccacacacaggctcccactctggcgtgcgtgtgtgtgtgtgtgtgtgtgtgtgtgtgtgtgtgtgtgtgtgtacgttcgttaacgggaggaggagagagctcccagtccttttttgctagcaggggcgacattctcgcccacatcaagtggggtaactttggttccctcctccggaggctcggtgcattggagaaagactcagttagaggcgactccaacgagccgcggttttccccagcccaacgcccagcggccgaagcgctgctcgggtccggattgcgggatgcggggctggagaggccgagcaggcaccaccgacttcccagggcgcccgggccccctggtacagcccggctgcccgctggaaggcgcctcggggcagcagagagcctcagcccggctgctgctgtcgctcaaaggcgccggcgccggccgcacccgcatcggggtccttttgctcccagaccccgggcccgaaagggccggagcgtgtcccccgccagggcgcaggccccagccccccgcacccctattgtccagccagctggagctccggccagatcccgggctgccgcctctgctgccttccctgagcgggagcggagcgcagagaaaagttcaagccttgcccacccgggctgcagctgcttgttaaccctcagagcgccacggcgcgagggaagggcacgccaaccaggagagggggcgagggagatgcggtccgcctgcagtcacctctgcacctcagagatttcgggaagtttgagtgcaggaaagcagcgctccgaggccaggcctggggtgctggccgctgcggggggcacgccctgcgctgctcaggggcctgtggtttcggagagcaccccgatccagtcccccatcgcctctctggcaggcgttgggacttggagtgagctggcagcctgcaagtgggtggataagagccagggcagggcagggccgggcagagtaaggagggaaagagacagggagtgcctcagggtgctaggaatgagtgttgagttcctggccggggtagaggctcaggtgagagtttgcgggtgaaaggcaggggaagggagttgggttcccaggtagggactgtctgggatggggagactggtgcagacttctaagggagaccactgttagagcaatgttgggtttagactttggaaatgggctaacatctcagaaatgcagtgatgggtgatagtaccaggggagattcaagtgcccggctgctgagcccgctcccaagctcctgacttctttcttggatatacagtcccgattaaggactgcccagttatagctccttttctaccaggcttttctggttgattatcttggggtccctacagccttgagtcttgccatggatcccaagcctggctgtgaaccagttttccagatgtcctgtaccctagagaccccaaggctgtatgtgtgtacatataccccaatttagcaaggcggtttggagcatgcctcagacagaaaggattcagacagatccttcctgccatctgctagtggtaccaacccgggcaagttgtttaacctctttgagcttccaagttctccattgtaaaataatctgctgccttcctaggactgctgagtggataggattgcattcaacaggatgtcctatgcaatgcatgccagtctgggagctgtcggtgtctgagagcacttaccattgccttgtccaggacttcacagtcctctttctttcttggcaggtttcaacctcagttcatattccagggcttgcccaaagttatgcctcctttaaagcaagacagaccacgtgacagggccccaggatcgatttttatgcactaagggctctgcgcacggttctttttgcaaatgaactggtgtgtctcctcacccagggccaggctggcacaggtgggttctgaaggctcactctatttatttagatgaaggaagcagagattttgctgtgaattgaaatgattgccctgagaggcttatttctattttcaattgttatgcatatcagagcaaatgtccacattaggatagtaattgatatcctggtagcaatagtacctcacagagaaatcattttgatgcaatccagttaaccagcaagaagttcacgtgcagaactctgtgtgccatagaaaaaagtggggaaagtcttcgaggccttgagtcgacgagcaaaaacacaactttcctgaggcagagagaaaacagaagggaaaaacaatgtaataaaacaaattagtcactcggccctggtggtgttcaggcaagcctgtatgtttttttccaccacagttgtaaagcatcgggtctggctttggaagccatcaatctctgtaagcttattggcttggttgttgttttaggcattttggtaggaggtgaggaattctaagcaacaatgactggaagctggcaccgttgaacagtcacctctcctatcccctggggtgttttgggaaagtctgtcccagaagtggcttctggaatttgcctatgataagtaatgactgtgaaacaaatcaagaaagaaatgagcaagaaattccatggtaaatgtgattcccctccctatttgggtagcacttacaactaaccaaaagttctaacaatgagtgagtaatcccccaagaattaggaatttagggaggggttcaggcttggaggacagtcgcttgggagtgactgaaaatgttccatggaattctgagatttcgctataaagtggggagttctctctaggggtcagagtcttgattttcaggattttcaatgagaatcagtgtcttatagtgctcctgcaaatttgtgtgttatgttttaagagcagtgtttatttgcagaactttttggatgaggaaaaggacacagggttgaagagggtgctgccccctccccccctagggtcaatacatgacagcctgtaagatttccagagcactagggaaatggaatatgtagtgaaaggagtcagtgatagagttcacctgtctgaatatttttttttagcaagtcccaaaacaggtttaataaactgcaaagctgagtatgtaatctggaatttgtgtaattccacagtctatactaaaagccccaacagtcatcttagctgatcgctcctactctgcctccctcccttctccccttttctatctttagcccttgggttttccgttaagtaaaatctgtttacttccagaagtatcctctatgtgttatagtgaaattgcccaacaaaccaacatactcaataactgcattatctaaaagcatcagcacttggatgtgtaaactgagcctcaatctgaagttcaatgtttaggttaaagtgtagctaggttcttgaaaacatccttatttccttccaaaaatacaattgcttggggagtctagttaatttatatttagtggaatgtaggaaaaggacaaactatggatttaatttacacctgaatgacagtcatatcatctacgtagccaacagtgtttctgtgtgcgcgtctgagtgagtgtgtacatctctgcattttgatcttgtaatacctgttgaaaaatttctccagaagagggctccatccacagcattacaaaattctgaatctacagctcattttaaagaacttcaatgcagcaactccatcaaaacaaaactattctccttattccacattaattgccacaatcacccccaaatgagaaatcctgccatttttcactgtatttatttctgtgtctctctctttcttgctttccttcttttgctctcttgctttctcgctagctttcttcttgctttctttcttttcccctattgtagttggttctgttctaattcattctttgactctgtatcccctctgagtattggagcagggaaaatttcaaagatgtttgtagacggtgcaatacgcaatgtgaggaagttctgaaatttcctggcatttgactttggttggacttgatttcattctttaggtagccaaaaggcaggaacagttctgcctgtggaaggagataaccttcccccttacataaccacccagaagggtgactcctgagctaggtccactcactttccatcactcattgaaaaggagaaggaaatatccccctgtcatccaattacaataatcagctggacagaatcaaaccaagtgaccagtggttttggcattgtttctatttagctgtcagccaggtacccatgcacctgtgagaatctgaccctcctgaaggatgctgccaatataattccccacagcccgcttcttctgcagccacctgggatcccaggcctggctcctcaggtatgaacaggctgcacagacaatgaatggctgggctgtaggatctcttgctcctgcagtaggcactcagcagtggccttattctagagttagggtggaaagtcatctttctctgctgagagaggcagcttgggggaaggcaggagaggagaagaaaggacatttctaacttgaagtgctgactgagccagggtctgtggaggtgaatgtgtcaccctctggcttagcaagttgaacctcgagacatctgcttggtggtaatggaactcatctatcccaaacctgcaactctggcttctgggcagaggttgccaagtagcagccacaggctaaatttagccatggatgcagtttgtttggctcaaatgttttgcaaattgtacattaataaaaaagaaatccaggtttctagcatttctgaaaaagtcaggtcaggcaaccctagatccacacttcaacatggccgtacttgacagggctgagtcactactgccctctttaggcaggacgtgcctccgtagcttgccataatcgtcaccactctctactacccagccttctgtgctcactaattttgcctgcttgcccctagggctttttgagtttgggacctctgctttcacaaatgttgaggtttgatcaaattgatgcagtttatttctcagtgatggactatttggaaagggagggactggccttttctccttccctgtgattgaattccattgatgtgtgctttggaacagcatgaccaaggggactgcagcccctccctgagcacattactggcagtacttttggacaggcacccagagagacatagcacccagatcattgcttcaggtgtaagagtcatgcagagaagtgacacgctgcagctctgagtcagtacgagccctggcacaccagtgtgttggtacaaaatgtcatcacgcaccagcagccaagggactctgaaaccctgggatcatatagaggcctgcataccctctctgtcagcagtcctcaaccattttggtaccagggaccggtttcgtggaagacaatttttccacggactagaattggggggatggttttgggatgattcaagcacattacatttattatgcatttaatttctgtattgttacattgtaatatataatgaaataattctacaactcactataatttagaattactgggagccctgagcttgtttttctgccactagatggtcccatctgggggtgatgggagacactgacagatcatcaggcattagactctcataaggagaaggcgacctagatcccatgcacgcacacagttcacacaggattccaactcctatgaaaatccagtgccacggctgatctgacaggaggcagagcccaggcggtaatgcgagtgctggggggccattataaatacagatgaagcttttgcttgctcacgggccactcacctcctgctgtgtggcctgatttctaacaggccatggactggtactggcctgtggcctggaggttgggaacccctgctctacgtagtgttctaccaagagcatggctgtccttggagaacagtgacagctgagcatcatcattccatgagtgttgctccctcacggtatagacataaccagaacgtcacaataacttactctacttagacttgccaaggcctccgggaacactgctctaatattcagcacctttgtaacttcaggataaagctgaatctgcagctctgtcacctactttttttctttgagacggagtcttgctttgtcacccaagccggagtgcggtggcgcgatgtcggctcactgcaacctccacctccagggtttaagcaattctgtgcctcagcctcccaagtagctgggattacaggtgcccgccaccaggcctggctaacttttttatttttagtagagacggggtttcactgtcttggccaggctggtcttgaactcctgacctcgtgatccacctgcctcggcctccccaagtgctgggataaacagacgtgagccactgcgcctggccaagtacccttatccataggacactgtcacatcctagcaccgtcctggagcttgtgtgatgtttttatatctgttttaacagttaacacccacggccgttctacatacagtgttaatgctacaattaatgctctctggctctgtaaatactagactaatctgtctgcctcatcccataccagcaggtgagcctcagatgattcttgttttccatagctacagaccccaaagatcagagtaaatataactccatatacacatatgaaaaaaagtgattgtttttcctctgccagttgccaacagaagtcaaattctagaaaactaacattaacaacaggcacgttttgacttgtcatgtctcatttcaaagacaccaatgagcatcacccgatctgctgcagaggcacaaagaccctgtgtctcctagctgaacgcagcccgggctggggcggagggcagcagctgctcagccatcaacagccctgccacatgcctgggcagggcccggaaatgagctcagcctctggaggagcctggggaatggaaggaaggaatgtggcagcttccatccttgccttacggggccttcaggccaatgtctctttccctcaaggtgtcagggaaccgctttcttgtgttgtgtgctgcaggaagaaggtggtggctgcagacacctgaagcttgagcttctgtgattgtctccctgtggactgattgctgtagggcctgcggaaagttgctggacactgccagcggaaccgaggctgactcagactgcccggagtatccctcctcaactgccatcagccgtcgggcatctgggatcatctcactcaggggttgcaaattatggcccgtgagccaatttctccctgcagtctggttttataaatagttttattggattatagccacacctattcatttatgtaattgtttatggctgcttttgtgctataacaacagagttgagactgtctggcccctgaagctgaaagtatttactatttagtccctaaaagaaaaagtttcctgactctttatctaacttaaagttacagccaaagaggcttctgggcgtcttctcaaataagaggggcctgagaagttcagccgttggggacttttcctcctaggccccaagcacttgagcaacttgacttcagggagattcacctgagaccaaatggttccaataaatatctatgatctctatggaggatctactatgttccaagcaccacttgtgtgtgcaggatacagttgctcataaggcagactgagtctctgctctcctggggctcacagcttggcaggaaggatcaatagcaattaatgaataatttaagatggagacaactgtgatgagggaagaaagcccagctgtgtgaggtcatgccgttctaaatattttgcctaggtgttctttgtctttctcctccactagactataagctctgttgtggtccacattgtggcttgatttgttcatttctatactcccagggcttagaacagtgcctggcacatagtactcagcaaacatgaatgaacaaatgaatgaatgaatataagaaagacatcagaggcagatgaaggatctgggcggcttccctgacaacctgatgcttcagcccaaatctggaggagcagtagggcttacagacaaagacacagtagagggtgtgggtggggaaaggcattccaggaagaaggcacagtctgggtgaagcctctattcaggggaaacaccacacagccaaggcagtgatgtgaagtgtggctgggaggtgccagagccaatggggccatgtcagccactgcaagaatattggtgtttttctcagagcaagtggcagccattgagggtactgagggaaaggtacagagtgatgtgatcagatttgcattctggctacaagtagcaaatgggttggagctgggtaagaatggaaaggaaaggccagtctagggctgagatcatgggaagctggattcaggaacgacggtgcagagatggggcaggtgattgaagtagactgatatggtttgggtctctgtccccacccaaatctcatgtcatattgtaatccctaatgttggaggtgaagcccagtgggaggtgattagatcagagggcggatttctccttgctttaatcgtgatagtgagttctcacaagacatggttatgtgaaagtgtatagcacttccccctttgcgccccctctctctcctgcttgctgtgtgaagacgtgcctccttcgccttccccttctgccacgattgtaagtttcctgaggcctttgcagccatacttcctctacagcatgcagaagcaagccaattagacctcctgtctttataaattacccagtcccaggcagttctttatagcaatgcaagaatggactaaatcctattcagataatccaagagacatttaggtggataacttgacaggctttgatggtggctgggtatggagatggcagggccagagagaggtgaaggaggcctgcttgagttctgactcttccaattggcaggaagagtcaaacaaggagaccaggtgtttgacattgtaaacagggtcggtctgagggcttctctatgtgggagtgtaattcaggctgcagaacgttcctgggagaggcacctaaggcctgcattacagtattgccagcagatccagtccatgcctgcatctaggatgggcaccgtgggggcctggaaatgcccttgaataaagtgaccgacgtgcagcctgtacaattaaccaatctctgagacttttcatgcacaagatatttgagagaaacattgccaagccctttaatcgtttcttgaacattcaatcagcagcactggaaatatgtcttacatgaagcaaataatgatcttctaccctcagcaatcgctttgccaatgctaacaagcctctgcttcagcatgttgggtgtagccttggtgacttctgtttgtggtgtagtaggagaatattcaactgggtgccaggcagtggtatattggtaaatgtttaacaactgggccactctaaagaaacacccaaaccagaaagcaaaacccaaaccaagacacaaccaagtaatttgtagctcttgccaatttctgtgatgtaaatactcccgtcatgggcaatttgaatctgccaacctgagagtttcctaaaaacttaacaaggggctcttgctacctgatactaactggctccagcacaccatggacctggatcctgtttctagctcaccccctcactcgtggtatgaccttcagcaagcagcttgaatgttttcatctgtaaaatggaccaggttacttggaggttcaagtgagtaaaaagatgttagaatgcagggaagtccaatttgctgcaaagatgcatgcagattatctaaatcattatcacttacaaggaaacaggacctttggccaggatcctacagctgtctaattgggccctgtaaaaatactttgattcagccactgaatgaagtttgatgtgtgagaaacagagggtgtacctctgcttcctgcagttctgcatgtttttgcagtaagaaagattattgcgttctgtggcagtattgattccgaacgtgtctatcttgtttttctgctttcccttcttttcttccttttctcaacaaagatatttagtgagtgctgtatgccaggcactcacctaggtactttatcctcagaagctgaggtctgtacagttactgtgccttttttttttttttttttttgagacggagtctggctctgtcacccaggctggagggcagtggcgcgatctcggctcactgcaagctccgcctcccgggttcacgccgttctcctgcctcagcctcctgagtagctggggctacaggcgcccgccacagcgcccggctaatttttttttttttgtatttttagtagagacgggttttcaccgtgttagccaggatggtctcgatctcctgacctcgtgatccgccagcctcagcctcccaaagtgctgggattataggcgtgagccacagcgcccggcctatcgtgccctttcaacagatgaagaaactggtgagtttaaggaactgacccaagatcacagaataataagtggtgagctgggatttgcacctgggtctgtgcgtgggcgagtccacctggggcccgtgtcttcactcagcgagtatttattgagcatttagggaattcagaggtaaacgagatgaactgaatccctgtctcatggagcttacagttttgtgggaacagcagataaaaacaagtaagtacttgaaataattacaaatgtggtaattgttacaataggaagcagtagaggctgaaatccattgaagggagaagaggctgctgtgccttcctttgctcctttgcttcctttcatctgccttgcctccctctttctgctgtctttctttctttcttcccttaaatgttacctaccaactatgaagaacgctgcaaacctgggaacccagaggtgaacacgacagtccaggccttcactaggaaatgtgctggagcagaattagagcctggggctggcctggacccagagctgctggtgccttggactgcttagggactgctgagcagacctcctagccctttagaagtgagcttgaatccctgcccagccatttacacactgtgttgcctcagataattgacttcatttccctccttttctgttttcccctgtattaaaacaactgaaaaggaatatctatgcttgccctgcaggatttttgtgagaattaaataagtgtatgttaatgatgtcatcctatgcttaagaaatgttggttgtattacttttcaccctatgctccaaggaattttatggtctgaaggtgtcatggggtcttggctttcaggatgtgactcacttaaggggggaaatgactgtgcatgtcataatgcgtggacattaaaaaaaataaagtttgctccccagggaggatttgccaattcccatattagtaggtcccccaagattgttcccctcgggattcatgcctcataaaatcatttgatctggtgggatctcatcttcttaatgtgtctgcccatcatctgttcctgggaggctttattagggcagtgtgtgcgtgtgtgcgtttgtgtgcatgcacgcaccagtgccatgagtacttgtttaaagtacctccatgtaaccacaattcactgtagttgctatgcactagttacccatgttatctggaatccttcctgcaacccttagaggcgactcttattcccaattttatatacgatgagaagaagttttgagtggtggagtcatttgctcaaggccacacagtcactgagaactgggaccagggtttggacccatgcgtctttattcctgtgcatatttattttcctctatgttgcactagtatataaaagttgcctttcccactcccctcattatataaaaattctttcctttgtctattttgttctctacctcccttaaagtcaagatagctgcctgggatgactacttttttgagttcctagtctctcaaagtgggtctgggccctggacttcctgtctgggctactgattgcaaccttcagaacagggtcagcccggggtcatttgtgttctttgtctccatgtccttgcttttgaccagggccaaacaacccacctgcactgcatggttcccccagcaagaacatcccagtgagaatggcccacagatgcctgggcgtgacccacctgcagcttcaaccatgcaggtaaatttgcctgctgctgtgtcgtgtggctggatggaattcttccctagggatgctaagaaaccctgttgcctaagtcagtgcttcctgcaagctactctttgtaattctttccccaaacaaaaagaaaacaagaaatatacagtctgtagctatatagagacacctggatctatattgtgtggcaattggattgaatgtaacttgaagtttatttttgtcttaccagactagtgttttttcctgttaatttaagtgctttagtgagggttgccattgattgagcaaacatgtgttgagtgcttattatgtacccagctccattttccgtactagccacagagcagcgagagcatggcctttgccctccaatcctgttctggtggacagacactctctcccttgacagggtcctcaccactgtgtgcaccgtcccgccacctggtggccgtgcctatctgtgcattccctatttggttaactcattcacttaacaaatatttactgggggaagacaatatctcaagcacaattctcagcattgagggaggcagcagtgattaagaaagacaagattgcctgcccccgtggagtttgtgttctgatagcagagaaagacaggaaacaagaaaaataaataaatatggtagttttgcgtagtgatagtgctatagaaaaacgttcaaatggggtagagtgatagacagtgttgttctgagcttgtccaccacaccctcttgggacagaggattctttgttctgatggaatggcctttctatagcatagagatgaaatgtgctaccgtttgtgaaaggaagttagtaatacatacatggcatttttgtcttcactgataaagtgttgttggtcaacttttgtcaactctctactttttgtttgtgttgaaattttactgttgggaatttacgaatatggcaactaatgatttaaaccaggggtaggtatcctttttctgtaatgagccatctagtaaatagctggtttctcttgaaactgttcaattctatccgtgtagcattaaagcagccacagccgatatgtaaatgaatgggcagggtaataaaatgttatttacaaacacaagcagagctagattggtccttcaggctgccatttgccaaccactaatctaaaccagtagctgccttaccagttggtcaaacttgtttaagacagggatagggcagaggccagcgaggggaaccaggcattctctttggcctcagttgccatgaaaatcatggtacttctttagggtcacatatcactagattatttgcattaacttttatcaaggtaaagatgctaatagtcaactatggaacataattctcagagtagatctaacataggaataatttagctttgtaatatttatctggactacaatttttaaggcacttttgctacccaaaagtatcttggggttaaacacgctcttggattgaattcctctaaataaatagagacacagaattgggttcagggggttaagttggtaaatgatctcaaggtccataagtgagcgagtggggagagtgagaccaagaagaaggaaagccagcaagccaacagtgaatgtgtcattgaggtggtcacagtcatgggaaactggcttcttgctgctgggtctctacaaaagcactgtgtaaagctcatttccgaatggtccctccacagaataggtggctgagggtgtattcactcgcccttatcttctgctggtcaggggtgacccctgccgtcattaacttctctgtgcttccctgctgagcctttgctgtcatggggagcagtcatgactttggaagcatcatagcagaaaaaatggaaaggtatggcaagttgttggactgtcaggatatgccctgggtagggtatgaatatatgtgatttctcttgccaccattacatgttactggaaacttcctcagtagagctaatggtaacagaaagaattatggtagtggtaatttttaaaaccttctgaatttggttaagcaccctcctgcagatattctctttcccactagatggtaccagtatgccaaagccctagaatgctaccttagggcctcgtctttgacatgtgatatattctcattacttttcaacaatgaatgaataagccagttgaggtcaaaggaatcaactatggatgttttagggacaggagatgggagaaaagtggaggctgtctaaacagttaccctcattcacgcattcagtcatttatcaacaaatattactcagcactgactgagtgctcaacacttttctaggcactgggaatacagaaatgagtaagacaggccaagtccctgctctggtgagcttatgtactggctgggagagagacaataaaaaaatgaacaggtaggtatgtgatgtctgcaggagggtgatgagtgccatgaagaatgagaaagcaggcgagggggtagatagcgacaggcagaggtcatggcgcttgccttcgctgttggctgtagggtgagagattattttcatctgcttcccaaacccagttcttccattcaccaactccttatgacacccctatgcggtttatttttgaaatgaaactaacagctcatggagggcaaaaaaaaaaaaaaaaaaaaagtggtgcttggcaaatgtgtgttcactagtcggggcccactgcagcctaacacctaactcattggactgcttgttggctgatttaatttgtctggaatatttctgaattactattgttgttgacacacaatagagttgcatttaactcagaggttagactataaggtcagggttttaggcaaacacagttgtcattagccttgaactcttttaagttgcccattaaagtacagtaggcgtggtttagtctatgcatccccgtattgtaatcaatagggaacaatgtataatgcacgcagtaatgtacagggcataataaagaatatatgcaagatataattttatagcatttaattgcagtatttacattgttctttttctctctctctttggtgggagagctggctttccattagttaaatgtgcatatgatgagacttgactatattcatttaagccacattcctaatcatacaatctccaccagactgtgcattacgtaaggcaagacctgttttctctgttgtgttctgtttatctttggattcccactaccagtcagatgctttggggtgggggaattgaggaataataatagtagaagtggcagtaatagtagctgatatcagtgtggtgctgattttgaaccaggcctggtgtgagtgcttcagatgcattaatcagcacatgtaatcctcatagtgactctataaaatatcttctatggttttaatcccatttcataggtggggaaacttcaggagaacttagtaaaagaacctaataaagctttaggactctagggctgagattcaaactcaagacaattccagacacacaagaccacatgttgtatgattctatgaaatggaacaaactgtccagaaaagtcaaatccagagacagaaagcagattagaagatgtctagggctgggggcaggaggaaatggggagttactgctaatgggtatagaattgctttggggaagatgtaaatgctctggagctagatagtggtggtgattacattagctctctgtaaataaaccccaaacctgggaatcatatatcttaaccggctaagctttatagtatgttacacatgtctaaataaaactggtattgaataggaaaacaagcaaaccttgggcaggtcagcctcagggctcctgtttgttcatgagcacacaccacctgtcttacagttgttcaccacctgctggtgatactctacttgctttacttatattaacactgcgactcctcaaaagatccccattgtccaccctactgagatcagaaagcggaagcagaacgatgttgagaaacttggggctggcaagtggtagtttcaggattaagacccaggctgtttgggtctaattccttctggctacactggttcttacatgtgtttcattcattaaaagcaacctgtgttatttggaactgcaggtcaccttggcctattggaaataaagcaagggttcttcacgtttgttttgctgatttgtaaagtgaattaagaaccatcttttgcctcactggttattattctcatagtagcctaccctggtgtagagttctggctgcaaagctctcagagactgaagaaaaggagatggtttagtgttactgactttttttaagacagggtctttctctgttgcccaggctggattgcagtggtgcaatcatagctaactgcagccttgaccacctgagctcaagcaaccctcttgcctcagttctggaaatagctaagtgggactacaggtgtggaccaccaggcccagttaattaaaaaaaaaaaaaactttaagacaaggtcttgttatgttgcccatgctggtctcgaactcctggcttcaagtgatcctccaggagtagctggcattacaggcttggctgacttttaaaagtagtaagtggtttaggatggggggtggtatggaggtcgggtggggagaaagaggagagaaatctaattgatatgctaattgtcattgtactcaagttgatagcagattgctgaaggatttaggatttacccaaattaacatgaatgtttggcaccctttggctggtgcggctgaagaattcaatagcctagtaatgagaagtcaatctaaggtctaaggctgggaaaggagctcccacttcttacattcagtgctcatcactctgcaaatcaaggccccccgaactcctcccacccctgccttctgcgtctccctctgtgctctccatcacccccctacggagttcctttgattctcaggtcccttaaccatggaacgtactcctgtctgccctcactcgtgggttgatgatttctatcctttgtcatgttgaaaatgctgagtgacaaagccattagccatgcacagtgaaacaaggaaagcagcctagagctggtccccagaccaggcccagtgcacgagtttgggtgctggaaggggaggctttatggaggcaaagctgaggggctgtacgtgtcttcataggtctccagtctgtaaaagcaaccacgctttgggctggggcagaagtcaggacttgaactggctctggctgggacccaggctcccaggtagccagctcccaggtgacaggagtccgctgggctccctctgattcttaaagcctttccaggtagcaacaggagatcacgcaaagccacgtaagtgtctgattcagtcctccctggtcagttttccagcatagcgttttgcaaaatgtgttctgaagagatactggttccatgggaggttaatatgggttctggggaaaaaaaattaggggaatcaaaaaattacttgtataaactaatattttggaaaactctggagttagagaagtggaccagattgggttttgttttttcacaaatgaaagtctctgagattgtagtgtgtttcagtttcagagggctcttcccaaacccctgaggttaaggaaactcttgtacacagtgggtctcgggcactaactcacagatcacacttctgaaaacaagctcctaggatgccatatctcagagtacgggcttcgacggggcccttcacccagctccaggaccaactgggagcctgttaggactgcaaatcctgtcctctggacctagagaatgaaagcctctgggggcaggctcagaaatctgtgtttccagattccactgggttttcaactccatccagaataattcttctggtgtcactgtgaatatttgctgatccttctgacgtctatccgtggtgcttgtttctgaagtgtagtctaaaccgttggctctcaactgttggggtgaggggggttgtgaccctcgggacagtttgcaatatctacagacatgcttgtttttcacaacctggggaggggagtgggcatctagtgggcagagctcagggatgctgttcaacatcctacaatgaacagcacagctcccaccacaaaaggttatcctgacccaaatacagtagtgctgaggtggaaaactctgatccaaatgcatagcttcatactcacccagcacacacagggatttttatccttatcttatcctgttattactaggaggctggaatctgaagctggggctgtgaaaagatacctcacagcaagccgctattcatgtataatttttcaaaaggtaaaaccaagactcttgggtaaatacgcacttcaactcattaatttatgaagaaaccagtaagatgccatggttattccaaagggcatttaagaagctaaggtattcgtaaggaatttagcaaagaaatgtgaagacgagattgctgagttagataaaaagtggttaatgttcatcatgcctaaacttttgggggttatctgttctattagataaaaagtatttgcatctctactggacaaaagttgaccacttaagtggtgacttcacaaagtctgggatcttcaagagcaaacaatgagatgaactaagagcatgctcctaaacaacttcaggttgtccctgactgataaccaaaggatgtgccatcaaccatttgggccttgtttgcaagctttgaataatttttctggtgctttaaacacattattgttagtattttgagacggagtctcgctctttcacccaggctgaagtgcagtggcgtgatctcggctcactgcaacctccatctccagagttcaagcgattctcgtgcctcagcctcccaagtagccaggattgcaggtgcctgccatcaggcccagctaatttttttttgtatttttcattgagatggggtttgaccatgttggccaggctgatttcaaactcctgacctcaagtgatctgctcgcctcgacctcccaaagtgctaggattacagacatgagtcaccgcgcctggcctaagcacatgacttttaatttactggtgctgcatggtctgtgaaaagtgggtcaaagaaatgggaagtgatgggaggagaggtcacaggaggccaaggttgtaatatggttagaagccatttcttacctgtcttctatgaagtgtgggttgtgagcgatgctttcattcaaacctatgaggtgcatcttgtcatcatccccatctacagatgagaaaactgagtcagaggaagagttaggtatgtcagtagcaggcatgggcaaaggaaggagaaagtaatgatcaagatgatagagggagaattgcaattaagccagagagaggaaggatgatgttataagctcgagggaagcctgagtccagatctgaagcagatatactcacagcacgttcagggggtaatgaagaggctgttatgggtgactatgaatgtgaaggcaacgtgagattggatcagagttagaaagatgacagttgttaatagcatcagtgttattttagccaaaggactttactattgctgtagtgcagtgcctcgcagtacaccatgacagttaagagcccaggcctcgagggaaggttacagtttgaagcccagctctgccactgtagggctgtgtgaccatgggcaagttgcttaacctctgtgcctcagttaccagatctatgaaatgtcggcagtgaaacctagctgatatgactgggatggggattccagagaaccttgtaaacacttggtccagcaaataatatggcctcagaaaatagaagctggatgtgtttacgtacatgaggaaatggacagataggacttaacagaccatggttgtgagtgacttggctgtaagtgtcacagtctcagtttgagtttcctcaaaagcggatgctgtgaggaggatttgagtgcaataaattctcttgggaggtggtccaaggggaagtgtagaggagtgggaaagtgaggcaaggaaggaaaaggaaacagacgaggggtctgttactcaggcaggtactgctctgggtgtctggagcttaactcccctgggaacctttgagaatcagtgtggaatacctgcttccaagccatcccacctgaggggcatgggagctccagattttatgccacaaatctggttggcattgattcaaagctgccccagggggcactgattttgagactactggactactccagcctcagagaaagcagtcagtgaagaggtgtagatatttgcagttggaagttgagccagccctgtaatggaaaagccagaagagacaggagcttggggttgggtggtgagctgtctgtcagtgtctaatgtggtaagtatctgatatggtttggctgtgtccctgcccaaatctcatcttgaattatagctcccatagtccccatgtgtcatgggagggaccctgtcgggggtaactgaagcttaggggcaggttttccctgtgccgttttcatggtagtgaataagtctcacgagatctgagggtttcataaggggcagttcccctgcacatgctctcttgcctgctgccatgtgagacatgcctttactcctccttcgtcttccactgtgattgtgaggcctcctcagccatgtggaactgtgtgtccattaaaactctttttctttataaattacccagtcttgggtatttcatcatagcagtttgaaaatggactaatacagtatccaaaggcataaaaatagtcatgcactttggggaagtaatacacatctgagaagttaaacagaggtaaatacaggaaaatatgtacaaaatacattatattaaatgatatatgaatattgtatatgttttatgcattgtatgtgaaatagtaataatagccaacgcttaggaagtagttgccacatgcctgactctcctaaatgctctgcaaataggttagatttccagcaaatgaaaacaggttaggcagctcaatagaatattacataaccattaaagaggatggttataaagatgatgataatggcatggaaaaatcatatgaatgagaattgaatactaaacaggagattgtgtgtgcagtaggattcctacaaagcaaaacaagcctctaaataaagaaaaagaagggtggaatctgaaaggaatttatcaaaatcctaactgcaattttgttcatgcgttgggattcagagttgttttttcccctctggtttacaagtctccattgatacacttgcgttacatctataatgaaaaatacaagaaacttgaaaaagtacaagaagaaaaaaccttctaaaaaataggtggtaagacccagtgaaagttttaaagaagggaataacataatggaaaatgtatttcagaaaaattaatctgggggcagtgtggaagatggattgaatcaggaaacacccaaggtgagaagtccagcttgaaagcttgtatgagttactgggagtatggaaaagaaagagccaattttagatggttgatcatgaatgagatgatggggaagaaagagaaaagtgccagaaatgattccaacattttaaagcattttgaatggaagaaaataagcaatggaactaatataaatatagttagagagtgagcgcgcaccggctttctttacatttgttgcttgtttaaacctaacagcaatcctatatgctatgcttttaatattcctattttacaaatgacataatagaagattagagaaataaagccacttatccaaggtcacacagggtccaaactcagattattgtgaaatgaactggctagatagaaggatagatgatggatggaaggatgaatgcatagatggaggatggatggatggatgatggatggatacattgataactatatgaaggggaaggaatctggtgaattgtaatgttatagtggaaaatagggcatttcaagaaggaagtggcagatagtcttaggcagtgaagaaggaagggaacagagaaagcactagattcaacaaaaagaaccagtcactggtcctctttgagaaggtccttccagttaaataatggaaagtgggcttaagcagcatgggggactgaagggccaggacatgttggggaacctgtgaaatggctagtcagagcatggcatgtatgagcttaaaaccagatctgaacctaaggaagagatccaacaataggaaggagaggggatgtaagagagaaaaatgatggggaagggagaggagggtaagaagacatggaaaaatggaaaggaaagaaattactggttaagaacaaggacaccagactgcctgggtttgagtctcaactccgctgccctgtaaccttgagcaaaccccataactgtctctgcttccgacccctcatctgttgaatgggaaaagagtaataagctctatatcctggggttcctgagaggaggaattgaagcatgtaacatgcttaagacagtgcccggtgtgctgtaagttgaaactgtgtagggatcctgttgccttagtcatcacaacaaggaccatttcctgggcaacaacccaaagctatagattaagaaactgaggctcagtcacttaaagaatgttctctgagaaagtacacttggagcctcaacattgctctacctgcaagtagttacctctcctgtcttccagggagaaatagattttgtgtaaaataggatgcatggctttgttagtggaaactaaccttcagcaattgtaataaatgaggtacgtgaggttgcatttttttctcctttttgaaaaaagagttaataaacagaggctgttcaataaagcagagttagaaggagtttaggaagcactggagagtggctgaggagcaaggtagtgaggacttggaggacctggagaaggcagatgagatccatcagatcccagaaagctccatcaactcagtgccctttctctattccagaaagtcttatgctcatatcattgatgcttggagaagcctgcacaccacagacttggcatgagaagtcctaaaagcctcattaacccaaccacttaggctttctgagtgcaacccctaccctattctatttgggctcagggtttgctgggccccaaaatgtcccgctgttgggatgaggagattcagttaatacctttctttggttggctctcctcccacatccccctacctctctagccttggtttccagaaaactgtatctgtgctcagcctgctccctcctgcccttggtgatcatgaaacctgccaaagaagcattctctctgaggctgagccactggagaagttgcacatccaggattgattttgcatagtgtagaaatcaatccggtgaacctggcagcataggtatcctctaagtttggttgtaagcccagtggggcagggcagtaaacagtttaaattggaaagttaaaacaataaacaggagagacaggtgaagttggggtttgaaatttgctgggctagaatgggttttctctttctgtgttaatcttatctggcagctaatctttacctgtcatgtggtttttgggggagaaaacggtaccctctttagactgcttccttttctgggaggagaaccctgagaaagactatcagtttgaagttgtccctcctgggatagaaatttatctaattttagtgggtggcaagactatgaacaaccatcattatctgtgctccaataattattaatttaatgacattttaacaaataagaaataacttttattgagcactgtctacatatcaggcacccagctaagtactttcacatgtgatgtctaattaaagcttctgaatatgattaacttcattttatagctgaggagtctacagcctatagggcacacacacatataccatcttcattgatcttcacccaaccatcagaagcctgggaaagacattttgcagttaagaaaagtgaatctcagggacttgtcttcttcagcaaacaattggcagaaccacggtttgaatccaggtcttctgactccatattactttgattttattgggagagtatatgggtggcgtatcttcttaaattcctctggccaggtcctgagaaaagcatttactgtgcattgtctcaacacttgtaataaccctattagggaggtggtgtttttccactttacagtgaggagactgaggcttagagagggtaggtacgccattggaacaaagccactcaggcagttgtaggaagtacagctggggcttataccttcccattctaccctccaggttttccctgctataagcatttcttacagcagtgccttcaataggagaaacaatgacaagtgatttttccagtgggacagcaagaaggtgattgtggtcttggaccttgggatttaggacgggctattgacattaacagttggataggctgctaggtcagtccagggaaaagcaggagggaagataagacatgactgagaattcaggaagggccagcgccatccaatcagaacaagttggagcttttcgtcttctttaagcctactagtttcacttctcattttgaaagaaacaacttgctcggccaacctattgttgctgcctttctctgcctaccacagctatgaaagcaaagttattggaacatgtgaacgtcactagcatccgaggcaagatttaggttctgaaaagaggtcatcagattgtagagttggatctccatttccctggagagtcttgtgcttcagaaaatcattattggtttgtcatcctagcctgtcatggtggaacccctgggctctgaaagattacaggaaaatagctggtccttggcagttctcagaaggttctgtttctcacctgggccaggattgtgcctgtggtttttgttcatgacaagatgagaagagcttggttaaataaggaacgacctctcgttatatatcttctatcctgattgattgcatcagaaaagccattcatctggtttgaagatagacaggtggttgctgtcactgcaccagcagcttttgaagtttgctcagtgatatgattacagcccatacttaagcttctgctccaggaagtgagattgacctttgatcctactcctcatttaaaaattacagatcttggaaaatgaaccaatctagaaagatattggaagctgctgctgctgctgctgctgctgctgctgaggttggctgtcaaaccaacttaactggcctgcattacctagaattgtttttttttttttttttctggttaaaaccaatgacctttaaagcctttttatttttcctctgacaatctctagtggacctatggtcttttgtgagttctgatgggaatcccagaatctttctgtaactgtgggttccaatgagagaggcacatttaacaaagaccagaagaaaatcaaaactgttgctcaaactgacagtgtatgttcttcatcccactccttcattagctcattcattcattgattcgttcattcatgtgctggctctttgtagaagttgggggtaaacaggcgaccaaaaggtagtccgtgaccccaggatgttgtaattcagaagggtaaacagacaaggcagtcaacattgtccattcagtgtgaatgagcttgggagtacaaccactttggaaacccattttgttaatttacctttgatagatacttattgaacggtttttccaagtgtctgtgaagaagacatggtggtggtagggggtgggtggatggtttctgaggacctgataatgtttctccttgattttagtgccagttacgtggcaactcatggaaaacattgagctgaatacttgggcttttgcacctttttgtagtgccttagtgtattttacacaaaaaaataaataaaagtatgctcagcctcaggtgtgttggaaatacagaggagagaccagcccaactttggaggagaacagagagagggacccaggaaggccttctggggaatatatttgacttgggccctgaaggagcaacagaaattaggcactgagtaaaatgggactggatgtacctgcacaaagccagcagcagaagaaaagacatggagtggagggagctggcagttcatgcttgggggaagctgagagttgcttgtggggctggaggccaaggtgcagggctgcaggggtaggagggagcagccagggagggggtggattggttaagaaacacgatgtgcatgtcatgttgagaaacttggatttcaccctggaggcgcaggaactaggggggatttttcagcagcagtgacagacgctcttaaatctgggttttccaatgatcagcatgcttgtgcctgcaccggggcgcaggatgggagacagatgccttttgcagtagttccggagaagaagactgaagaccacattcaaggccctgagagagaagagaaggggacagataccacagagatcatgagatatagcacaacagataagacttgctaattaactgtacggggttacagggagggacagggagaaatcaggtttcttccagcccagcttctggttggaatcactcaggcagagacacatgggcctgagagaggattccccttatgacataaagccgcaaaaattctcattagtcattgcaaaaacatctatttccggcctacactgcaccagccagtgggggaggtcctgagagatagagaaaggatgaattcttgcccttagagagtcacctagagattctggggagacagcaggtccgagtctctctgcctgaaacctctggacagtgtctttggctgacacttacatggtggtcttggtttcttattcaaggtcggtttcccaactctcatagcatcagctttagggcatccccaaatctcttgcagaagagatggttctttccccttgagttgttttgagccaagcatataacattgtgtgaatgtttgaaaacttctcttggttctcagaatgcaattctgacagtgctgaaggctgccaattaaatgaagatttagataaaggctgtgtgggaggtggaatgcaatattcttaaacctaataatggcttccttctgtctttttgaagctctcaaataatcctgattgactgactctctgctttgggcattcccattttctggacaatttaataccatttaaaatgtttgacaacttttatttgggggcagacatccttaggggatggggccgtgggcaaagatacaaatgctgtaccatcaaaggaaccatggatttaaataaggatttttttttttttcatattcagaagaggtgggtacagaaaggatgagggcagcttctcaggttatagtattaaccacgtgaagcagctaacaaaggtatgtgcctggccttgtgctaaaggctttcctcgtatcagttctttcatccctcccaacactactgaggtagatggagtgactagatccattatacaggcaaagtagctgaggcccacagccatagcaaataaactgtggagctggtggtcccagatttcatgcttttagtcattctcttggctctggggtacaggtaagcttccagaactggaggatggagtccaaaagaaactcaagataatttccctgcctttcccattgtatcaggggattcatctgttcatacattcattcattttcccaacacatttactgaatgcccgcaagcaccaggaaaatagcaatgggcacaaccaggttcctatcttcatggagctattgctttattggcagaggcaaacagtaaagaaaattcattagtaatcagtgttgcaatcaatgagccggtcaatcaagcaccataaaagggtaaagtgtgacgaaggtgctccttgtgataggggttgggggtgaggggaggtgtcctggagaggagacatttcaactgagatctctctgaagtagatgagatggccatgtggatctcaaaaggaaagtgtatgccaggaagagcaaaaagcaagtgcaaagtcctaaagcaggaaatagtgaggctaccgcagtgtcgggtccaagagtaggagatgagatcagggaggcagattaggctgcagggagggtgtgcgtgtgatgctgagagtgatgggaaaccactggtggggttgggggagggcaaggcagtgacatcatttgtttttatgtgcagcagaggaagccaaagcaattcagaagaagcctacagaagcttacctcctccacaggctatttttttcttgtttacatttgttaattttacatatatattaactcagtcctcacaaccaccaaatgaaataggcattgcccttattatcattctttcccattttaacaatggggaaactgaagcttagagtaggcaaggtcgcccagataggaagcaatgccttcgggtcatggctcactactcaagtgcctgaaatttcagctagcctttagtgggcacctgctatgtgccaggatctgtatgaggtttggcaccacctagacagccccttgaaccagtggcatgtctcaggacagtgtgagagacagaaacttcagctgagagttaccgtgcaaggcagaaaatgctggtctagcaaaaggaactctgatttcgatttggaagtacagagaaagagcatctgccttggacagagttatcagtgaaaagatgacatatgagctgagactgaaaatcatgttgaagatagtcaaacaaaagctggcagtgtgggagtgggggcttcaagcagagaatcagtggttcaaaggcacagggtagaaggagaatggcagctggctcagtgtggctggagaaagaggctggagtgcacctggttgcatttgaatggtgtgcgtgtgtgtgtgtgtgtgtgtgtgttaatgatggtgatgagatgaggggctagagaggaagacaggttggcacctggtagcattttttaaaaagcaagtaaaccttattttttagagcaggtttaagttcacagcaaaatttggtggaaggtacagaagtttcccaagtacctcctatccccacaaatgcacagccttgtcccactatcaacatcccacatcagaatggtacatttgttacagtcaatgactctacattgacacatcattatcactcaaagttcacagtttacatgagggttcactcttggtgctgtacggtgtatggtggatacatgacaaatgtgtaaattcatgtatccaccattatgatatcacacagaatagttgtacagccctaaaatacttgctctgcctatttgcctacccactcccttctccctaacccctggcaatccaccgatctttcttctatttccatagctttgcctttcccagaatgtcatatggttggaataatatagtatgtagccttttcaaattagcttccttcacttggtaacatgcattgaagtttcctccatgttttcttatggtttggtagctcttttttttttttttttttagcattgaataatatttcattgtctggatgtatcacagtttatccattgacctacttaaggatatcttggttgcttctaagttttggtgattacaaataaagctgctataaacatttgtgtttcctcatatagatcttgtatatatacagtagttccccagttttcatggggaataagttcccagacacccaatggatgcctgaaactatggattgtaccaagccctacatacattatgtttttttcctgtacatacctgtgataaagtttaatttataaatgaggcacagtaagagatgaacaacaattgctccataaaatggaacaattatgacaatatgttgtaataaaagttacatgcatgtgggctgtctctctcaaaatctgttgtagcgcactcacccttctcttttaatctgtcagtctgataaccaagatggttactgagtgactaatggatgatgggtaagatagacaggatggatacactgaagaaaatgataattcacattcccggcaggatggagtgggatgacagaagatttcatcatgcaactcagaacagcatgtaatttaaaacttatgaattatttttggaatttttctatttaatattttcagactgtgattgaccacagttgagtaaaactgtagaaagcaaaccttggagaaagagagactactgtattttgtacatttcatgtacacagtttgctagatttatatgtaaatattccaatttggggagggtaatgtaaattgtattgtgttttaaattcctgatttcattcattcattgctggtacataggaaagtgattggcttttttacattaacctcgtatcttgtaatcttggcataattacttattcttggagtttgtcaatttttttggatttcttacatagataatcattttatctgcaaactaagttttgtttcttactttccaatcactatacctttgttttcttttcttatcttactgcattagctaggacttccaggacgatgttgaaaaacaatggtaagagggcacatccttgccttgctactgatcttatcaggaaagctagtttcctaccatgaagtgtgatgttagttgtaggctttttgtagttgttctttattaagttgaagaagtttctgtctgttactagtttgttgagagttattatgagtattgattttgccaagtgctttttctgcatctattgatatgtgcatgtgatatctattgatatgtgcatatgagcctcctggtcatcatcccaggcttagctcacaaaagttgtgagcagggaggccaccaggaatgtggggcaggtattatgcttcccattttacagaaagtaatgccagaagaaaacagtgcacagttactgctggttcccaatagttgatttgactcctttaaagatttagctgtcccatttatgtgctggataacatcaattgattcttaaatgttcaacaagccttgcatacctgtgataaatcccatcatggttacattttaatatacttacttttcttcatacctgtctcaagagagaaagtagctcagtggttaagactggagtcaggctgcctgggtataaattgcacctccgttgcttattagctgtatgaacttgggcaagatatttaatctctctgtgcctcagttttcacatctgtaaaattatgtcaaatagtactgatctccaagggtggttgcgtgggttaaattatacctaaagaacttagcaccccactcagcacatggtggctgccatgatggtttgccgtgacctctcttcatttgaatgtgtgcccagtgtcttgtttctctctgtattctcagtgcctggtacaaagtcgatagattttaaaagcccatagaagaaaacatacatttttccctgtttgtgggtatgtatggaagattctgtaactttgactagacacttgatattcagataaaatagccctaaagaaggttctcaagggggtggattttctcagactattgtgagcatagttcctaaagctgactctatgtcttgtgctgactctaatcccctcctggccatcatcccaggcttagctcacaaaagctgtgagcagggaggccaccagggatgtggggcaggtaatatgcttcccattatacagaaagtaatgccagaagaaaacagtgcacagttgctgctggttcccaatagttgatttgactcctttaaagatttagcacctgagttagaatccggatggcagaacttctctattggaacctagtcccactattcctctctcccttcattcaacactgggtttagaatgcttgccagcagcattgtggaaattacctcaaaggtagaaacacgtaactcataagcacacatgaataggtataggtcataatcctggaaagacggccttgccattgagaggggaatagcaggagcaaggctacggaagcacgggactctggttgagtctaggcactgtctgcatgtacttggcacattccttaaaaatggcagcaagcagtccattctcaaatggaaattggaacaaaaaataacgtaaaaccataaataacagaaaagaatatatactcaaacatgtataatccatatgcatgaacataactcccctattgggaatttctcataaagaatccccccaaaatataataccacgtccacaagaacccacccacaggccaggtactgtgcgaggcactggaatacaatgggggtaacatggactaggagactcatgaaaacgtcatgacaaacacctgggaaattctgaacgttaaatagtagggaagggtttctccaccatggcatggtggccactttgggcaggaagattgtggtgaggctatcctgtgcatggcaggatgtccagaagcatccctggcctctacccactagaggccattggaagccccatcctcactgtgaaatccaaaaatgtctccagacattgtcaagtgtctcctggagggaaaggggggaaagtgactccccattgagaaccactgctttaggggaatacttaagaagttgaggcatatctgctcactggaaaatggaaatgagctaatttggaggcttaaaacagcagcactgggaaaatgacataaattttaaaaagcagaaagtaatactgcatttattctgtggtttggctgaggttttgggtttcagaggaagctgctgagaaaagagagggagggaaaatgtgacccagaaatcacgggaaccagggaatctcaacaaattgagtatcttggtttgtgtaagattaggaacctggagataaatatgggtcaggcagatgcaagtaaaatgatcacacgtggggagcatggaaattgggtcttaaaagtgagttaagtcaagggtggtatttaaaatatgtcatatgtaaatatgacagagaaaccaccaatcaaaacagccatctgctgaaaccacccactatgggcgttcctgtgcctgccggggcgtgcggggaaacccaagagggagcaccagttggtgaacgtcagtcaatccacaaaccatctaacagaggcacagggattaaattcagagcaagacctggcaaaacagaaacagcccgaggccagagatgaagtgaaagaaagatgacaacctagggcccaggagggaagcttccagaaggttgagttatatttaagccctttcactgtatacctgggaccaaagaccctagagcagcttcagacataaattatgtatatacatgaacaaagacagaaagggagcaaagaaaaatgaaaacagcttgatttgtagggctttcagcatggcgggtggttttctttcccccctcgttttatttagacgtctgctgctgctgcttcaattttgttccggcaatacaagtaaaatatatgtggatgttaacaaagatgtaaagagccttttgaagtatataactgattataatttaacattcattaagtttcttttatcaaaaaaaaaaaactattaagttcattgaagaagtcataaaaacaaaccaaacacccaccaccttctcccctcctggggacatggcagtggccacttcaaagtgggtcaggtctccgtgaaggaaaggggctcttgagagagtgatggtggcccaggggccggtgtgatgtttcatgctggagggatacagctgtccgtttcctttgcctcttttcatcctgatggagcaaacggctcattgtttacgctgacctagtgaggttggcttcaagctctcccctcaccatgttgtaatgagatagtcctgaggacacacgctctgtccattgaaacagattagctctgatcacagcttaattatgtgaagtacagccaaaccctatttatgcttttcctagggatggggtggaacagataggaacgggtaattgacagacattaagaaatagacttaaatattgtttgtcctgctttagtacgcacgatattaatgagatgttattgtgagtgctgagtaaagaggttgctgccggctggttctcatgccaggcagccagcagaccttcttcccaagcagggaattagcgcaggtgttcccttggtgaaagcctggctatcagcatcaacaccttctagaagatccgtgcctcttggtttatttcagggagcctgtgcaactccaaaaggatggatgctggatgcatatggaggttccatgccttaaggctagcttacaaatgtatgaactcgtctgtcttttattccatcagaaatgaatgtacattgtaggaaccagacttagcagagaacacggagtattgggggaaacctcaattagggaataaagagctagtacacacacagatgtgtgtcacatcagactatgtaatggacacaatttaggaacaactaaggtatgtcctgtaattaggggacttgttaaatctgcactgtctaatatagtagccactagttacatgtgactgtttacatttcatttaatcaaattaaagaaaattgaaaattcagtgtcttgatcacaggagaggaattttaagggctcctttgtcacaggcggctagtggttctcatgtgcagatgtaggacatccccgccatcacagagggatttgctggacaccactgagtcaaataaatggtagtatgtccatagaatggagtattctccatattctcaatgaagtaaatgcagatattctggcatagaaaggtcacccttgtgtattgccaggtaaacaagttacaaaactttatgatattaatttcacttaaaaaacagatgcaacacacaggcacatactttttggataagagtgcaaaaaacacagaaaggatgcacaccaaattgtcggcattagttaccttgaggaggcgggggtagatgtttactttttattttcttcacatgtgtattgtctgaacatatttcaatgagcatgtgttactgttgtaattaaaaagagatttatgtgatgaaaactgatgaaaatgattgagaaacatgaacagagggttttctctttgcctctttagagactggttaatggtgctacctgagtgagattgaccagatggcttgttgggagaagaagggagctggtttggagtaaatccatccccaccactatcaggtcttgcccaggcataccctgcttttcctgaatgtcctgaatgttgttgtaggacaacaaatgcgctttataattattcataggacctctcactactaatctttgagtcgataacagcttctgctatagaagggggcagatcactgggcttaaatgtcaaatagcgcctgagaggcttaaacaaccaccagtatgtgtccctctgggagggcttctctgccatttagaagatcaatgagaagatgtcctccaggccagtgtgaggtggtagaggtgtgtgcttgcgtgggcatgcctgtgtgtctggtacccttacccactgaaacagcaaaggacatgccttctcccatatgacaaatcggtacattgatgatttcgagttaaaaacattggataaattgcagtttcagaaagggctagctgacttgtctcttcctacatgtagcaggccagaaagattcctctctgggaggggcatcctccccctgccagggcaagaaaatagcccttatcgccagagactgcggattgcaggctgcagtgggcttgaataaatacccttactgaagtggcccttagcctccactaggttttttgtttgtttgtttgtttgttttgagagggagtttcgctgttgttgccctggctggagtgcaatggcgcgatctcggctcaccgcaacctctgcctcctaggttcaagcgattctcttgcctcagcctctggagtagctgggattacaggcatgcagcaccaggcccggctaattttgtatttttagtatagatgggtttctccatgttgttcaggctggtcttgaactcccgacctcagataatccacacgcctcggcctcccaaaatgctgggattacaggcatgagccaccatgcccagccaccgccactcattttacacagtcccctgtatgtctcctagtgactcccctagaaattcactgaccctagccagatcccatttgtcctgtctttgtcagatttatcattctttgtctaaaaagttcaaaagcatcttgctttggccgcttcttcagacatcactctcttgtgaagatcccttgtacctggaaaactattaagatccgtatgcttttttcctgttgatctggttgtctgattcgtgtccatttggtttctaggtccagccaaagagcccacataagaaccaaggtggggttgggggtgatctctggtcccctttgtgatcctcttctaggagatttacctctctgctagcttacatactatgtgaatatagcgtgggctttcttcttgctcttcagaaagtcttctctaccctccctcctcctaccatggcgcattctgcagcatgacaggcattccactctgaggtgtgagccatgtgggctctcaggactcttttggctccacttctgcctttgtagctgtggaccacgaggcagtgactttgaaattcagtcttattctgcggaaatattacttactcgtccctacctcatagggtggtttttcgaagtcagtgagacaaggacagtgaagggttgaggcagtgctcagcacatagtaagcgctaaataaatgttagcttttgttgaaattaatcttacttttcactaaattgtgctgcaaagcaacgtgccattgcctgttcttcacatggctgtgtctctcctcctcagatggatggagtaggagggttgttggaagacaaaagcatcctgcttcactcttgtctctccaggctcctgacagtgatttgcactagctgattagtaaattcatggcagtgcctggtgcctgagagagcgagggttgggtgcagcttggctacagctctgaacacagcagtgggggctcagttgcttggaaaagctgccagccagtgagcccagcacagtcagagtcctgtcaatgcagtaggtgggtaaaataagacaccagtgtgcctttgaagcatgactttctgagggagaaggctgggagcctttacatttgatgactgggagaaaggacccaagtttttcctgtgtgtttccttaaaacagccttattctctagatgtgatttgttttctgttttattttcaaagagaagaaaatcttgttaatacttgcttattaactaacaatttcactttactggtttggtatgtaaaactgagggttttcttctacccagtggcagtttttgatatgaaacagtaacaacaacatcaacgtaacttgtatttttgaatatatttgatacagatattggttaaaagcattttgtacatatatattcttacatatttgtgggtatgtatgaatacatgtatatatgcatatatatgtgtgtgtgtaattgattctcattattcatgaattctgtctttgtgaatttgcctactcagtaaaatgtatctgtagctcccaaatcagtggtcatggtagtgttgtggtcacttgcagacatatacagagctgtgacaaatttgaatcatatgatgtatatgcttccaggtgcattcaaactaggtgagactgccttcttgttttagctttcatactacaaacaaatatccttttcatgaaccatttaatgccacatttgccacaattttatgctatttcttggcaattttgctgtcaaaatggccccaagtggactgcagagtgctctctagtgtctctaagtgcaagaaggctgtgatgtgtctgactgagaaaatgcatgtgttagataagctttgttccagcatgagttacagtgctgctggctgtgataaattttaagtaaggcatctttaaaccgaggcgcacgtaaaacaaggttatatattgactagttgactgaactgtgaccagaggctcacaggaacctaaccctgcatttctactaggagcaatggttcaatatatgttaagtattcatggtgacttcatagaacataagtaccataaataagagaatcaattgtatgcagacactccttgatttatgatgagattttatcctgataaaccatcctacatcaaaaaggcggctgcatgcctacctcaaacatcacaggtactctgcttcaccttcctcaactatgtcatgcctcaactctgcttggactctgcccaactccagacagggacaatgtgacagtagccagctcctctctgaactgacaccctgtaaattggacctactgaacagcaatagtttagcctaacctactttatatgtgcttagagcacttgcgttagcctacaggagggcaaaatcattgaatacaaagcccattttataatgaagtgttgactgtctcatataagagtattgtaccacatatttctggaccaggaaaagatcaaaattcaaaatctgaaaaatggtttcaatggagtaagtatttcttttgtaccattgtaaagttgaaaaactgttgtctagtcattctaagtcagggaatatctgtgtataaatcgtgtaaaatcctcccagaacctttatgagagggtgtggactgtgattcttaagttaatggcatccctctctgcctataacgatctcacgtctgtttttttgccaaaaaatatagctgctggggaacctgttcagggaagttgggatgtgtttatccttaggtgtttattcatctttccaagctcctgcaatcaaccagaaacacaggggaatggaaggcttagtgtttgttgtaccaattatgccacaggcagtatcttgtgtattttaagtaacagcactgctttggtaaggcagttgatcctactttcaaaggcaaggtacctgaatcatggacaatgaggccaccatcagccctccctctccaatcaatggatgaccatacactgtgcttgttccttccacatggagacccatacttgaatacttggtgggtaccttgagctaacctctcactttgtgtggaataggcagtgggctataaggggaaagcacacactttgaagccagactcacttgcattggaatctgggatgtctgacataacaacaactactactatttttttggccatttactataacctagtcgtaggttaaccatacaacaaccatggtaactgaggcacgaagaacatctttcttatttgtggtgcatatcacaatgtaaaggtagtcctgttgatacacccatttttagaaatgttaaatggtgtgctcaaggtcacacagatggaagctggtgaatccagaatttaaaagtagaacatttaatcccagagccagcctgccttcccaccatccaaacgatgctatgccacatcttgaagaatcagaaccaccttgtcaagatgggtgacaattacaacagagaaatgatgtaaaatgcagtgtgtagtttctgcccctgagatgagttcaggaatgggtccagttcctgttcttaaacacgctttgccctactgcttgcaagccaactcggagccttctgatgtttctctccaaactgacaaaggaatcagctgttccttctagagggggaatactttgacttgtgtcttcagaagttatctgatgccagcttattcacatcgcctcacctcctagcagctggagcaggaatgcagcagtagggtattgaaatttaagaggttggccttgagtcactgacttagctgggtatcccataaagcagagagcttatacatttctatcgtattagggagacaattccagagagtgagagtgaaggaagaggggattgaggcaggtaaggaggggaggcttgcgaaggcgcgtactgagctggccatccccaagtgcaactgattgagaggtttgtagagctttgtccctgagaagcctgcctcaccaggatgtggtgtggggagatgaaataattcctccactcattcccatctgctattggccatatgttggctcaaggggcgttcctttccttgcaccgtaggattgtgcatgtatgatggggctcctctaccgagttaagaaggaagcccttggcaagggcggagaggctctcagttcagagaggagttgtctgatgtcacgttgcccctatctgaagttggacagagcccaggcagagctgagatgtgacgtgagtgaggaaggcgaagcagtgcacccatgatgtttggtgcagtcttgaaagcgcagtcactatggagccgccccccgcctctccccttctgagccgccacagctcacgcttgctttctatgtcctgagcttttctgtacctctgtcttgctatgtcaggcattcatggctgtgctgttagggagccttttcaatcttctcatgctccagtttcaaagctgtctcaaaatgagataagttaaagcctaatacagttttttagaaacacctgtatttgtcacgctgacctaatattaacacaggttctcgtctctacttgaatgttacgcatctatcgcgacaccattaccaggactgcgctctgaatctttagagattatctgtgtgcctgatgtcatgaataccaagtagatgatgtaggatggctataccctgccagggagacctgcctggggtaccagtgagtttacaaagacttgcaggaggcagcatacagaccatgggcttgtagctttccagttcaactacaccaccaaaccctggcacctaagactttggttgttccccgtgtcctatgagccctgatcacaaggtgagcaatgccttctaggctgggaaggcagagttggcaagaactgccaaccccagggatggcatcaggcccgctgataattaaagggtgcctaggacatattgcctaagctgttattggttctagaggactcgacttcattccatgaggggtaaaataagtagatagggaggcattcagagcctgaactggtaaaggggggacagttataatattaccccaaagctacagctcagggaaaaccattagggcaatgtttttttgttgttgttgtttcttccttaagaagggatctgtgctatgtactttagcatcacctgagatggtgtgaacaatgataagagtttgaggccctgtcttttatctacagattcagcattccttggggtaaggtctgggagtctgtgttttggcaagagttctgagtgattctgatgtacactaaagtttgggaatgactgtcgtaggagtgttcagtaacttgggcctcctggaatgctctaagttgtgtcacagcccagctgagtacctgggacagaacagggaaaagcaaggagtgacgatgtcagagaggggctgtgagcccctggctttggagccagacctgtaccttcctggacttcagcaagttccagaatttctgtgcatgtgagtttacccctgtgtaaagtgaagatgacaacagggctggctgttattctagggggctgccccggtgtacctggcacagtgcagtcctgctgattttcatattgctctcattgccatccacatccgagggagtaaattagcgggatccacaagccacggatgagccttgaaccagagaagccacaaactagcatttaggacttcctgaggctcaggtatgagcaatgctgcccaagtgcatggcatgaaacccactacagaccatcggaaacctcttgaggacaccattcctctctggtagcctttggggcatcattgaacattgggtcagcatgttagatacgatgaagttccagatccaaggacaagccctttagatgcctagtatatggctctgccctggcatttaacgcccaggagattatattaccctatcaagcttatagaaaatggacgcaggtacaatatatcttatctactgccacattgataaagtctacagagaaaatagtgggtcttttaggacttacccattgagccttttattttaagtgacacattctagtacggacttaattgtaattctgataacattacttgtaatactgtctccagtccttggaattaatttgactggaaaaaatccagaaggacttaaatgtttctcattaaaagcattatagataacttattagacattgtgactaattgtagtatggcccaatgtaaagccatcccaattaagatgctgtttcttctcttgtgattagttggcaaaccttttccatacaactgtgccctctagaatgtagatcaattaagcatatataattggacggaaccatttgctccccagttatcaccctctccagtgagatataccccagccgggttggtaggcttgtgaagacaaatgtcctgatctcactttagggagttgacaaatggatctctataaggcagcttatgtgctaaatatttctcctggccccattggcagagatgtagtctgttttcccagtacagagaatttcttgcagcctgtacattttccctttaaaagataaagagaaaccattatgcagtttttattcctgacctgcctcaaggagcagatacggactggaaagcagcccctgttggataattgctgcttgtctcagagtttgagattctgccggggtttcttgagtcaccgagcatatggggcttcaggttggactgcccactccagtgcctgagaatttactgggaagttttaataaagtagagcagaaattttccagctgcatccgaaatatttgatgtcatgctgaattgcaaatccctagtcggaacatttgaacatcatctagagggatcaggaaataacccaaaggtttggtaggcgacttagaacaatggctgctcttaagagggaacaatttagagcgatttctttcctcttccttctctccaccttccccactgatttctccttcacgcacctatgggtgtgaaatgagaaaaaaatatcacttgaaaccaaatcaaaagctacagcaattctggaattaataaaagctcacatgtagaaggaagtgtgggtttatgggtagggtgaccatgcactacccaggtttgctttacctgaaggcagcggggcacacgtactgaggactattgggtagaaggacagatggggctataattaggggatgagcttccaacagattctcggaatgagctaggcatttgcaatgttcagagtatatagactggcacgtaatttggggtagtcgggtatgaaacttatagacacatccatggatttccctttaataaatcgtctcttctagtagtcatttgtcatcaacgagcaattcagtaaaagttggaattgagcataatgttgcatatcatttcagaacatctggccctaatatgtagtaacagctgtttagtacctgagatataaacaaaacatttttcccatggctgtcactgttcctcctcctggaggtgcagtatcaccgaggcttctctgtatttcctatcatgggtaatagtaacaatatcaataacacaatgatgattatcatgtattgtttaactatgtgtcatacactatgtcaagcacttttcatatatgatcttggtaaatcctcatgccagcctttcgtgggtattagatggcgaggggaaagtcatcaagccagagactgactactttgaaaattgaatacaagtctgtgcagtgctacagctaacattctttaagtactaaaataaattgcttgtaaataaagtaaatgaaaaaagaacacaactgtgtaagtcacaaatgaagaaggcaacaaaagggaacccagaagggttttttattttttggtgtggtcttcctttgtttgggatgtaagacactgattttcctgctatattatagtatgtacactgttacgaggtggcagtgcagtaccttggtcatgtaagccaatcaacaagacttgttcttttcctgatgttcaagggagtaattccttaagcaaaatcacatttatacacatgtcttttcaaatttttaaccaaatatttcaaaatcagttgtttaagaaaacgattacacctataccttcaatatcaaagcagatcaatttttaaaacaaatttactaacctagtcttcagatacataggtttgtttttctcactaatcctttgtggtcactgaaagagcataggccaccccagtcttttgcccagatagtgatgaaaatgctgatcttcgtgaatccaactgaaattttaacttcgtgcccaagctgttctagaactcaatttatcagatccagatttggtattctaaagactagagtgttttactttctgggtgttctttgggcttcttttctattcatgaccctttggattataaaagaagagaaacaccatggggcagatatgtccaagaataaagaaaagagaaagttgcgcacctgagaagtgccccctgctggccagcatcatttctctgtgtctcactacagaaggaggtctttgtttatgaattctgccctccccctcttgccctgagactatcacctgctttggaaagaatggcatcatttccagaatgcccctaggggcattagcttctcttctacactctctctcttgcttttcaatatggaagttaacaacgcagtctttgaagctgggccgattggatttcaaattctaactcagtaacttcccaactgtgagtttgagcaaggtatacctcttaaggctcagtgttttaatctgtaaaacaggaataaaatagaaataataacaataactatctcatggggttattataagagtcaactgatataatgtatgcacaccattgagcagtgtgtcttcctcattattactccttgatagatagctagaattactgagcatccgacttagaagtctaattctctattttgattttattcctaaactcccatgtatgcaccaccaccttaaactcggtacatctatctaggccgtgatgacccctctactggcagctttagtccctccctaatcactgtatttctatcattgatattaatattcttgaaatcacccggattcgaaacgtccagtatcattcttggctcttccctccactcttctctgatcctttcgcaccatatcatcccctactgcttccccacacctctatctaggtgatcagtcaccaactcctattatttcctcctccatctgccttgtaaatcttaattccattctcctcactgattcactgttctccatagaattccttgtgactttcttggaggtggggatctcatgtttcctttaagaaaggaaatatatatgtgtacacacacacacacacacacacacacacacacatacacacacacacacaaaatatatatatttggagacagagcctcactgtgttgcccaggctggagtgcagtgacatgatcatgactcactgccacttctacctcctgggctcaaatcttccttctgcctcagcctcctgagcagctgggaccgcaggattgcgtgccaccatgtatggctaatttttataaagttttcttttttttttttttttttttgtagagatgatggggtcttcctgtgttgcccaggctggtctcgaactcctgggctcaagcaatctttccaccttggccttacagaatgctgggattataggcatcagtcactgtgcccagccccaggaaacatgttttatttcttgtgcccccatcagtgttcgacgaagccccgggtaggaatttggtagatgcaggtgtttgattaatttccccttccttttgtttctcttctcagccgtgtgtctctttcctctgtcattcattcaaccattcattcattcattcaataaacacttactgaggttcacactcagtcaaggaactgagaacactaatgccattactagttctctctagaaactcactagcaggaaataaaagtatccccaaggagaaagccttgggaattaaaattttttgcacaacaaacgtttattgagcactgactgtggcactttgctttttagtgatgaacaagatggacacaaccccagccctggtggagcttaaaacctcacaggtattagatgagcatgagataaataattctacgagccatgaaagtcatgaaagggagaatgcaacagcacaacaaaaaggttttcatttctgagatggcgagagcctccctaaagaaatcatatttaaacctatgttgagaaatcgagtatagtttagttaaacctgtatatgttgagggcaggaggcagagtgttcacattagagtgggcagagaatgattgctccacaactttacaggcatgggttcttgacatatgcatacaagctcatccatgtggaagtgttagcaacagaggcaactgtatgggcagcaactccaggtcctcaaaaactgagaaaactaaaattctatccaggtccggcaatgtgtgctttctgcatctttagtatgtgagttggtttagtttgttaattaagcctatggaacaaaagtgttctttctcctccagactttcaaaggatgtactctagggctcgaagaaggggaacagagctgattatgttggtcctgttgtttgtgtttttcttcccatttaagaacgtacatttgaaggtgcagtcttgaaattcttgatatggatggcagacacttgtaatgagagaggaattagcagaaaatcacacctcatttcaataaatcttcaccccttaaggcagcctggtgcccttcctgcattggcctatggaagtcaccatctggactgggaggattgatgacttcagtttcacccctttctaaatagtgtttatgaagatccctttcttcaggtcagactagagattgtacctacaaataatattgtaattggaccacttagttttcatctttgatttgaggtatttgaaatgaatgtgagattaaagcaaatgaaggggcatgagaagtgttagcaatcctccagacagggaaaatttcttttcattctgtctccatgatatcaaactgaaatcctcagttaaccacagcaggggcaagtgcctgagttgaaaatgtcttcatccttgtattcttaattcatcacctgagaagtccttggatcaggtacgtgaaaccagaagagagatctccctggggatttcatagatggtggatatttaaatatgcaaaacattattgagaaatatgagatgtgtcagccatctcctgtgctaacattttttccaagtcaattactttgtggatgtttgaggtgggggcacactggaaagaaagaaagaaagacaggaggaactaaattatttataattatggtatgtgttggcgggacgggggctgccttctgagacacaaatggatgacaaagaataagttatctctttatagatagaatgtggcaataattgcattgtctctggattcaaaaagtcataatctattaatttgatggatatcaaaaagctataatctgtcaatcaggtgtcagaagaaagagtctctcaaagctttgaagcatggcatttagaatacccctggatacctttatttctattctaatattaataggaaggaaggatacaaacatttttggcatagttagggaatggatatcattttagctgtcttaataattttgcaacttaaaaatcgtattggataagggtgccgtattgaaaaaaatgtgtaaaagacacactacagtgaattagagggagataatttcatcctaagatttctctgacattaggcattgtggcatcgctttcttggtttaaatgtgaaatagaacctgagattatttttcataaatttatctagcccatctattatttctctatattatatggctgtatacttgaaacataccaatggggactgaagaaaatgcttaagtctataaatggaatgtcaaactgatggaaggaggaaattggagatgtcacacacagtaaaaacacagcttttccaggacccagtaagcttgccattaccaaggaattaaggtattctcctctggtaggaaaagaatttgactccttggcccagcacagtttcaaagctgcatgaagtcacgtttgcctcattacaattcctttggttaaagatgcttttctaagtacttcagaaaatgtatgcaaaaatattttttggtgcggaggccaccaaacctgctggactcacgttcctgcttttggcaagcaaagcaaaagaaccttctgggttcccttcctgcctttcctactgagatcaagctgaaggtggaatttttctatatatccagtccagcctttgtgacctctgcctttaacacaaacaccttgtttaaaaagtagacttgagggagggcacttgagttcagaagccaaaagaaatgggtattgctctttccgcgctaagcagttctgaacctagaccatatccttgggagaccagagcagctgtaagcagcaaactgcctcttttctgcctccctgtgaacctgcttccctggagggtatgctcaaactcaattccctgttttattgttcaaaggacagggaagaaaggagggagaaaagattgattaagcccccagtctgtgcctggcaacattctaggtgctttgtatctgaaaatctattttattttcacaatgatctcatccatgtccatggattcaactttatctacctgaccaccaataattcatatatttggtctttcggtttagtcatcttggtgctccagagctgtatacccactgcctacttgacattcttcttacatgtctcaaaggcaccttggattccacgttttccaatttagtgtgtgatcttccctcctaaactcaaggctttctagtgttccctacctcattctgtggcaccattctccatccagtttttcccctttctcacagtcaattaaaattctgttgattttgtctgctaaatatctcagcaagaatccatccagttctctccctctccattgccagtatcctaatctgagctaccatcatttctttttttttttttttttttttgccttgaatatcaatctggccccccagatggtcataccacaatcactcttaccttcttccaatctttctcttctccccaaccagaatgattctttgaaagcttcagtatgatgcatatgacgatgtcattcatttgatcaaaatccttcagtggcctgccgttggttttttttatgaaatataaaacaaaacctcggacatgagctataagaccttgcatgagatgcactttctgagaccagcccctccattctcctttcatgccactctacactttcaactccagccaccccagtccttgttaagttgctgagactatcatgcacaaaggtatttacacagttttgttttgggtttctttgttttttgttttgttttgttttgttttgtttttttcaacggagtctcactctgtcaccaggctagagtgcagtggcgcaagctcagctcgctgcaacctccgcctcccaggttcaagcgattctcctgcctcagcctctcaagtagctgggactacaggcacctgccaccacagccagctaatttttgtatttttagtagagacggggtttcgccatgttggccaggatgatcttgatctcttgacctcatgatccaccctccttggcctcccaaagtggtggaattataggagtgagccactgcgcctggcctacacagtttttatgcatattgctctctgtacggagaaaggtaatgcagactcattcatcctttgtatttcaggtctattgccacttctttgggaaacatcacccctcagtctagatctgatacccctcttattccctcttctgttttatacctcttcttcctagcccaggtgtttacaattcccatttatttatggggaatatgtgattattgtattttccctactgagattcaaagctatacaaaggaaaggactcttctgcctttttttttttttttttggtttttaactcattatgaaatccccactgctgagcacaatgctgaacacctttgaagtaattaataaataacgactaaattactgctgtgtagataaggcagataggattaggttctttcaacagtgaggaaatcagagctcattctaacttaagggtttagaagtatcagaggcaggactctgacccgggtctccagactcacaaaacacaatacactataaggtgtacaatagcactgacagatattttttaaaggttcctctcatctcactatactaacacaaatgttttcagttctacaatctacatttccccctccaatttttctcctcttttttgactgccttgatggtttcagtgggtcctggttaagcctgtctttaagtttctaatcaaactaatccaagtgaatttggcttctgaccttgctctcacatatttgccatctctaaatgattgatgtctgcttgatccctgttggaaaagcgtctgaagatatgatccagaaaatctatagttgcaaatctagcataattttaatgaatcgtggtcagaatagtaagaagcattgcacagaaggcttgcataaaaaatatgcatcttctgtcatcttcaccctctacactggcctcccaagtccccatggaaggtatctagtacgggaaactttcttttcctgtaagaatgttgtggccaaacatgctgtgtattggatggatggatgggaggatgatttatattttcatctcggtatagttcataggtctaggatcagaaataaactagaataaatataaatattgcttttcttaacgttggtttaaaatgcaaatgcatggcatacagaaaaaactttttttttttttttagctctgaaagctcaatttttactacatgatttccctagtagaagtactttttgcagggtataagaattttctgtttgcttatctgttttcagtctagaatgttcacttcttaagggcaaggaataggttatgtttaccttcttatctctggagacttgtataatcctagctggtcctaagtactcaaaagttttcttgaatgaaacaaagccttctccggatgaggaagcttgtcagaagcttgagtgactggtaaggagggtgaatctctgctgctgatttactaagaaatatttggatctttccttgaagctaagggtatatacctacttctgtgcaaaacaggtggcatggctggcccttgaagagtacacagtttaaggagacagtaatgggtacagttatcttcttaaagatctgggccactttgttcctgaaaaagtgtgggaagtttctctcttaggcagtctatctcttagagcccagtactcacagcaaaatatttataaaagaaaacaactctttcatcatccctgacatagcctgccctcagcctagaaagaaaaggccaataattgggactgtgtggttccaggagataggacagaaggatagggccaattcaacaggtaagaaagacagcacactcaagggagcagactccagttgatcaccgctgtgggcagctgaggcacactcctcccaagacagctatagaaagtgcctcagaaatgtctgtctctaggacacggttcccattatccatgggtcaaagcttgcccgaggaacgccagctcctttgcattcccaaactttgcaagcatgtgtcatcctgcaggttctcttgggtattccattgtaaggagtctgagaagctccaaggaagaatgcagaaatacggggtatagctgaggccaggtgctgtctgatcatatacctgggaagctgttgttgatcacgtacctgggaagctgtctgatcacatacctgggaacctggttgttatatccatggctggggagcagggtagcagggagcaagaactgtccaacataatctagtttacctatggactttcaaaggtttgcaaagatttacctcctactaaaatggcttgtgagcatggaaggcttaaacattagcagagcaggtagaaaaataacgcctggtaagatgccaaatggtggaaaccgaggcagaagatagtcctctggacaaggtcagcataatctagtacatatgaactcactcacgctcctgcatcagactcccctggttttggaatctgtctctgttgcttcccagtggaacctgagaacattgtttaatcagccttggttatgtattcgtcgtcagataaatagggacgttaataccaacctcatactgtttagattttggatcatttacaatgagaatgtgttcatctgttacctgtgtaactgaacataataatactatgtttgaacagatttcaaaaatgggtttggatctgattttaaaacatttgaaacagatgtggaacaagtttttaaagaaggaaccctatctcataagattgtcaggatcattaaacatcacgagtatgagcccacaggaaaccttcagtatatcgtgatcttcttgacggtggtgaagaaggacaaggaagaccaccaccataacacacgggtcttctttggaatggaggttccaggatctatggggaatttgcttgtccctatccactctcatccctccactggggaagagagagttggtgccagtcttccagcgtaggtcattgttggctcagcatctgggaagaatctgggcctgcaggaaggactcctggacagtgccatgagcagctgataaagaccaagagaggggaatgtggggcctggtctaatgagagttactgccataactggcatttactgagcacatcctacatgtgactctgttctaagtactttctgcatgtcgtgtgttagacatcaagagtcgaggcaccctcattcacattctacacatcatgaaactgagacttgtagaggttaggtagtttggccctcatcacagtgccaggaggtgcgggtgtaagatttgaacccaggaagtgtgattcttgtagcaattgctgtgtggttgagatctggtctgggaagtggggctaacacagaagtgtggataggacagattatttctgcgctccaaagttatgaatatatatactccaaaatatgcttcagtgactgagtgagacataaatgggttactctgtcagtgatcattatattactccccatccctgcatgcatgttagaaaggcacacacaagctggaataatatgaatgacatttaatagactacttacaaaaatgttggaagatctggggaaaactaacgaaggaactttccgtacttgaggcctatcaatagcaggaagttattactacctctaggcctgaaagggcaaggagaagggggccaatggaaccaggagatagaaggctggtggagaggaccgcctaacctgggtggtggccataaagcgagggagctggagagaaaaagacaccttaaactcacttgctcagtagctcccatgagccaaatctagtggaaagccagagaagaaagtgagaagagaagggagcccataaagaagacaggactgcctacaaaggccagtgtctcagagcacaaatgaggatgcagatgagagcaggtctgttctggcatggcaaaggggcttgcccagcactatcagcaatctgcaaaaagatattcttgggaagactctggtgtctgaaagattaaagggaaaatgcatccacgtgataaaatattattcagccagaagaaggaatgaagtactcttacatgcaataacagggatgaaccttgaaaacctgatgccggtggcaacgaccccataccgtgtggttccatttagatgaaatgtccagaataggcaattccatggacacagacagtagattcgtgattgccaggggcgtggaggaggagggaatgggaagtggctgctactgggtacaggatttccatttggggaggtggaaacgttgtgaagctagatagtggtgatggttgcacagcattgatagtgttccagatgtcattaatggccaattttatgttatgtttgttttctgacaattaaataagcaaatacataaatgagaaagaatttttctctcataatgtttgtttgcctcttactcattttctgagctagtcaccaaaacgtatctgacactttcttgcttaacctggcgggagtggtagcggatgctcctggtgcccccgttgcattccctcacctttctgccagctcagcttccagtagccagcgcctgcctgtgtttctctgcctgagggctctctccggctgccaaagcccgtgtccacgcacagcagtaccagagaattaccaggtcccaggagcagcactcgggtgaggactgacatgcgtcaatgtgtaaacaccaacttccctgcactccaggtggggtccagagctcagtgcgtcttgctggctcccagaggccccagcccggttgagctccagttgcctgcagcagttcccaggcttagtgcacttgactgtgctgccacctctcctttcatttcccctcttccctcctggtttctccttcaccttccaaatcaggtggggctctcaagcccttggctcaggatttataataactacggagtaataatagataacatgtattgaatttttattgttaaaatgtgtatgagaagacactggcttgtgttcattttgcctctcttgttcccaatgataagactgccttcacgcatcaggcaaataactataattggttcctggacattagcataaacagaatcccctagggaaagtgctaaaagtgcagattcccaggccccacccatcaacatgctgattccatctgtctaggtgtgagccttggaatctgcatttatcaagcttttctggttcttctaatgcagaatagagtagaaagttttcattgaaaaacactggacactggcatgatgagaaacagaggagaggccacctattggaggcaggcactggcatctggtcagtatttcaacaaatgtggtccctcaagttctgcagggagaaatactccattacatgtatacatttactttctcttaaactgatgggatccatatccaagtatgaaagttaatttcggtatttaataatcattaagtaaagagagagtgaaatatctacactatgtaattacataaaacatgcttctggcaatatttgccccctaggaaattcaaataggaagtctccaaggagcaaggttgtattcttggaggtggacacaaagtaattgagctttgctaatggagataattaattaggaaacggatgtgcttgcttctgagaaaaatattggaaagatcttctgagaaggcctagccctctgctcttgtaattttccgaagtctgtgccaccctgaggactggtgcttcccctgagccatgacccagccacagttaggaattaagggagcagaaaacacacagccattgcccacagttcaggctggtcctaagaatgcctgggccctaggaacacactatctccaggaagcagctctgaattagacctcgggttcaagttccagcccccacttatcagctttctgaacttagccaagttattcagtttccatggagcttagtgttctcagcttaaaactaggggttgtaatagcagaaacagtcatcagtatccagtgaaacaatgctctgcaggaaaataagtcgtagatcagaagatgtcgccctggtgtggtcttactaaaccttccctgtctcagcccggggtcttgtttattgcatctgggttacctgtttgcccctttctgtccaggtttgatctgcaggaacctagccttctggtctaacctttctagcttgtctgcttatcaccccaacctccccgctttctggttccagatgctagcctgttcttgccttgtatatctgacttgctgagctcactcttggtgctgcaaagtggccatgccatgaatcttccatagcccgatgcaatgtcaccccagtgacacggaaggatggccgtatggtgagagactgcattcagaccactgagccttctcttccctaattatatcatgccagaaacagctagaccaaggagtcaagcacacaaatatagttggaccagaaggaccagcagctctcaaggggtaagagaataaggaatcatgtgagcattcatggattgaggaatgcatccattattcaagcaagttgatagagataattaattaggaaatggttgtcttactgtcctattcaccaagctatccacaccatctagctcagtccatactttcttaatgagggagaaaatgagactcaagccaagaaggcaaagacttgatgtggatgatattttttctatttttgctttctggtgatggtagacattatattacatattattaggttaaggtaccgatggttttgttttctgtgttgataaaaattgtgcgctttttattcttttacagaactaataaaaacatgacacattaacctttgacttgtctagtctcctcttttattaaatctgctctaagcagttggatggggagtgccttttcgcctgtctaccccttcccaaggactatttatattgaggcaaccaaatgatcaaggaagaattcgtgaatagccatgatcaaagtaaccagacagggagttagaggttcaatcgtatttggggaaaatggtccaatgatggggaaagggcccaggttttgacacctgaagacatccctggatttcaggaatttgaggcagatccctagagctcagatctaggattcagaacgaaacggtgactgtgagagtaaaccatggtgtctgacataagggtttccttgattaccctttaagggcccctatgaatgtctctgggtcatcagtcccttagataacatcatgtgtctacagctgggatagcaagtaggttttgttttgtgggtcaactcacatgaagaggatgcctagatgtctgcggtgagcaagattctagagctcatcaggaaagtatgctgtagtcaattagtgatgtctgccatgtgcacgggtagagaagttatgtcatgcataccacagactcaccatctcagcttaatagaccatgaagtcaggatctggggagctaccttaatgtatgaggactgtttccaaaatatttctgaaaactattgatactagatcctacctggagtctctactggttccatagcatggaactgtttacaattgcttttgatcctttttccaaatgattgagtgctttggcataaacaggtcaggtacagaaagcacggcatttgagaattatcctctgcaaacatgacttgcaggcatagcctgagcccactcagagcccatacccaagttgtgctttcttaaggccacagcctccttctgagagctgaggaagataagggtggaggacaaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggcaaggcctttctgggagaaatgatccaatgaggggaaaaaatacttcagttttgttgagagatgatcttaatctgtttgagctgctatataaaaaaataccatagactaggtggcttaaaaacaatgaatgctcatttcacagttctggaggctgggatgttcaagatcaaagcgccaacagatttagtgtctggtgaggtcccgctttcctcatccatggtgccatctagccgtgtcctcacttggcagaatggatgagggatctggatggagcctcttttataagggtactaatcccattcataatggctcatcctcatgacctaatcacctcccaaaggccctgcctcctaacactatcaccttgggggttagacatttaacatatggatgttggggggaataaatctttagcctgtagcaaagataatgagatcaggtgtaggtgattaagtgacatctggagaaagaattattagctgctaagaaagatgtgtttgtgcctgtgtgtgtgcacttgcacatgtgtggatgtgtgtgtgtgcatgtgctctgtgtgtgtgctttgtacacaaggcagagtttgcagtctgtgagggggccagcaggtgttcaaccccgcctggctcaggcagctttcgcttcagttggcttttatctcttcctatgtgccctcagccctgtgtcccagggagaggtttaaccaagtctagaatgttccactctgcttagatgccacttcagaggtcttaaaacagaacctttgttttaagcagagacagtcctctttttgatacgtggttttcaggtgctccctttaggaatggccgccacccacatatcatggttcctctagtggttaaatcatgatgaataggcacagagagctgataattaaggtaggaaagagtaccatatttctcttctgcattatccctagtgaattacaattttttctcccaactgcaagtagaaatgataatcacccttagctccacttccacacccttctcagaaatttgggtaatgcatcctcatcttaattatcaaaatacagggttatcatttgcagagaacatgtgttttgtgtttgtggggtctggagagagtgatcatacaatttctaattcaaagcagaatactcttgaaagtaaatcaggactttcctgttgaaactagaacaggaagtcaccttagcagtggtagatctttgaattcgtctcctcctggttctgcggagagccatgagagactagaacacaatcaccagttaggatcaatacacttataaatgcagagggtcttagcatccatttgggtgccagcttcccttgtgtgattggttactggtgtcaacggagattgtatgggagaggaactaaagaatgcaggctcggcttttcccagaggcagcagtgcgatgcatgggtcacagaatatgccagagaacaacgaggccagtcgctcactgactatggaagatgagtccattatttaatcactctggccttcggtttttcagctctaaaaatgagaatattcctttcctcaatgattattgttatgattcccggagataacgtgcatgaaagattttagtgcaggcctttcttccttccgttgacaacccagaatgttgcttgatgcacaggggaaatagagtgatcaagaagagcctttataaatgagagttgatgttgagtaatcattttgggtattatcaatacccatggccataacacccccaccatgtggaacaacacagggaacacgacttcttactcaagctacaacaggagaattcttccttggatctctcttacacagacaacattgtctgtttttcatcaaaatgctagaaatgagagctcaacatttgtaagctcttgcttcgttcaataaagattgtgtatgggaaatccactgcttctctcccttcgtagatgtaggaatctgcctcagacattgtacaaatgggcagagaggggaatggaactgagtcttacccattacgtttaggatttcagggctgcaggtcatctgtttacctaagatggagaggccaagtcctctctcatggtagctttgaagctggtgtcagggaaaggtcagtgcctgtgaacagtgatggaaggtgtgtaaaggaggaggcagggtttagcacaaggggtaactaaatcttaacttctgggatactgggtggtggtggggttactatttccaatttatagcaagatgtaagtgatatcagctggaggacaactttactggtctatgtgggtgtattagtcggttctcaagctgctaataaagacatacctgaggcagggtagttaataaaggcaagtggtttaatggacttacagttccacatggctggggaggcctcacaatcatggcagaaggtgaaggaggagcaaagtcacatcttgcatggtgacaggcaagagagagcatgtgcaggggaactcccatgtataaaaccatcagatgtcgtgagacttattcactatcacaagaacagcatgggaaaaccctgcccccgagattcagttacctcccacccacttcctcccatgacatgtggggattattacaattcaagatgaaatgtggctggggacacagagccaagccatatcagtgggatagatatcatttggaatatggttgccttccattctgatctcattctatcaaagttggtagatcctaacatggtgacccagcaagagtctcttttcaaactggctgtcctcgggggtaggagcagagccagggcaaaccgtcagggatgctaagtaaggagcttcaaggggatccaaggcacctccttggactcagacatgcttgggaccgcgttcgtaggacaacttttactgtccattgccacaatgaaacatggcagtgacagatgtaggccctcagtgatcacagatctatatggcagcaatggttcaagtgcagaaatgacaacagtgtttgtgattttacctttttgtgaagctgggttactggggtttctgtcctggaatctctaaacaagtaaccacagggtagttgcttggctcttgcctcaagtgaaccagccaagagatctcgtccaacactggtatagcctggcagcaactgctacttccaggctgtgtctcgaatgccctgctgggctccatgtgtatctgggaacatggtttctgatctacaaatctaagcccctaaatacacaaaagcgctaaggcaaaccatatgccttaggctcacttttaaacctctctgagcttcagcttcctcagctgtaaaaagaagccatgatcacaggcatgtttatgcactaaatcaaataatgaagctcacaagttcagccctggtcatcaccattcaagactctgaagtctatcaaagcagaattcatgttctctggttgcattttccatcaatggagactcagaaatatttattgaataaaacatcaactatgacaacatattttacagtgtaatagtgaaaacatcattcatctgatgacatgcttcttttgaaccattttgggatggttctgatattgtttgtaacaagaaataaagatccgaggatgatcaagtgagcattcaattattcttaccttcatttaaaaaatatattttcaatattaaggaatttgttgttattgttatttacaaagcaataaaataaggtaagaaaaatggagaggcctgggttggtgatttggtcaccaggcagattgagaatggaaagaaaagggaacagggtaaccatgtgaccaatttgcttcttggaaaagggaccaaataggacccagagaggggcttggtcaggcttcctggtcactgccagtgctgagacattaaagatccaggccccacggagaaccagggcacctggactttgatcttgccataatggtatgcctccatttaagaactaggtcagctgtctttcacaccagctgtgttcttcatgcttagggcaataacatgtataaagtaatgggtatttttctagtagggttaacacacttactcaggtttattcttctaacttgcctgcatccaaacatttttttttttttttcaagataaaaccagcctgtcaaactgtgcagttgacattacttggtaggatgcagaaaatatctgaattagaaatgggcccatacaggttccagtgggaatggctttctcagcaggtatgaatcactgctattaaaaatgtattccgtaggtaaattgttagttatcatattcatccactcttacagaaagccaatgttatcatttgggtccattattaagactatcattatcatagtcagtttagtaacctccttttacataacattggattttttgtgggttttcaagtctcttccaaactgaatctcacaatctaggtttatttttgaggccaccttgcctgaaggctcgaggatgacaggagtgacttccgtcactgccatatttcttctacacttgaagattgttttctgggatgttgctgcaaatggcaaatgtgtttgatgccctaatgtttaacataaatcaggatcatggatgtgcatagccccctcccgtttctgtaaagtattgtaaagggactcctgtcctcagagtgccaggcctcacatttacattctggacaaactgggctgtctgcttgaaagggcagataccacaggttggagcaaacatagcttctgaagaagatgtaatgcatttctgtcccagtaagttgtgcctgattaagatcttctcatagctgggggcagtggctcacgcctataatcccagcacttttggaggccaaggtgggctgatcacttgaggtcaggagttcgacaccagcctgaccaacatggtgaaacgccatctctactaaaaaaaaaaaaaaaaaaaaaaaaaaaaaaaaaaaattagccaggcatggtgttgcatgcctgtaatctcagctacttgggaggctgaggcaggagaattgcttgaacctgggaggcagaggttgcagtgagccaagattgtgctattgcactccagcctgggcaacaagaaactctgtctcaaaaaaaaaaaaaaaaaaaaaatcttctcatgaccccgggtgggtggctggggtggggttggtggagggaaataaatatgaagaagaatggtgagacaaccagtgggcatatactgtgtagactaccagaaagctttggaaatgtgtcaaccctaaagcattgctatttttaaatatttagttgtattttaatatttagctataaatgaagaacttggcttggacacaaaaataacaaaaaattaatatctaagagtcatgttctctgtggaataatcttagggctggtctgtctttacacatttattgatgatccagaagaggaagcacacaagtttgtagattagcctaagctattctggatagaaaatacacagggccctagcacagcctcgtgggcagaagagttcatctcgtgagaatgagcaaagagacacttaagaaaaaaatctgatgcccaaagcctttcatataggtgaccattgtacccacagtaatgaagcagaactactgtgctctggaagccactatgcccaccgttgttcatgaataaaagaaacatggtagatatccttatgcatgtgtgcacatgcagcacacctggcctggcacaacctgctcacacctctgggagtcacctgggtgttggctgacgcagcctggcctcggctgagctgactgtcaaccccgcaactgcctgtcccatcatggaccagaagcagagccagggatgaggatgaacgctctagttgcctgtggcagataaagaatcagtcatctagctgggaaggtaaaggttgagaggaaagccagccaatgtctataaagacacataggaaatgggagaatagagccagtgagggacatgcagagaaacacctagattttggattcatttacacattcagcaaatatttattgggcatctatggtgtaccaggcgctgcactggactcagagatataacaatcagccaaatgaacaagtctggaccttcagggaccctcgtggaggtgttacctacaagtgaggaaaggaagaccaaagtgtttgttagttagttactatgcatcaggtactgtgcacctcagaggccacctgcagtcagtctccctatatgccaatggctgccagcatcttcctgctttggggaattctcagcagccagtagcagcttgcatagcctgagcatgtggcaggtgggacttgatgcaaaatccatacccaggaaaaatcttcaagctataggggtgaaagttggtgaatgggtgtcccagcctccctgccctttggtgggacaattctgaggcctgtgccattaacttcggcagtaccttactcattaatgcaccctttactgacattttctccttctctgtctcacttactacttggggagattgtcttccaaataaactacctgtatccaggtccttcttatagatccactctggggaaaggcaagcaaagaaaatacattataagcctgttgtactattagggatggtgacttccagaagctgactgtgataacctttcctcgggcttcagaagaggctaatggagagttgaagggagaaatcaggaaagatggtctcccctcaatattctgacatgggttaataaggaggcactggttcttaaattgggatctcgatgatgctggactagcagcagcaatatcacctgagaacttgctggaaatgcaaaccctcaggctttaccgagacctcatgaatcagaaaagctgccagcaacctgtattttcacaaggcattcaggagattctgatatatgctgacagttaggaaacactcatgtaaagcatgtctatcttcccttcaattatgtttttcataatctgcaaatagttctgtcacttttaggggatatggctggacaatgaattatctgtggcttcattagaaaagtacatgaattatattgtggacagcaaagttatactgaagtgctgaagggaagtcaaatgcttaggagtgtaagctgcaggaagaaataggcagagaagctgggatagtttacccagcatggtaacttctatgttattaggctcaaatgttcacactctgcctttgaaataagtcattagaaactatattagtctgttctcaccctgcttagtaaagacatacccgaggctgggaaatttataaaggaaagaggattaattgactcacagttctgtatggtagcggaggcttcacaatcatggtggaaggcgaaagaggagcaaagtcatgttttgcatggctgcaggcaagagagcatgtgtagggaaactctcctttataaaaccatcagatctcatgagatgtattcactaccatgagaatgacatgggaaagagccacccccatgattaatttacctctctcttgttccttccatgacatgtgagaattatgggagctacaattcaagatgagatttgaatgggagcccagccagaccacatcagaaaccttctgagaggatgccttgaataggtgatatggcagtgtggtccttagcaatcagaggagagagaacgtgggttctctgtgaatgaaatttatattcctagtttccgtggagctgtgtgcatgaaaaacctaggttctcagtagctgggaggagacctgcacaggcatttttagtatatgtggtaggcagcttctaagtgaccccggtgatcctcacttcctggtcttcacggcctcaggtaatcctcttcccttgaggaactggcttctagccaatagagtacctcaacattgagggaggtgtcttctgtgatcgttttacaaaagattttgccttccaccttgttagattctctctcttgctggctttgataaagcaagttgtcattgttgaggagggccatgtagcaaggagctgggggtggcctcctaccaagacctcaccagaaactaggagtctcagtataatagcctcaaaggaaatgaatctgccagttatcatgccatggactttgagatgagaccccagacctggatgatcctttgaagccttttgaagcaccttgaagcagagaagatagctaaggcatgccctgtttcctgacccagttaacccatggttgaataagtacctctttattttaagcttcttagtttgtggcaagataactaacacatacatgaaagtctaggcttgggtatcatcaaaggacctgctagcagaattcttgtacatgaaaacacagttgtgcaggacatatctgtgcacctctttgctgaaagcaacatcctcaggaagaccacttcccagcttgcgacctaaacatttaggtctaaacacttgagctctaaacatttagttactcgctctcccctgtattaatgtatgctgcataaaggacccccattttcctacattaaaccctgtataagaacctccaagtagacacttatgcaaacatgccaagatgcaggaccacatccaaatgataagttgctgtcagtgaatcattaatgagcactgctgtgcaccctgccacatgttaaaaggtaaaattacattctgatgtttatttgagctattgcctattgccacttgaggcatatttcatggaatgataggagtagagcaaggtatttattttgcattattgacccaaggtgccatcagagtcatgaggtccccattaaaattccagtgaactcttagattctgccattcctagaaaatcttataacattcttggttcaaacttctcatctgtgatttaatgggatacactaaggtacagtgaaggcctggattaaaatgatgtcatttatttgctgcgtacatggtcctgggcaagtaattgaaacaaactctgaacttcaatgtccacatctggattaaaataaaaataaaacatatacttaaacactatgatcataaaaaattcagtgcctggcacttagtaggtactcaataattctgtctccccagttaatttattcacttgcatatagagctatttatgcagaaaagtttatgtgacaactaccagatatggatacttttatagaagagtatccataggaaatggctcagccttctgtcctgcaataaaaagtaatgtttgactccaagtacatgagattgaacagagttatttgagctacttttgataaaatgtgacaggcagactttggtatttcaccaccccaacatttttttatggactgctcactatcactgcaacattcagcacttttttctgtgtcaatgtgatagacaatattcatattcttcttgggtaattgcctttttagctgaatcaatggcttgcaggcatgagaaggaggctgttttatctcaactttatttatcttatgattatactaagactataaaactgaatctcccctccttcccttcctcccaggcccattcccaatcatcttctaaaacctctgttaatactcagcttttttggtgaattttcccactgccatgcttcatgttaccaaaatatttcccttttctgacaacattccaaatataaataaggacctactgaatgaatgaaccaccagtatgattcacccaatcactcattcaaaaaatattctttgaggatttactgtgggcagaccctggagatataagagggagggaggaggatgactatgcctacttgtaaagtggacagctgtggtctcttctagaaaggaggagtgcctataaaggaggcgccttgggtattcttactgagcataacagatggaactgaggagtcaaggagggaagccttctctgattatatgaccatggagctaagatttgaaggaaaacacataatggtgcatgtgtgtggggagggtggagacaggaggcagtggaggagctaagtatcccaaggtggaggaggcagcgtgggcaaagtcctgtcggctggaggaagggcatgttcttggtaccagaagcagctcagtggaaaggatcctgaagcggaggctggtgggccgagtccagaccctgggggccttgtcaacctagctgctttgtgcctggggcaatgaggaggctgtgaagcatcaacagggagatacagtatttagagtatctcaaagtctccctctgtgtggtgtttggatctttctgaatcctcagatgtaatataaattatttgaaagcaaataccaatttgcttctaattctggatctcttactcaggacttggttgcccagaggaggtttaataaattctttttaactctacttcccaccaatttttctcccttcgatctgttcctatatctctaccattcatggcagggttagcacgtggctccaatggtgagcaggaaggacttcacctcttgtctgtcccttagctttggtgtgtgctgctcctaacgtagctttggagttggagttaagaaccatctcatggcattgttgggttaggtattctctgggtccactcaagcttcctatcagttttttagggacagaaagctactgtgctgacctcagtcaaagcccctatctgaattcttgaaagagacatgattgttaggtcactaattgattctccatagtgttagaacagcaggagatttgaacacaagggcatggtgctataccatgcagcctggtagagttgagctgaataacttttaggtttgtaagacagcacatttaatttttaacagattatgtacaagatattgagtgacattaaacacagagttaaatcaaccataacccatttaaagcagccttgcagataaatgtctcaaatctactagcctgccaaatgtattccttatctacacacatttatcaatttttccacaacactaagcctttctaatgtttctctgacagttactttctctcccaagcctgaaattcgggtgacatctactttctgtaaactagatgtgcttgaccagggaaagcccctagatttgtgttaatcttttggggccactgacccttctgggactctgatgaaatctttagtttgctgtctaagtaaaaaaagaggtgatataaacatacacagatttctttttgcataattctattgtgttgcttttgaaattgattttattcacgttatatattattcaaatacatctttactaaaaagtgtcactcactctatatattttatatataaatgaaagattactttctaacaaaaattagaaaaaacacagtcaatgtaagttaatcagaaagtaaaccttaattgtattcaaaagtaaaactcaatgggaacaccgttgttttgtaagagtaagaaattttggtagtcacaaggtctttgacatggcaacatgaatgacagctttgcagttaagttctgcacctttggttttgatggcagcaaatatgtaaaaaaaagtcattgattcaggtgatagaaacaaaatcagaatgcccatagctcatgttgcaacgaaggctgtaacaggaaagcaggccctacatgactcttatcatttcatttatgtcccatgatttcttcaactcagttaggtcaactgtggtggtttcagtgggatgctatctatgtatgttaattatctattgttgcattagaaattttccccaaatttagtggcttacaagcaagtattattacagaaacattgcaatgaggtacttgtagttcagagtctttcacgatactgttgtcaagatgttggttgaaataggagtcatctgcaggcttgactggggctggaagatctgctttcaaagtggcaccctcacatggctggtggtaataggcctcagttccttaccacaataggctctgcataggactcttaaggtatttacacaaaatggcaagtggctttctcctgtgtgaaatatcccagagagaaaaccaaggaaggaaccagaacaccagttatgtcccaattttggatgtcatatattgttacttttaccatgctatatctattagaaatgcatactgagtccaggtccacactcagagggaagggaattaaactctatgtcctgaagggagaaagatcaaataatttgtggatatatttcaaaaccaccacactatgtcatcaaagaaggcgttgtatattcatgattcagttttaaggtggtttgggtaaagttaatagcacagttgatccatattcccaggtactggtgatttccatctgaagagaacaagatgaggctttgtcactctcaccccagactatcctccaacatcctttaatcacctttaagggggccaaggcatttcttttttcttttttttttttttttttttttttgagacagagtctcactctgtcactggggctggagtgcagtggcgtgatctcgactcactgcaacctctgcctccgggttcaagcaattcttctgcctcagcctcctgagtagctgggattacaggtgcccgccactatgcccagctaattttttgtgtttttagtagagacgggatttcaccatgtagaccaggctggtctcaaactcctgacctcatgatccacctgcctcggcctcctaaagtgctgggattacaggcgtgagccaccgcacctggctgggccgaggcattgtgtgtgtgtgtgtgtgtgtgtgtgtgtgtgtgtgtgtgtgtgtgtgtaagttttttcatgaattcaaaacatagccaaatggttttgaatatatagaatttatatttgcactgctgataatagcttgtaataaagctgtggaactatactgtttattgttgccccaacatgacagtgctggtgaggaggaaacaaagactggaggatgtaatctaccccatagatgagctccttgaggatatggctgcatgttaatgttccagcgcagtgattggcacataggggctataaagaagtatctgttgaatggatgaatgaatgaatgaatgaatgagtggagactcatggaatttaacttggacaggcaggttctaactgttgctgtaggcctaggaataccatgttcaaagtatggaagattggagcattggtaagaatgagctcttgaattctaaggcagtgctatctctagtctctttagtgttttctgccaggttggaagagtctttgcatgtcaagcatatgtttgccttcaaaaacaaaggtgaaagctggttgggattgcttgcttttagtgaagaccaaggcaaagaactctatctcctgggtactctctgtagatggtgggaaaaaggaagagaatgtatcaggtagcttttgctctgtgacagacaactacaaaaccttggtagtatattaacaagcagtgctcactgcccatgcatatgggctcagccatcagttaggtggctctgctgatcttagctgagcttgttcacgtatttgaggtgggctttgctccgtgactttcccatattgtagcagtgtagcttgggcatgtttttagagcattggaggaggcatgagagacaagctcaattctacaggtgattttcaagcctgttcagcaagcaatctactggccaaacatcccatggctgagcccattgtcaaagagggagggcactgaatagctccatggcacaggggggcgtgaagaatcggaacattttttacaatctattacaggaagccaaagaaatagctagtttttctctgtttaagaagggttcacacacattgcctttaaaaggacagatagtaaatattttagactttggggccacgtacaggccctgttctatattctttttttacttcttttccttttcttattatcctttttcttttaataatcctttaaaaatgtaaaaaaacagagatattcttagcttccaggctgtataaaaatagactgcatgccacatttggcccgtgagccgtagtttgttcatccctagtttaagaagaaaaaacatcttcatactaataataatatacaatattctgttggcaaaagacattttgatacttgtcatttaattgatcttcatagaagcctgattgttgaaggtggatatttctaatagctcccctttcatatggggagagatgggaacttatgtgatgaaactgggattcaggctgtagtagggccagggagggtcactgatgattacctgaggttgccctgccaaggacagctgcttgtgtcctctgcctctgagaactaagcttccaggaggaccaccggtagtagggagtgcattcagctccatcctcctgagaacatacactctgcaagtggagagaagccatctcattatgttaatttcaacccagcccagactgagaggaggctgatttcaagggcaaagaaggtgaggcagccgattcccaggtcccatttcccttgctccacttcattaacatggccacccttaatgcgtgtcataactctgccttccagcaagatttcctctccactaagaaccttttagaaatggtatttaagagaatgtgcataaaacaagtcttcatggtgattatgacatttctgctgaaccaaaatgtaatcagtacacacattttgcatccttacacttaatccacaaacatagcttttactgttttaccttctcccacccacaatccaaacagtgccacagaacaaacgtaacaggatattaagataatctcttttgtctatgccaaatgtcatttagctgttgagagaggaatgtcccatctagtttttacaaacaataaataatacagcttatgaaggtccacatgggtgacactgatgcaatgtttcaacagttttccgaaaaaggaaaataaaatgagtcatccaattagttggctgggcatttgcctgcaagttgccagagagctttgttgatttatcccaacttggctaagattggcttactctagaagttcgcctgttacagaagtttggtctttactagggtgacacaaagtatattttatggatattagttcatcaggatgctgagaagggttatagcatcaaagacaaatatggctgaacatattggggatcatttaggttaaagaaatttaaatgaatttttcctgcgggacttctcagaggctttaatctgtgaatgtgcatactgaatttccaagaagggtttagaatgtgcagcagtttccaaatctacttgacctgggaacccttttgttcacagggcatcccatgagagaacactttaaagaacagacgatgagaatcagtaccatgcgtaaaacgtgaccaacgttctatgcagaggagatttttgaaagtatccccaccagtgaagagttaccgtgtatgtgtataatgtacataagtggacattagcttgtattttcaaataataaagtcaaactttattattaaggaagatacaagaattagggctagtaagtgtgtgtgtgtgtgtgtgtgtgtgtctgtgtgtctttctatgtgtaaatgtccatccccagggattaagaagtctggatttgggttaaacttaatcatttctaagaatctcaggttttcagtcctgtcctagaatttcaaaaacagtcagagaaagcaactgtgagaagatcacagcttctcatcctgttttgagtctcaccctcctctttgccctcacaaaggatttcagtgattatgttcctgacaggatgcattttaattgttttctggtatgacttcccaatacatcaagttgtgttttctatatagccgctatcccaaatgattactattcagaacactaatctgatctctaaatctacaaagaaaaggccatgtaatttgcttctctttacagtgcattacgtgcaccattgtaagtgctggaacccgcccccccccccccccccccgccccgggcatctccaaactgctgtcctgtggatagccccagttgcatgtgctcaaaagcaaacttcttatctcctccatgagtcagttcctcttcctgtttttttctctcattgcagctaatgacattaccatcccctcaatgtccaaagttagaaacttctgagtaattttttatttctttctcttcctcaccttctactaatattagctgttaaatcctgttgatgctacctctgaaatatttctcaaatccacatctcctttcaaccttgggcatggccctagttcaaggtcctatttttcttagatggaccacggggtccttttgccatgatctctttttccatccaacttataatttttctacaactttgacttccatcctgattactaagacttttaacatttctgtgtgctccttcttctctgggtgtttgacatgcattgtcattctgtcttctgattgcaagtgatagaaacctactccagactagctttcagggaaaagaaaggaggtgtttagtagattgcacaactggcaaacctggagttgatttagctttcatgaaggctagaccttagacttgtcatcaggaatatgtcctatttgctttttctgtcagcagtccttcctttttttttggctgtgctctgtgatcacatgtctcattgtggtgataacgtggcttccagcagcaatcccagactcacagcccatcctcagcatttccagtggagagaagtgttctctcttcctaacactttccatacaaatcttagaaataaattttattggctcttaacatgtcacgtgcccatccttcaaccatttgctatgaacaaggggacaggatgctctgattagccaggacttagtcacctcccctcttctgaagacacagaagttgggacttcatctctacccagccacgtggacttagaatacaggatgggtgggtgcagtttccccgaggaaattggagggctgttcttggagcaaggacatgaataagcggcttacaaagagcaaataatcgttgcttatggcactcaaggtgttctgtcaccccatccaactcacctttcccacttggccttctgtccttgaatgcgaagaaccagagtcccctgctctaaatggctccttttctgtgtgtgctgcgtgtttgctctgctgctgagatccatgcttttcccttgcctgaaacaccctctgtggctgttgcagatgtgttcactctgtaaacgcagctcaaatgccttccaccccaaaaagcctccttaaacttgcccctgctcctctgtgtgaataattttcacagcacatgatctacacttccatcatggttcttgaaatacatgaaatacctaatcataggataggtttcatatgatcccacctcccctgctagacactgacagtgtgacagcagggcccctgtcttgttcgtctcagtgctccccagggcccacatgcagtaccttgtacacagtgcaggcaccataaatacctgttgattgattctggacttgccattcattaagagaagttaatggaggttttctgattcccatcagatgaacaattttggaatgttttatcagtcaaatttctaagaatcaataaaacttccatttggattattctttcccccactcaaattgtattttaaaaatagttttattgtaattgtccccctcaattctgacaatgtgtaagcattgcagaaaatttgtgaatataaaagtatgaagatgatcaaaagcttcttcctgactgatggccattgcatgtatgatttcctctgcctggaaccctgtggcccccagggttcagctccctggtgcctcatcaggcacagcttagtgtgagcttcacctttgtctctagatcttcctgtgcatttagatttttaaaaaatctggtgtatcccctcattggttggctatgaagtaagctccctgtgtgcagggacctttttttagcttggtgagggtgtatcctctccactgctggagctgtggtcagcacacagccagtgagtgctctacaaacacttacagcatcagttcatgaatgcttgcaaacatgcagaggttaccattgcttatacttttttttgttttgttccacttatataaaccacttatatattcagatatttgtgtatatatgcatatatatgtatttatgcacacataaacatactacacacactggatgtatactacacacacacacacacacacacacaatgttataaggtgtatgtaacacactcagggctgccccacagcctctcagtgccctacttatgttccgtccccccaccattccttctggcagcttctcactgtgaaccctgagatgttctgcctgagtgcttgttctagctgctggagcatggcaggccagaagttctggagaactcgtacccccaggatcagctctcaaccagggatgaatacagatggaggataaatttccccactcccttgcccctttggagatgtatttgacaccatttctcagagtctccagggagaatgagctccagtagcccacagtggtacctggactgataatgctttactggctttcttttcatatcactgcctcctggaaccacctcctaaataagctacttacattcgagaactaattccaataatacgctacttaagacaagggagaatggtagaaacaggtttctatacttcacaaaaatgagcttttgctcttcagaaatcacagccaatagattgtgccttctggctgccccctctgctaatgccccctctttgccccctgaacaagggcacccatgtacaacaatgtgtatatacttccttaggaagctggtcattcagagccccgtcagtgacacctgcactcagaatgtaatcctacccagcttcgggggctccaggaattcctgtggcatccgtgttatagactcctttgcattcagctttgcttttatctgtttccaatttgtgttttcaaggcttcggtttttctcctttctgcttcatctccagcccctcctttgcaacagtaccaaataaaaaaacccatgacactgccacagctgaaaaagcctttgaaaaaggcaggtggcgtggcttgaatgtttctaaactctaaaactgcaagccacagacaaataaagaaagaggtgggggtgggcatggggggttgtagtcttgtggaagcaatcctcagccttcagcaggctctaggggcacactgcctctagcatgttttgagcacgttgatttgggcatctgtcttgctgaatttgagtttgaattatggatgttacagaatgaatcattaaggctgtgtccacccggattgctctggctctctggcctgttcacagtgctgttcaattttatgtaagcattacttcaacatttttggtggatgttcttcatttattcattcattcagtatgcactgatggtgactctaagtcttgggactgcaaagatgtctgaggcccattctttactcctccacatctcaagacctaagggagatagacaggcaaatcaataaccacagtgccttgctattggtgctgtccaaggtgggtgctgtgaagaagtgcttaagggcaagtgctgcagaggcaggcacacctggggtccttttcctggcctggggggtccaggaaggtttcccagaggaagaagcagggctcagtcatcaagagctaaggatatgccgtcaaatagccctggcttattagaatctgctttgcactaagcctcctgaatacttaatttccccaagcctcagtttcctggtctgctaagtggccagaataatatttacatcgtggatttgtatgaaataaataggataatgcatgaaccatgcttagcgtgagccataacacgcaaaagcaacataatcagtatttgttaattgtaacaaatcaagcccgggatattgacagacacctaaggcagacttgggagacaatgtctcttgctgctgcctcatgaggaaggtgaatgaccatgcattgccactggacgggaaaataaacggtttcttctttttattcttgtagacaccagtgaggcctaccatatacctatgtcaaaacctgcaatttatcaaaaataaagcccgagatagtaacagtcttgctgaccacaaaggcaaaaggatccaggtaaacagattgcttccaggactattatttcatgatgagctttcaggtatatagcacatgagagggaggacaaggtgcggctgcacttcaagagaccacgttggacaggtgagatgtccaatatattcttacttaagatctgatttcttctccttctctccagcaagggatgcccagagatataacaattagaattcaatacgctaatacagtgtctcattagccaagccacacaatcgcctctagtggtccatatgcacgacaacccgggatcctagaaattagctcggcttcctgcatccgtccccatctgaatctttactcaactactttttgattgtgaagagccaagctcatttgagcagtaggaatttcatggggctggtgatcccaagactaattcaaaaattaataagtttcccattccttttcttatttatttttttggtagggacacatttcaccacacacgcctgcttctttcttgccagtatttcattcaaaactagtcctcaagttttgaaattttagagacttaaaaaaaatcaataatgctttaagaagattaagaggctgtgcttatgtcagccttagacaattctggagagaagatagacttgattgtgcttctcattttgtttatgatcctgcaatgtatcacgcattctctgccaagtgaattctgactgcatgaagaaggggtagatgcttttacaacaggtttagtcatctggcatattatttaatacaatcagtggtgttttccttcgtgagatgcagccttatatacaggctaggtgttaagtttatacccaggttatctacccttccccctcctgtcctctctcccaccctgtttttattctgtcttccctcccttcttcccttcttccttattctctctcttcctccctttcttcttcatcttcctgtcttcctcactcctcccttctctcctccccatcttctttccctttctttccgcctcccttctccctttttcgctccctctttcccttcacaaacatttattcaaaccctattatataccaggcacgatgcaaggcactggaaatacactgaacagggcagatgtggttcccgttacatgatgagtaacacaggtgataaataaacagttaacaagataagaaaaatggccagcgagtatttggaagaaatagacaagtgatagggaatggctttggggagaattatctgcatataaggataagggatgagacagactcagcagccgtttcatgccagggcagagtagaaggccgtggagctgctaggtggttggcctggagaaaaaacaaggagttttttctgcaaagtgctggtaggagtttacagttctctgtaatgttcagaaatgcagaggtcagcggaggtgggtggatcacctgagggtcaggagttggagaccagcctggccaacatggtgaaaccccgtctctactaaaactaaaaaaaaaaaaaacattagccaggtgtggtggtgggtgcctgtaatcccagctacttggaaggctaagaaaggagaattggttgaacccaggagacggaggttgcggtgagctgagatcatgccgctgtactccagcctgggtgacagagcgagactctgtctcaaaaaaaaaataaaataaaaaagaagtatagaggtcatttttaatgtgagaatgttctcagtgaattaggtatatgtgcctgccacattttccaaaccaatgtttttacgaatattctagtttagccctctcttctagagttataaaattattctgccttcagttctacatttagggagtcctcttttaaggaaaggaaaaggatagttaaatcaggggctgtcacagaagcctcagattggaggacaaggcgtggaccatcccctgtttggcgggaaaatagctttagtcacaggcaggttgttttgcttcctaaagcgtaaagttggaaatgtgataatttcgtcaagtagttgatttagttgtatcaagcttaactaattaacaccaattccatgcttgattcttttctccattaactgaacaaaagccattgctaatgaggctatgtatacaaagccagctgactcattttgttatggagatttcaaagagaagggagttgtaaacatttgtagggaagagataggggtagacatgatcttacacatatttaacaacaggtgcaatacaggcactggccaatgagaatgagcaggggtataatggtgccaccagcacatacagaaggagtaagaagtatcctcaaggcacggagagatgatagggtgcagggcctttgcactgggcttattcacaggcaaaatatttttccttattttaaagaaatggaaagaagtcttcctagaagccagggtctgtgatacatgacagagtgaccatagcactcaggggtgcagagggtgtgtggattctgatgacagattgcctgtctgattttgcagaattagctccaacatggttttggtaacacccgttgccctctttaagcttgatgtctctgttttcatgtaatttgcacaaagtaggcactcactaaatatttgtaggtgaagacgtgtatctcagcacaaagcagcctcttggactaccatctgtgtggtattcaaggttcttttggtttcagagaagaggaacacagtaaaatttacccaaagaaaggagcatatgtgtcggttagggaaagaccaagcttccataacaaagagactcccaaatccaatggcttgataagatgagcctttatgtcatgttttggtcccttggtgagaggcaccgactggcaggctggctttgccctgtgtaatcattccatctttttccttccagctgttgctcagacgtcaccttgggcatggtccttgtctgcatggttgaaggtggctcatgtgtatgtctgcttttcagtgcacgcatggaggcaaacatctgtcttttacattagagatgactccaatgttgcttacatcacactgttcgcatcccatttgctcaaatgtggtcatatgccacatacagctgtgagtgacgctgcgaaatctagctggctggctttgtggcatggcttgcattcttctgctgtgggagagaaggaggagagaatgggttttagtggacccacagggagttactataaaagtgcaaatagggcataaggggatgcaagaaacactgaacaaccaggcatcagagtgcaggagcctatggagttcagatgagagctctccttcgtgcttctctagctctcactctccatctctcacactttctctttttctgtgtgaagactccactgtctctgtctctccaccagcttcctctgatgtcctatcttggatctggccccagatagtatcctctactttcttgaccttgggttttccaaagccaactggtatcttcttacttgtctcttgattctaatttatctaaagggaagatctgattcgcccagctcaagatagtcagggtctaaaacaccatgaccactctaaaaagaggggactccgagtcagctgtctgcgcttatccaatcagatgacgctgggcaaatggagaagctgtcagttttctgagacacccctccccagactgacccaaacacaacttgcacagtgtgaatatcagagtactatgtgagaaagtactctgtggagctgaccagcatcagaaattctgctagggctctcttataaattgataacttgtttctcagtcttttatacatttggcaaccgtgaatctattctttagaaccagaagagtcctgagtgatgagttcatagattagagattctcatacttcacagttgagaagtggggacaggcccaagggtaagaatcagagtgagctgccagttacatcgctggtcagctcctctttcactgcagtagatacaatgaacataacaatggatataagctccaattctatccagttttccacgaatgaagatgagtctttgaatacgcccttagcagttctcaaaaaccaatcagcagaacaagtctggccagctcccactttacatggacattatcatcaaaagctattttaatcccaggaaccaagaaaaagaaaaaaattctgaacttgcaatttttttctgttttctgtttcatgccacaggaataatttttaagaaattctttaaaatagacccaattctatgtcttatttaaagcaacagatatgaagcagtctgtgtagcagacaaatttaatggttccaatcaggggcttggaattagactgcctaattttaaattctagctccatgcttgcaagggatgtaactctaggctggttactcagtctctctgatgtttctgttacttcatctgaaagtgtggataacactaataggtaccttgcgaggctgtggacaataaatgagataattcatgtcaagtatttggcccagcgactgcgacatagcaagtgttggctgaagataattattaggacttcacatgagcgttgttggaggagcttagcttgtttaacctggaatagaaaagatatggtaaagaggatgcaggagcttccatttagtatctacagggtgggccatcctgtttcctgtggcagagagagaagaggtagaaccaatagggaagaaatcataggcagacagatttcagatcaacaaagaaaggcaaaacagatagagctgtccaaagaaggaatgggtttgaaagaaataaagccccagaagggctctagatgaggatgtgaggttggataagctacataagggatgtcccaaagtcagaccatcttctgggcttgatagcatgggttaggatgggctgacaaagactgccttaaataaaagtatgcatacacacacacacactacacacacacatacacacaatacttatatgtaaatacatttaaatatattatatagatttaatatataatatatagttctatataaatatattttaaatttataaatttaatttataaattaaatttattatttatatattacattaatttatatttatattcataaatttatatataaatatatttatataaaatataaaatatattttatatgtttaattatatataataggtggaggcgggtggatcatgaggtcaggagatcgagaccatcgtggttaacatggtgaaaccccatctctactataaatacaaaaaattagctgcgcatggtggtgggtgctgtagtcccacctactcgggaggctgagacaggagaatggcgtgaacccaggagggcggagcttgcagtgagccgagatcgcgccactgcactccagcctgggtgacagagtgagactctgtctcaaaaaaaaaaaaaaaaaaaaatatatatatatatatatatatataaatatatttctatatttataaaatatataaagtatatatgatatacaaatatatttacatataatataatcattttatttgatttaaaaatatacagtatatttatatatttgtatatttataaatgtattttatatattgtatgtttataaaatattagaaaaatatatttgtatatttataaaatatataaaagtatatttatatacaaatataacctataagtatatatgtatgttttacatacacaaatacttttatacataaatgtgtacacatttcagaatcaaacagcccattataagcatatatgaaagaacagtttgatttggcatattttataaactgtcacctgattttttttttaccccaacattaaaaaaaaaagctagtgcataaacaaggtgcagaaagaagctagtcatccattcatctcttcttgtgccagtgttacaatatctagtagctgaaagtctgggccagtcatttgcccggaccgcattatgtctgaatacctcctggcagtttctacgtctttctcagggcttctaaataggaatgaacatgaaagggccgcgtggcagtgaccgcagtgtggaggttctaataatgactatgagggacacacagttttcaaggagatctaacagtgtttatgaaagattctgtttcatctcaccagtgaagagcccttcatcatctaccattctcttaaggatagagtcttagaatctccagtgatcctgcaggaccctcatcccgtggttttaaacctgtgttctccagaggtctagcattgagcggtggcacttgggattctggaatggggaggatgcaagaggaacacagtgaagtaaacagcttggactctggcccttcaagcatacttcatccactttcatctgttttaggcatgtgggttcaagaggtgatgccacttgaaaaaagattagagggttctgaaaaaatcaggtgtagaattaattccaacatagacctaccttcttattgcacagacaaagacactgagatccagagacattgaggggctctcttgggctcccccaccttgtccaggggaaagtcaggactgggatccagcgtatagtcacttgctacggctattcccattatgttttgctgctgctgaaacactggaacacattctaaagttcagacactcaggaaataccccacggtgataaggacaaccggtgatgccgatgagttcccaccaggtgtcagtgcctcgaggacttgtttaatcttcacaacggtgctctgagttaggtgctcatattagttccatttaacagttggagaaaatgaggctcagggaaattaaatcacttgctccacatcacacagctactaggcagtcaatgctggttttgaggctaggtgatctcagtccagaggcctcagccttaaccattctgctctctcgccttcctgcattttatactccatacttctcttgggagaaagatactatcatattatttcgtccaaacttaccatatcttaaaaaaaacttaccagcaaacaaatcatccaactgcctttcatctattgaatgttctacagacttaacgccattatctcgcatgaccttgatgaagatagtaaccctccctttatcaaaatggtcaatcttcattaatttattttactaattagttaaaggctggtgtaatttagagaaagtctaaattatagaatacattttattctgtcactttgaagcacaaacctccacaaagatttgtataaaaatgctcccttctgggactcacttcagtgatttgtagctaccattcatactgcctctatgtaaatgaaagggaggcataatatcagcaccttgcgtattcttctccatggtaataaatcgtgcctgataacctatgaaaatggcttcatttttctcttaccacgcctatcatggtggctttcaaactcactaccctgtgccccacctatcacacctgtcctttgtccctttctcacatggatgtctacaaaatgcagcagtaaagtgttccataatccacacttcagtctacataaatgtttaattcccctgccccttttgttttcgtcaggccccctgaagccgcagctgagatggctgactccctgaactcttcttatgttcttgactgttcgcatagcctttcctgggattacctcccagttccaagtttgcccattctgcaggcagtcttcttgggttccagcttttctccaccatcagcttctcccctagggctcttattaactctccgctctctgggggccactctcattttcagcttcatgtggatcagtgattacttgtcctatctcctctcctagaacgtgagcttcatcaaggaatttctctctattgaccctcaggcatgagcacaatgtcctactccctgggtgcttagttaatgcttatggagtgaatagaaccccggcgtgtgtgtgtgtggtgtgtgtgtgtgtgtgtgtttagggaaggcaaaggacgtttggcaaaaaaacaagttacctgagggaatagcaactcgaagtcattgtccctcaatttgggatcccggtaccacccgcataagaatcttttggatgctgaataaacctgcagtttctccagcctggccaagacctatcaaagcagggttcctgggtatgaggtccaaggatctgcaactggaacatgctctccaggcaattctatacacactggtatctaagaaccactgcgctcagaactaggatatccatcaagcctgatttgaagtacctgcatgagtcccagtgtcatgatgagatcaagagagcttctgtgtccttgaggggctggagtatgcgtccccctgaaaccctttccctgcctgcccccagcactgttgggtgtcccttctctgtgcttcctctgccaacactctgtgcggtgtttccgggagtcagaatggcagggtggtcaagagtacggactcagaggttgcagaaagataaaaagatgattgcattcatgattgttatgatgtcttgtacatagaatattgtcttatttgctctaagactccattaaaaagccagcaaaagcaaatgcataccagaaaaacagtggtgtgctctttgaatattaggtggcctagtgcatgtttcacctaggtctctgactaattctatgagcttgggcaaattatttagcttctttagggcttctgtatttgtgaaaaaaaaaacaaacaaaaaaaaaggaaaacaatagtttccctttaacagggctattgtaggaatccagtgagatcatatcttggaagtgctcagctgagggcctgggcgggataagtactcaaatcatacccttaatatcattattcttttttgagatcaagtttcactcttgtcgcctaggctggagtgcatgttggccaggctggtctcacactcctgacctcaggtgattcacctgtctcggccttccaaagtgctggaattacaggtgtgagccactgtacctgaacaagtgggtgttgttttaagccactacatttgtggtcatttctcccagcagccacaggacactcatacgtccataaaggcagcttctctgctctttgatgcctctgactccacttaagccctcttccccagggctgaaccaacatacccgcttccaagtctattaagtattgaattgtgttcccccaaaagatatgttgaagtccaaatccccaggatctgtaaatgtaacactatttggcaacagggtctttgcagataatcaaataaaaatgaggtcattttggggaagaagctaatctactgttactgatgtccctgtaagaagaaaagagggtcgggcatggtggctcaggcctgtaatctcagcactttgagaggccgaggctggcagatcacctgaggttaggagttcaagacaagcctggccaccatagggaagccctgtctctactaaaaatatataaattagctgggtgtgttggcatacacctgtagtttcagctactcaggagcctgaggcaggagaatggcttaaactgggcaggtgctggttgcagtgagccgagatcaatccactgcactccagcctaggcgacagagcaagactccatctaaaaaaaaaaaaaaaaaaaaaaaaaaagacacaacgacacacagagaacttgtgtgatgatggaggcaaaaactggggtgacgcagctacaattcaagggacaccaaaactgccagcaatgaccagaagctaagagaacagcatgaaacagactgccatctagagccttcagaaaggacatgacttttctgacactttgatttcagactttttgcctccagaactgtgagcgatcacatttctcttgttttacaccagccagtgtgtgatactttgttccagcatccgtaggaaactaatacaaagtcccaaactctttccactatgtctagatccaaagtcaccaagaggcctggcttggggcagcactgggaacttagacaggaccctagctaagttccattctgagttaataattgttattaactcactcagttcatgcccagttagcaagcatcatgaagcacattaagccaggatatggcctttctaaatgtcctgagtatcaggagaagctttttcacactgcaaaagccagtctaattctatgacttgcaggctgaaaatcaactatggctgcaaccaagtcacttagccatcatcagcgccaatcctgcagtgcttatagccaagtcagggcgtctgtttgttgagaggcaaaggcggccccgccccatgctctggtttctgcttgcaccttattaacgggtaatgaagagtaggttctgctttattgatcttgagaccagagctacgtgcgatgctgcctaagaaaagccgcaaaggattttatttgatttttgcacacaacaataatctccctcaccagattagctggtgaactggtgggcttttcaccttgaaattgttgatagggtagccaaacaggaatttctatatttgctaatccttcctcaaatacacatccccaccgtctgtgccctgtcaagtgggtacctgggaaatagcagagaccacactgtggaaggggagacactccagtgcaggaaagatcagaagaaagaggtgacaatgacatgcagcacgaagcagcgatgatggggttttttctttgcaaaattacaagccacagtctcacctcattcctacctgccttttttatttcccctgctctcaaaacatacctgactagaaaatccccagtccaactccaggaatgccctttcttctttagccacatcacagtgttaccagatgccttttatgagctctttggtagaaactaagccatgtgtcactactgggtgttgaaaactcaggagtcagcttccctgcagtctgctggcgctcagttctttggctctgcctaaagtcggataaggaaatgaccttccaggcatggtgagatgagtccttaggacacagaagggcaggctggcctggcctcaggagactgcaacagctgccagagagccatggcactcctcaatcccccgaggagcctggaaaagacttccctcttgggttcaggcatgtcctctgcttcctgcctttatggaaactggattttcgggaccttggaggacctcctatggggaatagaaactaacagcccatcccgagcctgcttttccatgggaaaggtggtgggaattctccatgtcacctttgcagagagagagagacaaacatggatccaaattagagatggcttcaggttctgacggattcatctctcccaattgcctttgtaacacatctgctaaatttagataagtcacaaatagagccaaaagaaaatccagaagggagccacaaaaaattattaaacagttgtaaaagttggggattatgagtggaggaatcggggttatttatcctggaaaagagaaggctgaggagggacatataaagacttcatactagattaattatgtaaataagcagacacccagctggcatggaatttcaaccatttggcagggagagtgggtattaaggggggtgactagttgttttaaaatcattagttgcctgcacaggtttctggaggggttcactgttgctgagtaatacaagttatgaatatgccaggtctgttttaatgagcccagacttcacccaccaaaaatcctttccagccaagcacgtgataactatagatcttctttgtcctttgcctcaagcagaagccttacacgggtccgtcgtaagatgcacctctagggctcattccttcttcaagtcccggtgtagagtttggtgttagaagggacaattagagacttagagattccttcgtccagacaggaagatgctggaaggagtgccttttggggaatgagctgagcttggccagatgctgcagttgtgtccccttgctgaagttagtcacacttggctgctggagaagtctgcccaggtgcacttcataaccacactgccatcttctgcctttcattcaacaggacatgaattgagcacaggctggtcctcctgagccctggcccaacaaggctcctgaacctgggcccagagatgcataagaggatgccaaatcacataaaaaataagggtatggtgaaatcccatctctactaaaaatacaaaaaattaataaggtgtggtggttcgcagctgtaatcctagctactccagaggctgaggcaggagaatcgcttgaaaccaggaggcggaggttgcagtggattgagatcacaccactgcactccagcctgggcgacagagtgagactttgcctaaaaaaaaaaaaaaaaaaaagagcccccccactcatccacacttactctcttacaatcctggaaggcaacttgtttcaatgggctagaggcaagttgttggctagaggagattccattgctggactcttttagatcctggtggttcccgacattccttagcttatagccacatcagtctagtccctggctccgtggtcccatgaccttttgtgtccaatattcctctgcccccctcttatgaaggaatttgggattctatttagtggctacccagataatccaaaataatctcttcatttggaaatcattaatttggccacatctgcaatgtctttaccacaaaagttaatatagatgagttctagggattaggatttggtacctttggggatcattattcagcctactgtagtaggggttcatcagttagtgggggggaagtagccagtttattcccaaaatgcatgtgtcatcacaaaccaagatgagtttcctaaaagaaaataagatactactgcgaatgtcacccaatgagacctgacccattctgtgtgtgcagggatgctgttttagttgggttcccacagaagcagaccctgcaacgatgatttgtgtgcaaggtgtttatttgagaggtgatctcaggaaaccggtaaggcagtgggggaagtgagacagggaagaaagggcagccagtgatgggagttgctttcaagcagttgcttgttcttatgggcagctggagctgaatcccactggggactctgggagacaatgaaaaccacatctcatagttatccccactgaggaatgagggacctggggtatttatctaccaactccccttctattattggttgagtccctcttctgacgagtcacaggtattcccagtaagcagcctctgtagggcacaggtgagtgatgatgggattcaccgctgacagctctgctgtagatttccccgggcaggtgacctctgaactgccacctgaagtagaagtaggaagtaaccagcaactggggtggggatggtgaagaagaaggagaaagtgttaaggaaggaaacagaaagtgccaagccctgaggtaggtggggcacagtgtagtgttgtattagtccattttcacgctgctgataaagatatatctaagactgggcaatttacaaaagaggtttaacagactcacagtgctggggaggcctggcaatcatggtggaaggtgaaaggcacatctcacatggcagcagacaagagaagagaactcgtgcagggaaactcccctttataaacatcatcagatctcgtgagacgatcacaagaacagcatgggaaagacccagccccatgaatgaattatctcccaccaggtccctcccaaaacacgtgggaattatgggagctacaattcaagatgaaatttggatggggacacagctaaatcatatcaagtgtccagagtgaaaggagttgagatggaacagcatctcaccagacctgagagccatttggtgcgtgttggatgcatgtggtccgtatctgttctggttgattgatgcctgtgccttgacatttgttcaatattttgaatatccttcacactgaggtcaatatctctttccctgggtggttatgagccttaaatcagctatgccatgtgaaagttatttgcagtttgtgaagtcctgtggaaaggttgttgctgtttttctgctggggctgttttaagatgaaacatggtatgggggaaagatgcaagctctgggtcccattctcaggagtttccacgagcaggaacctcacatcactgccattggcctgtaatataattttggcctgagtctatctgggacaggtggtgtggagatgcactgttactaaagacttaaagcttggaacttaaaagtctacattttctttggagtcaggtggtcctgtgtgcaagtcccagttccaggcccttccactggctgtccaatggcttggagtctgaggctcagttttcccacttgcagaaggaaggaatgatgccaacttcgtaagttacatgagatgtgaaggcagtgatggaagtggagctggggctccttccccctctgttttaagcatttgattaaaacaagttaggatgggcgcagtggcttgtgtctgtaatcccagcactttgacaagccaaggtgggtggatcacctgaggtcaggagtttgagaccagcctggccaaggtggtgaaaccccgtctctactgaaaatacaaaatttatctgggtgtggtggtgggtgtctataatcccggctactcgggaggctgaaacaggagaatcacttaaacctgggaggcagaggttgcagtgagccaagatcacgccactgcactccagcctgggcaacagagagagactctgtctcaaaaaaaaaaaaaaaaaaaaaaggtcttactgtaccatatgtcctcacttaacttcattgctaggttcttgaaaactgtgactttcagggaaatgaaatataatgaaagcaattttactgtatgctaaatggtataaacaagagttaaattcttacggcacgttcctggtcacaaaaacattaccaaacttcttaataaagacccaaaacacttctaatattaaacattgaaataaagatgagctatacatacatttaagaaagatgaataaaaacaagtaagataatcgtttgctcaatttttggtgaatcagtgagtgacggtggtcgtagtggtggtgggttaaatcaaggaataaaggtttgcaaagcgaaaattgtcaggggcacctcctgccaccgtgcagtttgaaaacaaacaattccaactaatggcagactgactgagtgctttcttactgcattgttttttattgtgcatttttatgattattatacacagtacttcatgagtttttgttttacaatacttcgtattaattaattcaccttccaaattgcttagtctataatagtttagggtcttgggtggccaaagcctctgctagcacagggtaggaactgaccctggacaggacatcattccatcgcagggcacacttacacccacgctcacactcactcatactggggcaatttagatgtgacagttcacttcacatgcacaactttgggatgtgggaggaaaccagaggacccggggaaaacccacacaaacatggggagaatgtacaaactccacacacagggtggtctgggccaagagttagtgtttttttttttctcatcaacattataataaaacaacattgaagaaaacagcattatatgatgtctggatgtatttattgttcatgatggccaggtcttcctgcattgttgtttgagtcagtcacagtgagttggcattgctacaagtcactgagcaaaaggccctcgcctggctcattcgccaatgagtctcctgtgcctgaaacaaagcttggtaaatagtagatgctcagtaaatactaactgaataaatgagtgagtgaggtttactggagaagggatcaagaacctgaattgatttagctctccccacatgattatgggatgaagccatgataattactggcacaaaacattcattttatacataatggaagtataaccagggatgcaaagtgatttgctccaagggtgctcagttaatttattcaatgaccagtcattcctctccttgatttaacaaacattcattgagcacctacagtgttgctgatgatattaaaacctcagtttctatcaaaaagcataagacattgcccccacccttgataagccatgacttggtagtgggttcacatacataaacaaaggatcatattgcaatgtaccatgatctagtatttacacacatgatgtgctgaaggaatacagatgaaggaacatcaattctgccttggggcccaaagaaaccagttgggaaagttatatttaggatgagtgagggacacggaggttcagaggtcctcaggcagttaaagagggagtagggtagaaggtgcaggataggtatgggcacatggaaggtcatggaactggccagtcacccagtgaggctagagtggaacactgctcacgtaggcaggaagaaaggtactccaggtagaagtaacagcaaagtcaaagaaagcagtcggcaaagagatttgtaagtttgaagaattaaaagatgaaccataggaatgaaggagagtgtggcaagaaatgtactttgacagagagaacttgtgccaggtcattctggtctttgtaggccatgatagagagttcagattttgttctaaatacaatcaaagccattaggaattgtaggcactgtacttccagtgagctaagttttggggtcagtctggtcactgtgatggagcagagagggcagggaggagagtcatcaggaggctgtaggtgcagaccaggggaaatgccagttagactacactatgctgtggcagtgggaatggaaggacctgatgtgctttcctgaaatgtagttggggcgtgtcacatgcttgagttctgtgtccctaccctctctcactgacccatagtcggacagaccacactgccactgggcccatcgggaggcagggatgggattcaaggaagacttgttggtttggatggaaacacaacagagtatagaataaactttttttcaaatgttgtttcaatttaattcagtaagcattggagatgtattttcatcagaaccctctcaattttaaggggttaatgtctaactcaaatgggaaatgtatagttcacttaactgaaaaggtccagggagttgagttttaggcaaaactgaatacaggggcttgaatcttgttaaatggtttctctccatctcttggctctacttttttctatggtgacttcactctcaggcagggtcttcccatgtgataccggctattggcagactcagatctgtagccttataatttcacaaccccagcagagagagagagggctgctattactgaacagtccttgcagagggctggcaatgatttgcccagtttgggtcccatgaacacggtacaggtactgtgccagatgaactgctggaattggctacgctagggtcacatggccagctctgcagctggggatggagtcacccttattttcatggaccaagtatggagagtgaggtgatttcccaaagacccactaggacactggtatgtggagaacatgagagatggcaggtagacagaaggacaggtacctactacgagcacctgccattgtatgcaagctctgcctagttctcctgcaggaagttcaggagtgaataattcagttcctatccccaagatgctcacagggtaccagggatgcagatacatacatataagcctttttcacgtgagcccacctgtgaagagtgccctgatttgatggcatgtccagcaccaggaagctctgactgcttttactcaaatggcacctggggccaaggcacatgttttctcacatttctattttaagagtcaataaatcatttctggtaccttaactggatattaaatcagggtgtttttcttgtcccctaatacagggccaagatgtctaaagttgaccttcagtctagtccaacatctggaaatgagtactaaagccaccagcacagacaaaaatggagaacaggtggacctggggaacagtctggggaaggaggggttccacatgagaagttacctgcagggagcagttgggtggcttgagttccagcctgagaatgattgtaatgtatctccttaaatccgtgtatgtaggtggcactctgttcctccttatccttgtatttcatctgctctcagggctgtgtttctttgcttcttgtgggcttttgcttttcagttcagcacatatttattgaacctttttgtggggactggctagttattcaccagctctcttccttctttgtcttgggaacatagctaggttatattccccagcctcccttaagttctctgtgactggattctggtctgtgggatgtgggatgatgtaaagtccaccttacttcagcaaaacctcctgtgaagttctccatgcaaatttgccctattcctctgtctgccacctggaagaagaggatctggtgggggacagtggagccacaagatggaaagaggagtctaggttcctaaatgacagcaaggagttgtcaatcatccaaactcctgtgcaaatacaaaactccacaccagattgcgacaggagtgaaagataaatctttacaatgttcacttgttgaaattttggagttattttctttttgtttttgctttagaatatagaatttagcctaccttgagtaatcagagttaaaaaaaatataagaaattgtgccatgtgctaggttctcagtgttgagcaaagcaggtgctgctctggccttgatggagttttcagtcttacctgttattttttctattcccactccgtcttccactccttgcaggcaataacagatgatgttgggggcaatagtcttgaaataactctggtaagtgcccagcagagccagatgctgggctgagttttgaaaatgaacaacttcattggtactctctgagcctttcttggagtggggcttgtctgtgggtcacagcctgatcctttaggccttgtgaagcttgaaagatcctacaattgtgcagggtaaagaggttttttgttatatacacaaattgtactttttcttatttctcatttttgttctcagacaagtccttctaattagttagaatttcattaatccagtcatccttccatccatctatccatctatgcatccttccgtccatccatctatccatccatccatccatatatttattctttagaggtagttttattaataatagttgtcttttgtcaaatgctcatttgccaggtgccatgctattgatatgactagtcctttttaattcaaatgacagtcctacaaggcaggtgccatgattatcacttaataaatgataaactgaggccttgagacatttcttcagagtatgatcccatatatgttttggtagagcctagattcatagtcatgatgctgtccttcattctacatttattgggatgccctcaaatgccatgtctgatggaggcatccccacctagagtagctgacttgaaggagttcacactgtatgtgtgtgcacatgtgtgaagatggatagtcaaaagagactgtcatgtaaacaagtaatgcaattggaaaggtgctgtgcaaagtagctgagagaatcacagggccctgtgagagactggaaggcacccagatgatccaaggtgatggccaaacctacaaacaggggagccagggacaagagcagggatgattgaatctagagtcagactgatcgtacaccctcagtcttccagttggatgtccttggctgggtcagccattctctctgtgactcagcttccccacctataaaatcaggataatttagctcatacttaaagggtagttttaaagattaaataagatggcttcttaaggattaactgagataatacattttaaatagggcttggcaatactaagttcttgataaatattagcttattttgtgataatgatggtcatggtgatggtgatgatggtgttgatggttgtgcggatggtgatggtgatgttgatggtcatggtgatggtgatgatgacagttgtgctaatggcgatgatgatgatttggaactagaatcaaaagaatgttttcctgctgtttccctcattgcaaataacgtacatatgtctctttccccatactcgttattgtctctcaagttctgaattgtcccagctctatcaccaaaccaggtttgtggccttgggcagagcataaaagatgtcttggcttattgttctctctatagtgagggagaatagtgggttctggagctggactgtctggcttacaagctagctccaccacttagcagcaggatacccttgaggaagtcatgcaactcctcagagccccagctttctcatctgaaaaatggggatgaaaatagtaactgccacatttaggtgttttaaggaatggtaaaatgatctgcataaaactataagcctcattcctggcacatggtgacctcttaatgaatgctagatatcctcattttgaaattaagaggtgccttcaactttacttggtggcttttctctatacattgtacctttatttttactttggaaagttgtatgcagtgccccgaatgctgacttgtaaactgatttgaacaccatcctcattccttttggctctctgagaaatgttcttttttaatgaatatgatagcaagacttacttattaccaggttatttcaggcaagagtgatttttaactcattaaccagataattattgcagttctccagttacctttctgttcatagacttaataaggcctgaggttatgtggcagagttttcttggctaagatgggagaattattaaagctctcaggtgaaggtgtgaaacctttggtgcacagagggtggccgtgccattcaagcagtccgtgatggtgagagggagctcagctgcttagggaactggtacagggtttcattaatcatgggacatttctggtgtacttgaaaatgttagttttacttatgggaaagatatccagacgtaaatgtgtgtgtgctgtgtgcatgtgcgcacggtaggttatacagcaccaaggggtcaaatagactggttgactgtatcctgtagtggtttggagcaggtgttggcaaacttttcctgtaaagtaaatattttagccttggcaagctataagatcttcatcacagctactcaattcagccaatatagtataaaagcagcaagaagatacatataagtgaggatgtgactgtgttccaacaaaactttattgtggacattgcagctggaatttcatataattttcatggaccacaaactgttactttcttttgacatttttctactgtttacaagataaaaaccattcttttctcatgagctgttcaaaaacaggtggtaggtgggatcttgctggtgggctgttgtttgctgacctctggattacagtctgcatctgttgcagcttatttcaagcaccgcttgtttcattatttactttatcgccttgggcacactccataagtagtcagtgcctcagtctcctcttctgcaaaagagaaatcagagacttcctatgttggtagagaaaatttgtaagagttagcagagattaagtgccttaaacagtatctggtgcgtagcacccccttgagaaatactagcttttattgttttcattgaattactgtctcatggaattcttacaactacatcatgaggaaaatagtattaatagtattatccccatttcccagatgaaaacactgaggcacagagctgtattctgtctgaggccagagttagaccatgacttacttatttacacaaagcagcagggacctgtctttgatgatgaacaagtccaaattactacaaaactgcttttgttcttcttctaatgaagtgcccaggattcccatccatcagaaattgcctgtgcctattagaaactgtcatttggcaaggggatgagggcggcggcggtggtggggttacaagatgcgcaggtggtatagggaaggagtggcaaatcaaatgacagcaacagagcagccgttactgcattttatttttttggcattttcttccattgttctcctttgtggacacactctggtgtttgcactgggggcatccctgttgtatttgtaaatccctggaggttgcagttgtaaaatgtgcctttatcctctcccattgcattttttttcctctctaatgcaccaaattagaagattgactgattttcgttttccctggaaggtaaaatttcagcttaaatcacaaatgtctgtgatgcacttagcagccaccgcagcttctaaccagtaaccattcctccttattccctctctacccaggagaatattcaggtctattgtgatttcgagatgcattagccgcacttagagttaaggatcaactttggcttctgtggaagctgctgagatttaaagggtaagagctcatcccatttagaacatggtgtattctttccctccttgctcatatcatttatgaaaggataaaagactggagaaagtgtcagagtagattctggaggtacttatattgctaggacaaaaaaaagaaatcacattaccagtagctggcttagttctgcatgttactatgtgatcagtttccaaagttcttcgtcttggaagacaggcagccccaacctatgggaatctgctcaccctacaatggtgagcagacccactccacccatctttgccattcaagtctacagcatttgaacagatcagcccgttctgtgtcaagaaactccttatgcatgttctggacacagccctgtgtctctgcaggttcaaattcccctgaatgagagaaaagttagaatcttcccttcgtatctcagcttctctactcattactcaaacccttgggaaagctgctctattacttattatgtctgcttcctctggaaaatggcagggtaatatgaataccttatttatagggctgctgtgagaatcaatatttgtaaaacacctggaagagagcttgacacatacaaagcactccaaaaatgttctctggcattaaaaacatttgataatatgggctgggagggatcacactgcttctcagatgcaatccttcaatggcaccccatttcttgtaaaaataaatactaatctcctcaacctggcttacaaggccttgttcagtttacccttatgggcttgttctatccatccacttttcctccccagcgacacggtacaggcacacctcagagatattgcaggtttggttctagaccacagcaataaagtgaatattacaataaagagaggcatacaattttttttttgtttcccagtgcatataaataataaactacagttacgctgtagtctattaagtttgaaatagtattatgtctaaaacgtgtgcataccttaatttaaaaatactttattgctacaaaatatgaatgatcatttgagccttcagggagtcataatctttttgctgattgagggtcttgccttgatgtgacattgatggtttctggctgatcagggtgggggttgctgaaggctaaggtgaattggcagtttctaaaaagaagaccacaatgaagttgtctgcatcaactgactgtttcttttacaaaaactttctgtaaaaattttgtatagcatgtgatgctgtttgatagcattttacccacagtagaacttctttcaaaattggagtctaccctctcaagccctgctactgctttgtcaactggtttaggtactgttttaaatcttttgttgtcatttcaacaatgttcacagtatcttcccaaggaatagaatccatctcaagaaaccactttcttggctcatctataagaagcaactcctcatctgttcaagttttatcatgagatttcagcaattcagtcacatcttcaggctctatttctaattatagttgtctttcagtttccaccacatctgccgttacttcctctactgaagtcataaagccctgaaagtcatctatgaaggctagaatcaacttcttccaaactccttttaatgttgacactttgacctccttccatgaatcatgaatatttttaatggcttctagaatggtgaatccttttcagaaggttttcagttcactttgccccgatccatcagaggaattactatctctagcagcaacagccttacaaaatgttatttctttaataataagacttgaaagttgaagtcacttctagatccatgggctgcgcaatagatgttacattaacaggcatgaaaaaactagtctcgtacatctctattagagctcttgggtgaccagctgcattgtcaataggcagtgatattttggaaggaatttttttttttttctgagcagtaggtctcaacaatgggattaaaatattcagtaaagcatgctgtaaacagatgtgctgttagacaggctttttaaaagtagcactgcaagagtaatttaggatgattatttagggccctaggattttcagaatggtcaatgagcattggcttcaactaaaagtcactggctgtttagcccctaacaagagagtcagcctgtcctttgaagctttgaagccaggcagtgacttctctctatctaggcaattcctagatggcatcttcttccagtataaagatgttttatctacacgaaaaatctgtttagtgtagccacctttgtcgatgatcttagctagatcttctggaaaacttgttgcaactctctacatcagctcttgctgcttcatcttacactcttatgttatgaagaaagctttctttaaacctcatgaaccaaactctgctagctttcaacctttcttctgtagttccttacctctctcagccttcagaaaattgaagagtgttagggctgtggattaggtgttggcttaagggaatgctgtggctggattgatcttctattcagaccacttagactttctccccatcagcaataggactgtcttacttttatatcatttgagttttcactggaatggcactttttatttcattcaagagctttcttttgcattcacaacttggttgattggcctaagaggcctagcttttggccggtcttggctttcaacatactttcctcactaagaagcttaatcattctagcttttgatttaaagtgagaggtatgcaactcttccttttccttgagcatttagagaccattgtagggttattcattggccaaatttcattattatgtgtctcaggtaatagaaaggcctgaggaaagggagagagagggagaggaaaggctggttggtggagcagtaaggccatacacatacaacatttacctattacgttagccttcttgtatgggcatggtttgtggcatcccaaaacagttacaatagtaacatcaaagatcactgatcacagatcaccatgacagatatcataataatttgaaagtttgaaatattgcaggaaagaccaaaatgtgacacagacaagaagtgagcacattctgttggaaaaatgacaccaatacacttgctcaatgcagggttgccagaaaccttcaatttgtaaaatatgcagtatctgcaaaatgaaataaagtgaagcacaatcaaacaaggtacacctgatgtctttcagttggcttaaggtaataattgctgcagccagctcagtccagcccagatttgttacattttcatgaatttttcaaatgttttgttaaatacagctatcattaaaaattaaattgcatcaacttataattaagttatattaaaagaagggtaatatgggcacaaaactgaccatttcctgattattttactacattttactattttctatgcttatttagtcctattatttatgtatggtgaaatctatataatggggaacagctgctcatagctgccagcacttcattcagtgaagtcacattggcagcttgaagctggccatgccgggagtatttatatgacaggaactggcaaacacctcagggctagatgtcttgtttttgaactagaatggcagtcagcaaacttttttctgtaaaaagctagaggagtatcctaggctttgtgggcaccgaaccctctgttgcaattactcaaccctgcagctgaagagtggaaaacagtcatagaatatacatatataaataaatgagtatggctgtgtttcaataaaactttatttaccaaaacaacaggctcacagtttgctgaactctagtctagacttacaaaagtgatagagaaaacataaagaatgcaaattaaattttaaaaatgtgttgattctggtagctgttacattgtatattgccccccagaacacaggacatattctttaaacatctgaaaagtattttgggattcagcaaagaagctgctcaagacattgacaaataagtgaaattctgacttaggtcattggtttattttcaatcttgcttgttcatttaaatggaaatggcaatcaacattgatatgggaaccacacttgctcatcagttctaactgtaagttggctacaagtgtaagagtttggaaaaaaatcaacaaaagcattctgtgagaatcaattggctgtgtgtacaatttacaatatagaaaattgtgtgttttattatttgtaaattatgtgttacttatctttgatatcagtgaaatacataatcaacatatatgtgcctggacatgcctatattggtttttgtgtagagccaattattaacattaccagaatatcactgcttgaatggggcatgttctctttagcttccaggcctttgagtggttcctccacctgaaacaatctcttcttccctttgcctacctaactcctccttctttgatctgcagcttaaatgtgacttcttcaaaaaagacttctttgatcccttcagtaccaaatgagttcttccctttatgcacatttttccttgtgacacttgacttaattatagttaaatgatgaattatgtgctggcttattacttcctttttaccaaaagactgcacgcttccccaggtagataggtccatcttctttatcatcgtgtctttggagtcttacgcagtttgttgaaatattatgtttgtagctgaactgaattgtgatttaaaaaaaaataggtctgtatttaaaagttttagtgtcagctccatccagcccaagttaagtactaattcagcaagttagttaagtaataaatggctgtcactcaactacaacatatttgaattcagttttgaggccccagtagttgctaaaaatcaatgcccactttctccaggtatagtaattatttctcatattgttattgactgtctctttaaagaccagccaggacaaatctatttctgaagctgttgtaaatgatttgaaacaggaagatgaatggaatggaatgagggttgtttaaaagagatttatccctcttattcttgctcaagaaatgagtggccagttgctaccagcctatcccaaaagccaagagataaaagccagcagcagttaattttctagtccgtgtgctagtgaccacagatatctaaccactgatttccaaaggcttactattattcatacatatttactatggtaaatagctcatgttttcaggaacactgaggatctgtttagtcactttggatttctggtttcatcaagagtttgtgtccgacatctggggatgagtgagggttccggatacccattacagaggaagagtctgatggggaaactagagggaattcctatctggaatttaaatttaagtttaggatctcagaaagacaaatggagttgaagctgtgtcaggcagaagagatatctccatttgtttttctgctttctcaacataaggcaaatgtcagtagtaaccaggtttattccacaggcatactctgcaatgtgtgggtaattgtgcctatcgattgtgacaaagtcttcaagcatgaggcagagaagtttgctatccaactggatgccctcaacaatgtttgcatctcaacaatgtgtcctcacattggctggctttacatatgcagacaagtgaggacatgcagaaaatcatttcactggtcctccccattgcattgtcgattgtgtggaggctaacatgtaaagttatcagcccagcagcagacacggagtgagttgtccataaatagtcattctaattgttctgtttttcttattataatttatttttgctatgtaaaaaaaaatcaaatgatctattgcgtgtatatgtgagtttttgtttaaaggcatatgacccaatttgtaaacatgatcattatcttctctgggaagaatactaaccaagggaaagagttcatgatttggctgtgtagagctctcattaagtgataggtgactggttctgtgctgagtgtttttcatcatcttgatcctatgagacattcaacattccatcttcatcttacaaatgagaaaactgaggcttagtgaggttctatagatgctcaaggtcacagacccaacaggtgactgagctggggtttaaatctccagggggtcttttagtaaggcttatgcttttaagcaccaaactctaccaggatataaatggcaaaaggaactgcttaagatatgaagagaaaagaaacacactacttaacacaaaacaaaaactggataaaatacccagttgcctgaatatgtatgcacttattcttgcattcagcaaataagtacatagcacctatcatgaaccagtgactttgcttaggaacacaaagcaagcaaaatccctgccttgatggcacttacttcttagggaaaagagaggatgacagaactgtagagaaaacagagtataccagatagcaatgagggctgtggagaaaataaggtgggaagagaactaatattggagctgggatttcagaaggaagaaagtgtttgagttgagacctgaaggaggtgcaggaaccacaggaccatctggggtcatggtcagcaacatggccaatgggccaactttggcccactacttgttttcatgaataaagttccattggatctcagccaggcccattagtttatgcactatctgtgtctgtttttgtgttcaaatggcagagttaagcagttgcaatcctgtggcccagaaaaacttaaatgtttactatttggccttttatagaaaaaaaaaatgtgtccacctacatctagaagaagagttttccagggagaggggacaggcagcacataggagtctcaggatgggaatatgcctagtgtgtttgaggaggcaggtgcgcctgcaacagaatgggcaaaggggtgagtggagggcagggcctgggcacgtgggggccactgtaggggagagagggaggattctgcagagtgttaacaggaggactctcgctctttgtgatacatccactgtcttaggttgaagaagcaactctgagatggagtttagcattcagggccaacacctatggaaagcaggggcaggaagcaggagtgagcagagggagaagtccagctatgatacagaccaatggcaaccttggccactctctaggagcttcagaattgaccctgtttggcccaagacagacaggcctttatactccagtgttgatcggtcattgaatataggtctttcaatggcaacaacagttacaaggaaggagcatcacctgggtgattgttgagaagctgagagccgagggctgcctgctgaccgcactcccagcagctggtgccatgggtcctgcattgaagtaggatcttgggggcacatcacaatgtccagcacatagaggatgtagggagtaacagctaaagcaagactaattaggaggctactccggaaatctaactgagagatgaaggtggcttgaaccaggaggtggccaagagttggcagactctctcttttgaaggtaaagctttcatatattctccatggcctaagatcaccttaaaggagcaaagtaaaaggaaacaagccaaggggaaaggcttcaaagattcagtctatgttattaaatctccccacccattgattatcatccatgacagtctttgcttagcttaggtttacctgtgctcatcattttccagggtgtacagaaggaacactatttaatcacaaacgttccaatcacaaatgcttcagtgacaggaatagaagctgtcacaccagacagggcagataagtccttgtcacatggctgggtctgtccctgcagtgactgtgctattcatagcaagaatgttgtgttgctaaacttggcatgaaacaatacagttatttatgcgacttcatgaactagagtatcgccttggatttgagattctgctaaagctacatgagtgggcaaatcaagaaattgtattccataatttgtttccaatctgacagagtactatgtgtaatagatgaataagcttatagattttagcacatttattgcagtgtgatgtggtttgacacagtgtctatgagctgtgtggggtgaaatggaaggtttaaatggattccagcttcattatcccactgtgatctgaggaaagcgagaccacaatgttgccatccagtaaagcactttatcacattccttcccaagttgaacagcagcgttctgccaaagaaaagctatttgctgggtagactctttagcaagtttcatttttaacttgggtgccaagccagccaatagaatctaatgggctttgcttacaatgtgcatggcttggctatttacatgagattgacagcacgagaaaaaccagacgctatactcactaggctgatttagaggtttctctgctcatttgaattcagccaagctagtcagtctagccctgggaaaacctgcaagagtaaaaagagaaccaataaaagcgattcatgaaaaacctgaagtgcataagaaattaattcccctgagtttccaaactagtcagtaagctgcgctgaggttttgctttctatgtttctcctttgcttagggactggtcaaaatctcgaagccacttgttgatttttctctctttaaactgctttgatggaagaacacccagggtgtaatgggcacctgggtgggtggatgcctaactaaatatatttatataatccttgaaacatgtttaactctggaggttaaggaaggcccaaagacaaagcggagttgttaagggaagaaaaaaacagaacttcttaaaggttgacacggtgccactcattaattctagaaaagtttgcaggggctgttacatgtcagacacaatgctagccttcccagatgcattgatgaacaagttgcaattcttgctgtggtgagctaatggtaaaaataaacagagcactgccacacacagacataagagccatggggcagcatcccattccaatgcctggtacatattaggaacccactaaatacttgttaaggttcattttgtgatggtatttttttcctctctccgctagcttaaatctgttcaagtctcccatggttaatacgataatttttctgatgtttatcaccaataaatttttagaaaaatcaggctacacagtcactctctccaccttcttaggatacactcactctcttaccctttcactccttcgggcaatttgatctgctatcttttcccaccactttaagagaaggactcttgatggggttcccacacctggtcagatggcctctcttggttgtcttcctcaatcctttcattgtgttgtagttgggcagttcctccacctttcacttctcagatgcagcataatcgtgtttcttcctcccctctgaatattccttttctgcctctctgcattccttttcctcttcccaacacctaagtgattcttaaaaatattctctgactttctatgccttctccatcagtgttagtttcaagttatcttgtcatagtttcatttaggagataatgcctgaatctttatcttaagccttgaaccctctagaacaatttcatttgtgtgctgggcacctggatgtcccaaaggcatgtgaactcatcatatcaggagtcaaactcattctgactaattttatttaatgctatttccattcacttggtcatccaggtggagacctgagggtcaagatggagccctctcccatgtctctctctttgctgctctcagatggacccaggggtcatgtgctgtcaactcatccatcactatatttttctcctttgcccttccatgttatttccatttcacccaccgttgtgtgataccacagcgtctgttttacctcccactgaacaaaagaaatataatccttgaaacgtgctccttagtgtggaagagaggggtggtctgatgacttgtttcaaaatgatctcaatatcaaccactgccccaacggtcttgcatttcatacttaagcaacatatttcaatgcagagaaggtttatagtgtggtggggatttgagggtagcttttcaattctgctctgtttgatttttgactgatgaccccagacacagagatttggcctggcagaacctgcccttagttctatagaggacaccttccccatacttttttctccttttcctcttcctctataaactctaggttctttcactgcatttcttttttgtaaacagctttactgaggtataattgacctacaaaaaattgctccggtttaatgtatacagtgtgatgagtttggatatatacaagcactggtgaaaccatcagcttcataatcaaggcttccaatatcattcacctccaaacgtttccttatgcccctccagtgtttgttgatttgtttgtggtaagaacacccaccatgcaatctaccctcttaataaaatgtttaagtgcacaatgcagtactgtcaattacaggcgctgtgttgtacagcagacctctagagcttactgatcttgctaaactagccacttgtcacacattcgttaggtttcatgacagtctgtcctctgagatgggctaagagttagtctgctctcaaagagtttcttgcaagaatatgatgggtgctttgtggtgaaaagtgaaatagcaataaaaaaaatcagtcacttccattgtaaaaataaacgtaactgcatggccaatatgttattctaaaacagaagttggcttcttacctggctttaccgtgcacggaggactttaatttgtgttcctgtcaaactctaggaatgtgaaaatgtggaaagcccatcccaaacaaaaataagcctcttgccggagtcctcacctgaaatctctctcattctcacccattcacctttcaaatctgtgcttttagcacatcacctttctgccctaaaacgtttagtggctcacaagctagtttccaaattccttagcttagtagttagccctccgctaccttttcttaatgcacttttacacttttctccatgctgtaactaaacagcactacctactaaaatagaaagatacctttcaggttcctgacctcatgccagtatctaccatttccttttcctagaattctctctttctccttatttaaatcctgtgcattctctagtgcatttgggggaaaatgtcatctctttctgtaggcattaactctctatgccctaaaatttcatataaccttggtggttccttttatctcacacatttcgcttatttctttgactaatgttattcatgaacatgtcttaccatttattctgctgcacctacaacccctggtggccagtggctgtcttactaacttttgtgttccctgtgcctcacacatcacagactttccagaaccttttagtggataaagttaatgcagaaatgagttaaatattcaaagaagcagtgagcaagatacgttttttattcttcctttcggaaatgaatccttgctcttccccacccctgggaactgtgccctggttatgattgagatctcatagtcactcatcattcattctttagttagaattgcataacattttattctttacaataaagataacttgttaattgcttaaccagatgtgattttactattatattttttagtaattacataaatcagaggaaaaatccttttcagatgatatgcccttatgtgtgatttagacaagctgaccacctacttttagataaagaaatcatcttctgccaagatggggctagatgtgagggaagagaagtttcctaccaagaatttccatttaaattcaaatttagaagctttcttagtccctgagtcttattccacttcagacttgttgaaattttcctcatgaaatatgctttagttgtcttggtaaattttaagagtgagagaagaccaagtaacagtttacaaaggtaagaatcatttaaacctacttactctccctgtttaagcaatgaggaggattctgtttatttatttttaaaaagtgttaagggaagaagtgctatttcaaattaaatgaagacacgggaatttgcctttaattatttaaaatagtttaaatcttgttgttcaaacaacaccttgtctctacaaaagaaaaaggaaaatacgatgacactcagactttgtcaactttttccaaatattagcaagttaaaaaaaactattggttctgaatggtgagataaatatatgccacctgtaatatttacctgaatagtatatattcagaatgcaatattgtgtaatctcttttaacttcaaaataacccttctttgccctgcaaagatacttgaactcttggtgttggctacctatgaaattatgtcaaacacatagattctacatctccagatattcaaaactaattatcccttaatttgcaagtgaaagcaaaataccacctaatagaccatttctctggtaaacctttctttatcttaatgagcagaatgtggacgcctattacaacctgattttaaaacctccgtgccactcaacagcttactcataagactgaccagaaggaggcaacaaagatgtaaatattcttatttacaatatggactgagctcatatctgtctatttagcattttattataatgcatgccatcccaacagaatcaatagttgattgatttcttatgtaagagacttgagtactttaattctggatggaaactcatcagcaacttccagttgatgagatgacgttctccatttggtgaaactgggctacatttaatcatcacaaacttcaaattgtattatcccactttccagataatgtacagcgtattagcccaacccgctttcttcagaagtgtctttaaacagagatgggctgtatctagataggggtggaatatgccagtgtatcggttagccgttcctataataatgctgcataacaagccatgctaaaattccatggcttacacattgctccataggctgaggggttggctgatctaggctgggctcagctgggcttgactccagactgtgggtttcattcaggtctgctccatggacgtctcattcttctgaggacagcgtgctccttcggaaacattcttttcctgatggagactgaaagtttccaggttagcatatagaaacacatgatgcttcttgaagtctaggtaggaactggtgctcagtcacttccacccactgggcaaagcaagtccaatatcaatgggggaacattctgtttggaagaacttcaaagcctcatagcaaaagcctccatatggggagtagtgaaaaattgggaaaaataatacattcgatcacagctgctttgttttagggtttatataaaagaaataactttaaaaggggttacctccttctcatgcctatatttttaaaagtaagtgtattactctacattgaataacccaagctaaaagtattttatagttaaccttgacctagtatacatactctctcactctcactctccccacacccccaaacccaacaatgaccacagatcttcctttccttccactttcacaacccaaaacttgtcctgttcattctctgctcaaaagcccatcagtgaatccctgttgccattgatatagctcaaaccctcggctagctttacaataaccttcacagtgtgtggtttgtctcttccatcattctgtgtgaatttacttgtctgtctttccacatgttatttcctttgctgggacactctcttttctctctcccacctgcctggtgaattgatgtttattcgtcagagcccagctcaaactttacaacgtctgcacatccttcactaatcccctgcaggcttttctgtttccttatctgtggtttacaagcattttatacatatggctataaagcacttataataatagactggaattagtcattcatgcgccttttgctgctagcctgtgaaatccttgaagatgggggtccatgcctcattcattttctatcgttagcattcatctccatgcctgtaacatggtaggcttcaaataaggtggttggattgaaaagaaggagattttaaaaataagcatttaagaaataaaaaggagaaacagccatggcacaaacagttatgttcaacctcgccattaattaaagacactataaacaaataaaaattatagatcaatttttatttttcaaatagggaattatgtttttagaaagacaagacatagtattgaaaaaaacatggatatctggcattgccaactggagtctaactgacaactttcagggatttttatcatttctctttctcaagtacttaaatatattcatatgtgttgacccagaaatttgattttaaataatttatcaagtggaaataaagatgtgaaaaaattacataggattgctgattatagcatcatttatagtaggaaaaaattgaaacactctaaatttcttacaatatcagcccggttatataaaatcatggtgtagatataacattgggccaaaacgtctgccattattagaggcacagttaataaaatgggaaaaggtttaccatgtatgttccaacataagaaattaagagcacaagaaatgagaatcttgtaaaatataagggctattgttagttacatcccatgtacgccaaaaactgaatttgaaagaaatacaggaaaatattaatagtgattacatttggatgtaataatcacaggatgatcttatttttatttttttctttttgcctttctctagtttccaaattttctacaatgaacatacatagcatttatagtaaatgaaaagatctaaaaatattttaaagatataattatgatacagtaacttgtactgttaactgggcttgtgtgagctctaagttattgattatgtatagctctttatgtgagtttctgctacttttgagccttgacttgtttatctttagattgggttccatttctcttttgtaattaactaagaactgaaatgaattttctaaatagaattgttcttaatttaaatatgaaattctgttttctctaatgtaattgtacctgagtgaaagtaactgcaatgaggactataaaggaagataaagtaggaatatgatgtataatttccctttgcataattgtaactctgaagaacgcatgctcccagcagaaaagtaatttaaattatatcacaacaaatgccatattttaaaatagaaactatccatcatgtactgagtaaagctggtggcaacctatacatctcaaaaatatactgaaaatccctccatgagtccattaaaaacaaattgattggtttaattccagcacatgctgaaggaaagtataagtgacattaatgtaattttaagtgcataaaattactaattacatatttagaaaaaaattatgtaagagaataaccatgagaaataatttttattataaaatattgaaatgtgtacaatgtgaacagaatagtataataaatcccatgtatgtagcgcccacaacaccttttatttctcagtacaatttttattttggaaatgatttttaaaaatgtagaacaatacttttgtctttatcttctgggcaaaaccagttttgaacaacagtgaacattttaataattgtagaccagtgctaatatgttttttgtttttgagacagggtctcgctctgctgcccaggctggagcgcggtggcactctctcagctcactgcagcctcagacttcccgggcttaggcgatcctcccacctcagccttttaggtagtggggcctacaggcgcagaccacggcacctggctaatttttgcatttttttgtagtgacagggtctcaccgtattgcccaggatagtctcaaacgatccactcacccacttcagcctcccaaaatggtgagattacaggcattagccactgcacccatctactaatacatattttgaaggcataatttgaaatctgttggaacaaatgctccagcaaagacattaaaatatatttttcacctagacagagaatagacatacctttcatgtacacaatttaaaatacagacccaacactcagcattcttttccttggtcagcataaagcgtgtgaatatggaaaacatgtcaagtgttgcttgtcccccactgttaatgttttctcacattcctgtccagagatagttctctgcatcttttacattaaaaatcttgccataagtgtatttttaatacaaatattttctattttataaatatgacatagaaaaatttcaagctattcaggtgtatgtaattaaatttgattttttacaggaaattttgaaattgttatagtgattaattgatttgttcatctggcatgtattaggcacctactatataccaggtgctcttttagactttggagaaaacagtgaacaagatggataagggatcccatttttaaagcacaaagttttctccagctatttcttaatggagagattaaagaaatcttcgcctccaagaagtctggatctaagtcatctccctttacttgatcaggcccatttccaccccctagttcagttgacagagataggatggcagcctctgccagcatgtttcaggatatacccaggaagcaaatacctggttggaataacaaagtccaaagcgaagcaagagggtgattgttaaatgagtaattagaataaacactgaaaaatggtatctgcctgggcctctatttttctcgcttttgtagtcgtttttcataggttggacttcttgcccttcagagataatgaaccacaatatgcatctatctgtgggtagcagtagcttgagtttgggattgttcctcgggttcctagggatttttttgaaaaccaggagaggattttctgaacccaattggtccagttaatgtatctatacgtcttacttctctcttttccaggcataaatctctgggctggcttctagaataccaggtccctttcccctcagttcctgtgtatcctgtgttatagctccaagaaggagctataacagggttagaacaaagatctcccctccctactactcctggataaaaatcacagctaagctgtgacttttgagtgcttagcacatgctaggcactgcagtgaatacttctatacacatgatcgcatttaagctccaccacctatttcgagggctggatgaatttatgtttcttgtgctacatatgaggaaactgaggcacaaatagcctcggccatttgtacaaggtgcagagcctgtaaaatggcagcttggcagtgatacccagttgtatcactctaatccccagagcctgtggccaccatacagggctgcctctcacaacacacataaatagccatatgtctcataggtagcattgacagagtcaattcttttccagtacggagagcggtgaattttgagaagtgactttttggcagaaatgcaatctagtgacaaatcagcaaaaggttagagttcagattaaaactcagaatctctgacttcagagtctacaagttaatctgtgacactttaaaggctctgggaaacaaaagaatactgttgaatctggttaccccctcagactcaggctgacttggagttgtgtgcgtggggcgatgccattccaatggtagccgctttgctttatggggttttaggaagaaatccaagcttcagtagcctttcccaaccgaatgcattattaaagatacaacgtgtaactcaggactgattttgacattttaaacatgatttttctccattaatagagtaccataaagtcagcagtaacaacattacagaaagctgagaaagaaaatacggtgaaaccccgtctctactaaaaatacaaaaaattagccgggcatggtggcgggcgcctgtaaccccagctactcaggaggctgaggcaggagaatcacttgaacacgggaggtggaggttgcagtgagccaagatcacgccactgaactccagcctgggtgacagagcgagactctgtctcaaaaaaaagtcttactgtaccatatgtatgtggttccatcatacatcatcgtaggtcatcgtcacctttttctcccttaggtataagccttttcttatgttattgtctcttttcataaataggatttttcatagtgacatacacatcattgaattaataaaccacaatttaagtaactatttccacattactgaatatttagcttgttcttttagtcccctccagtttgacactgcaaacaccaaatttggtcctctgttattttacttccagaaaataattttttagaactaagattaccaagtcactaatatttttgtggttcttaatggatatatattgccaactgcttttcaaaactattgttatatttaataccatcaaaatatatccattcacaagtttaattacactgtcttcatcattagtcataacgttttaaaaacataattgccagcataagagggaatctatctatgtctttctatttctctctctctatatatacatacattttatatacatataagcacacatcaaacatactatatactatatacatactatatattatatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatgatagtactttgacatttctttaaaatctaggcaaacctgagatgcttttatcattgaaagtagaaggtgtccccattactggcagggaaatagattccagaatttcatattctctccaggtcagccactacaaatgagaactgaagaattaatctaagacttttttcatttttaaaaatcgggttattactttagcagaaatatgactttatgccttcataactaattgtactaatttatgaataaagtacatttttatttaaaaaaccaagaggcatactagaagaaattaatccacttattttcttctcaagtaagtggtttacttaagcatacatatatatacaatttcattttcctaagacctagaaaaaattcccaaactgatttcttaaaatttttacttgaaaaaaatttcagcttataaagaagttgcaagagtcgtaccatagttggaaatactctgaatcatttgctttgttttggtgtgatagagattttttgtaacgatcacttataatgtaactccctggaatattaaaacaattgttaaggacctgatgttgtgattagagcagccctgtttctttcgtttttatattcctgacagtgaaaattgctgtgcaaatagtagaaactcagaatgtgttgttgaattgaattgttagattgtcttagtcctcttctattcaggcattttctaagacaatgtgattgatacaaacaagtagaaaatatgctttctcaatacaatgagttttatttccagtgggactgtttaatcagaatgaaatgttgttgtaccatgatgactgccctgcccttagaagtcaattattttatgatggagaaaaaactgtggtccgtagatcagtagaatcagcatacctgggacctggttagaaattcataatctgtagccaaaacctatggaattggaatctacaattagaagaccctcaggagtatgcacgttaaagtttgaggtgtttaaagttaaagtatgcactttaaagtttgaggtgtgtttattcaggtagctttcctttcttctcatatagtttttaggtataaatgaaaggtctggattatttcacgtattggcagatgtgtatttattttttagtgcagtgcttctcaaagtatggtccctggaccagcagcatctgcattacctgagaacttatttgaaatgcaaattcttgggtccttcctcaggtccgaatcagaaactttggagaatggcactactgtttaacgagaccttcaagtaattctgatggctagagtttgaggaccactgctttaatgcttacgagagttgaattagttgtttaaacagaaatcttagaggctttgaatccacttacaaattagtcttttcaaaggtgtactttttaagtgtctgcataatgcgaatgttgtgaagtatgtcaactcttgggatttaggaatagcagagtattagtattccagaggcaaaattgtaattggccttttcacttgcattttccccacaagtgacaaaaggctaaaattaacaatagaaaggcatttgtttacatccaggcaaccttcttttttaaaaaccaaggcacaattttagatagttgataatacctggaaaagcttgggctcaacttgaggaagtagattccattttacttttcctttatttcccagatacagagaaatccatgttaaatgccttccgtgggtccagaacttcttgcttgttctctttgcccccagtctcctatttgacagagcagctgcactataataaatgactccctggcatttcagcatcatagctggggactctgccaaagccctggccacgtctctgtagtgggacgtacaacaacgaagaaaagaggctggatccacaaaccccacaggaaattagtctcattattgcaactcaattcatgttcccatccagaagagggcttcattgcacatggcaattaatttactatgcagagtgtgttttgcttggtatcagcttttattctgacttccaggacaaaatggttgcctgagttcttaatcgtgtgtgtgatttgacagtcaagatgggctatgggaatcatctcttggtagtgtcatcagcagaaagaaaattcttttctgaattgagctttggttgtatgggatagatatctgttctgttggtggtggtggttgtggtggttttgtgttttaatttttggattgtgacctcagtttgagtgagcaatgtgatgaagctgctaacaaaaaaatcaaagagaaaactctaaactctgttaataattgtacattgtaaggtagtaaggcatgttagcctcactgtgcttgtcacagatcagaatctacctagagagctggggtacacgtagaagcccaagagtactagatgatctcctataaagagccaggatggtagaagacctgtggattggccttctgctatgtttctgtttcccagcatcttttccctcctgccactgcctattttaagcaattttacttgaactttcaaatatgtgccttggtcatcccaacagatacctgcacctagttggccaatcagatcactaattgtccggtctcagcgattgatctagacacatttatgaccaatatatggcaaatgagagttctttgggggaaattaatttgaatgttgcagagtgttggccttctcactcccctgaaatatgagttccaaagacaaggtgaatctggaattgtggggtccaatttttttttcaaatggacacagtgagttggataaaaagcccgacagagccaagaaatgcagagagaaagagagagagagagacagagagagagaaggaggaaggtgggaagagagtgacagaccttacggtgttattcaaatccctggatccagctgtacctaaagcccataccttgagcttccccattacatgcaccaatatattatctgtttaatgagtttgtttgcattacattcaatgaggcttcacttacatagcccaggagtctcacttacgagtaatagtttgaagagagaggtaaccctgatggagaaaaaatgaagatttatcgtgacaggagtggggcaggaaaacccacttcccttcacatatctccaggttcggaactcatctattcctcctaacagtgctctgaagtattacctagcctgtgctacagatacaaaaactcaatgtaaggctctaacttgtttaaagtcacatacagagtgagagagctgggactggaacccatgttcatgcgattgttttaaataggtgtccctacttctgagtttccattgcattatgtatatattttccttgaacctccttaaacttaacgtattataaatgtttgtagagtctactaggctatgccttgacagtcattttttgcttccctcctttccttccttcctcacttgtttctttgcctccctcattttctcccttcttcctcctttcctttatgttcaccagcacctaacatacatttatgcctattggaggtgtcagtgatgttatttttgccaatgactgaatgaaagaaaaaaatgtataagttgaaggctcctgtctctagaaacatggaactaaaggcaagtcgatttttgtttaggcattatggggagggtattcctgggtggggccaaagatcagattaagaatcccccataaccctttaaagtcaacagtccatggaggagttgcaccaaaaagagactctccttctaaacatctgtgtgtgattcctggaggacataagttgagcggggtgcttttggaggttaactccaaaagcagcgatgcttcagagggcagcggttgtaaacagaaatcaggaagcagatggtgggggtatctgtggccagaaataagaatatctttattgctgagtaaataaacaagccacatcctgactaaatgggtggaaatttcctgaacatccaggaaggatgtctggtctttaatctgtttttggaaagtcaacctcagagcactaagcccaagtgtgtgcctctaccagcctcaatctttatcttgtgatttatcacccactctctccttctttagggagcttgttggttattctgcttatggactcacagaagagaacaattcttcctccctttgcccattcaattccaatctgaatgttagtaccagactaatgatctgacatagactgaagaaggttccaaggacttttctgaaagctgagcccatttttgttcaccattctcttaaagtctcaggtggagaaggaagaccttaaataatagcttttcttttataatgaaaggggaaaaatatctgaaagaatgcttccagctgatagaggttggacagaacagtaaggagaaattctctaagtccacctggagcttattaagattgaaaattgcaagagattggcttaagctgattttttttttcccaacagcctaggcaaagactctgatttccaattttctgttatggttgagtgcattcttccggcaaatatttagtaggcactcttaatgctaggactggtcacttaaaacaagtgtctttaaatattcttaatttagacacataatcttcaaaccacaacagtgatggaatgaaagctagtcatcagcagtttgcaaaaattatggcgctggtcctctccccagccaacttaactgggcttctaccatcctcctccttcctgatctttcttttctcttcctgagcatctatccagttccctatttaatcatatgtaatcttcagtatgtgcttttatgtggaaagccagatgtgtaccagttgatgtcaccatgatggacaagaaaaagggaagcttacagagaagggcagattcatgggcttgcaacatgtacaattgcatagggccctgtgcttaacaggagggcccatgcgtgcgagttaatgctctgtcatcactaccctgaaattcttaatagatttttttttgtgttttgtaaatgaagcccaaaggaacaatggagcatgagctggggcttggagcctcacttcacagacagccccacctcctcctgcctcctcacttccctgggagaggtctttagccacctgatccctgaccttgccctacacaaggcacacactgacctcctactacagcacctcattgcaactagcatggaccagagctctggggcagggaggtttttgtcaggtgcatgtaacccacatgcagaattataggacagagccccaggttcctggaaaggtcagacttatccttcatatattccatgcctgagagagcacaatattaaatagcaaataaaaaacaccatgacagattgagagaaagaccatggaaaacaggtaaaaaaaaaaaaaaaaagttttgtctgctttttagacaagagatcgcacgttttcgttttgtacctagctctgcaaattatgttgcaggctctggttacatacagcctttagtttatcagcacacagtgttggtgagcggatgagaaatgtggatcctcccgcaggtgagtataaggatgtctgaatgtacagaaagcagcctgatgtaggccagccccatacttaactgacgaatttatcggttgtatctgtcttccagaaacatacaggctaaacgccaacaaacaatgaccatgtctaagcatctgaatattcctctaagaaatcaactgacaaatttgggggaaacaagatgatagctgaaattaacagaatatcccccaaagcagcagcatgggaaacaagtgttatttataccataagctaacaaggcaggcctgggacaatcaatacatgagcctcctttccaccaaattctcttctcattatgtaaataggatggcctgaggtgcaagaacaatgaatagaataataatcggaaatgtaatggaactaatagtggatttctccggactgttaacttctgttcaaagagcccgccaatgatggatagagagcggcgtgcagaaaggaatctttccctggttcagcttgggtgcactgccttgtgctgactctgtcccctcccctacccaccacaccccatgtgtctagaacaatctcctctgcagtacttcatttcctaaatgaattagtccagagccctgttttgaacagatgcctgtacagttcttgattggttgaggcaagtctaaactgacataagccctaactctgaaacatgtgactttttactttgaaaatgtccaattctcagttgtgagctattcatgtgcaagtaacaaacacctactcaaacaagcttaagaaaagcagggaattcctgggaggatgcaggagcaggaaattgagccagtcgttccaaagggccagaaccagaaggcagaccactgggtcccagacagatgggtcatctctttccactgtgattcaagccctgatttgtggcctttgcctattttcatgatatcaatacctccaccgtggctgattgcaagctaccaatgacgtatcatagaatgtggcactggggagggatgtgcagccgcaccccattattgtaccccattatgtagtacttctgccatgcagatataatagataaataatcttaaaagcatagataacagtcaaatacatttgtaaaagagttaagaagtgatgcattttgagtattcattgcctttgcttttaagattattgaatcatgagtgcatgtaatgtctaataacatcaatgtttaactggcttagaaaaatcctgaaatttcaaaagtgacctcttacaaacagtacgtgtcagctcctacttattattcctcctcatgagtccatggaaacagcctctctgggaagaaggcagagagcaggagacaggtcgtggtacagaaggaagtgactggcagaagtacatggatggcatctcagttcaatctctctttattattttggcataattcaaagttcatatctcacttcatctcaaaaacaatatgcatatctgtccttggcttcattttcctcctacctcttcagacatctcttctctggctcttccccttaacccctaactgggggctttctaccctgtctttgcacaccatttatcctctctataatgacaactcctaaatctaagaaatgggcacatttcccctgctaagctacagacctgtgtatttacgtacttcctagatattgccccatgcatggcccaccatcaccttaaattcaagatatccaaaacaattctccatcaaaaaaaaattctttatagccaaatggaagtgtgctgtaatgagaggcatggactttgattctagtgccaaattgtaggtcttaatgagcttgctgactgtgagcacgtcactgattctccctcatctcagagttttgccatctcataaacaggcttgacctcgattaatgggttttactccacaatccatggggccctttattctgtgggtccacctcagaagctgtccaaacatcaagagagaagtggccttggtccagtcctgggcaccccatctcccatcaccaagggccatctgtctttcatcttttcatatgttaaagttccatgaactatttcttctctgaagtagtcatccactaattcattgattcactgtgaatcatgaataagatcatgatcactcaggaaccctctaggtctagcattccgtgattcttcggttagtgctcacgcttctggaatgaaaagtacaaaggtacaggggcagcagctggagatgacagcacagtctgttgccatgtgtagttcatggcgcagggtcagggcagaaactccttaatattaaacttagtgtacagtaactctaatgcctgatatttgatttgcattaagcactgacaagaacctttcatgtctatttctgccctggggtcctaaaacataaattttaacattccttgcttctccttgatgatcattcccacatagaaatggaactgcattaataatgattgttgaaaaaatgaataaatgattgttgaatgaataaccgaatgaatgccaccagggaaaattattgtctccatttcattttagggcctgaactttaggagaataaagttatcctaaagagagctgttggaacctgcctttctaaccagcttcctattttctagaaaaggggtcactgtttgtaggaattgtctaggattcctgagaactgccatcaaacattcattttgcttttcctattgctaagcattatcagacagagacacagcttctacacaaaggaagatggtagggcattgtctgttcagggctgctagatcaatattatagttttatttatctattaatttatttggatttctaagcagctctaccttttgttacgatgattatatggcaaaatgcaaaacaacttgacaggactttgctatctagacttttgataatgatctctaaaagccaactcatttcatttgcgtccttttatgaataatacaaaaaaatccaaaccttaactagtgtttgtcacagtcagtgggtacttcatgagccaagagtgcatagaaaggtatttttggttcattactaggtttctataattgacctgacattttgtgagagcaatcatgtttgttaaggagaaactcaagccaatgctgtagttgcaaagttctccttactattaccctgggaaacaaattcatcagaagtgtgcagatgtgttttatgtgtgcgtacacacatacatccctatgcatacacaagcatgtacacacattggcatgggtcgacctgataaaatatatgcagtgttctctttgtccaaatccagctggtcatctagggactgtatagaaaatttgccagtgcctgcagccctactccatgtttccctttttctctgcagcttgagcctcaccttaaggcctaagtgagatatgcattctgtcccaaatgatggctcatggggacagaacatttctgagtcttcctttctgaccctctagttatatggcagtgattgcactgagggaaaaccaggaaataacaaaggaaactgcttaagcaagttgtgtttgggaagattagaaaagggagtgcacaggaggatgaagctgaagtctctgaggaggtaatcttgttcaaataatagcttttcttgtaaccatattttgtcaaattggttatttctgatgatgtatccccaattttctgaaatgttttaaaacttacattgtagctttctctcatttccttattcctatgttctcattctggtccatcatctgttcatttattcagtccattctttgtgtattcattcaattattctttcaagtgacatttactgataattaaaactgttaaaatcactgacgtcaaggtctatgagcaaaactgaaccaaaccaaaacaagaactaaactagaatccgttgtggcgggattgaccactaggtggtatgtccattctttggccttactggggatttaggcatttgttttggttatgtgccttgttaaatattcatcatgtcaaaatggtggtagtaacatgaacacaatcaagaaaatatgaagagagtgatataaattatatttggagctcagagaggggccaggaagactttacatgttggattgcttctgccttaggcagaaaagaagttgcagagcgttctaggaggagtgaaatacttgagtaggggctgggaagcaataaagcaagtggtattttcaagtttatgcatccacaagatcagtgttcaatatttaaaatgttcaatgtgtaaactctatcatggaaagatttttgaggaagtagcttgtaaaaagttgcatatttctatttgttgctagggttacctaaccaacaggttcttggctaagcaaaaaactacagtctgtaaattagatattctggaataaaaaatttggggaaagaggaaaaggactcatgctcccaagaaggccaagtgaaaagtgatatccttctgatagggaaagaagtcatgagtcattagtctggactgctatagtaatgataataatagtaagaataataatagccaccatttgtggatcacttactgcaaaccaggaactgtgttaaatccttctcatgtgcaagctgctcctttaacctgcgtggcaacccggggtgactagctgttagtatagcagttccttgcccaagtttctcagtatctttcagcctcagtttcctgttgggcaaaatagagattacgggacagtgggaacattaaatgaggctatgcttgttatgtggttagcatggtgtcaagcagggagtaacaggtcagtgagaattatagtattagctactattagcatttctccttcctcgttagtatttttccttccctgaggaggaaacagagaattaggaggaccaagctgaatataagcagtacctgagagcattcttggaagattatgctttcgtgagctcctcttagaactgaaaattgatgatgagagagacagactgtcaccaatgcatgactatcaccttgtcattattaaagcactttccactagtttatattattttattctcataagctctgtgagggccaggatttgggtcttctcttgtcccttgctacatcctcatctatatcagtggctggcacattatctttgttgacgactgacctttccttttcctctttctttgcctggcaaactgttacttgcccatcaggatccatggggacattgacgctcctccatcactctcacctccagtcctctcttcccacacaactcttagttcatacagtggtcacagtacctccatgctgtattgtatcctatctactctcctgtttgtctcttgctgcagactcctctaaggcagggaccacttttcaccacctttccatgcccctggatccttgttcagatttggcttgatgtacgcactttgaagatacttgaatgagtgaccacaaatatcttcatttgcatctgaacaattttcttgatatttgaacttcttacccaaacccccaagtccaaaggcccttgtcttgagcttacaggttttcaaagaatgctttacctgggtatagggcagctctcacatgcctgggaggaagccttggagcaaaaacaaatcgatggctctgaaagaattatgtcaacatttaattgcaagagatagctgctctgcccagagggcttccggaacaccttagcttttggtttaaagctcaattttaggtaactgatcaggtagaagctagtttgactaccgcagcttgcaaatgcaagctttggtaataacgccatagctttttttttgttttttttttttttggggacagagtctctctctgtctccaggctggagcgcagtggtgcgatcttggttcactgcaacctctgcagcggattcaagcgattatcctggctcagctttcggagtagctgggactataggcgtgtgccaccacgcccagctaggccagctaatttttgtatttttagtagagacagagtttcaccacgttacacaagatggtctcgatttcttgacctcgtgatccgcccgcctcggcctcccaaagtgctgagattacaggcgtgagtcaccgcacctggccgccacagcttcttaaaatgtcactatcaatccattctgaggctagaaatctctctggcaagtgtgtgaatgcaaaggtaatggctttacctttcaggttagttgtagataatctcatctttgttcatgaccggtgagtgccaagcccccagcattgagtatgtagtctccaagggacattttccttggaccaattgggaaaagacctggtcaaaattgaggaatgggcaatactcacctggtattttgagctataatttggttctttgagctatgagaaaaaaaagggacacgggctatgttgaagtaacaggaatttgagaagtaagggtgatgagaatctcagaaaacttgcaacagctggacatccaggtctcctggaaatgggaagttgattgaggaactggagggaaagttaaggtcctaactttagtgattgggtttctgtgtcaccaccttggcccaggagactgttgatacccccccccctttgctttgtctccccatttcttttagtgtctctttccagctgagcagtcttctgactcccactagttcaagtttctgagggagaagctgattgagcggagctgtgcattagacagcttatagatgggtgctcttaggtcacatgttcccagtgagccaatcagcagcctctagaggagaggtcacgcggcacagaatatggccgcctatgcttaaggcattacagagggcatcttcctctggaggggtagtaaatgtaggcactttcttctaaatgggctatgggtgtaacaggcattaggctgcttctattttatcagaggatggggccatgattagcccaatgaacatttactaatcattgaaatttaagcatggcagcctggtgtgtaaccattgtttgagttagcatacttcagttttcccctgttgatttagtctcatgtaaatctctgaagcctcggccagtcttttcttaaatacacgtaacagctaccataattctctttctgctagtcctttggtccacctaagttcacctagtcaaggtagacagtctgcagccactatccttcttcactttctaagggctttctcagcattgggggcttattaagcagcaagcaagtcagtcctgtaaatgtggggaagctggctccctggggtctctcttaactgttgagagtcagtggataaatggcccggcttcctgtgagacaattgtgagtcaggttccacacagctccttagagtgtccccactgggagtgagcagaaacctgatttttaatataaactttatttgtgtatctcccttctctgcctcatttttcacacctcctcacttgtacttcccaaatatattctctgctccaaaatccttgcctcaggctttgcttttgggattattcaaactgagacaataaaatactacacccattttagggaagatcaggagctaacagtgtagggaccaatgcattatggtcttcatctaaatgaagtctgtttctaatatactgaatgtttctgtaaggcaaaaactcataggtaattggttaaataggggattgtatattaatatgtagtaatatatacatatatgtatatgtataatataacatgaatataatatacatatgtatacacatatataatatatatgtataatataacataaaaatgactttggtccatatgcagtattccatagaaaattgatattttgccttaacaagaagcggcaattaaaggaatgtatactaatatagctgaatgcagcacacctcaaaagaatagagaatggtctatagaattcaaataggttctgcctcttgactcacttgccaaatcctctgtcttagaagtgcttattgagtaattctcccctatcctgacgcactgcgcctctgttgccataattcagcagattcaccctttccttataacccgtctaccaagccccaatccacattttttaaagggaaagccttatatttactgtaagttttcatttatcaacaatttatgtcttctcaaacacaccaggtttaaaaattatgattataattattatttgcaataattatgtgattacaaagttgcaaagatctggagcattctactctaatcttgtcttttccaaaatccttatgattttattgcacaattttcctaagcatagagtttttctggaacacaaatattttccagaacacctatttcagggctgctccacacataggcatatctgtgccagttagacataagcacccggctcattgcgggtacttactgagggggtagaaggaacatagtaccgcccccgcaaaaatgcaattagcctgttatcaaaataacagggagagatgaattcttatctttttgctggaaggtcggaagaggcattgggcttaggaagtggccacatcatagtcatttgatacactgtcatttgcatctagtgtaaaattcaccattgtttatcttatgattttatgagtagagaccaactgaaaaattttgtacttttattaatattatggcattacaacaccttactttaggagattcatagtttggaccctgtttacaaaaatgtaccagttatatggtatttattgagtgtctttactgcatactaggaatcatacaagagggaaacagaagttatttctatatgactctgatagcacctgtatttgtcccttttgtgttgctataaaggaatacctgaggccgcgtaatatttacagaaacgaggtttatttggcttacggttctgcaggctgtacaagaagcatggtgccagcatctgtttctggtgagggcctcaggcagtttacaatcatggtgtaaggtgaagggggagcaggcatgtcacatggtgagagagagagcaagagagaggaggaagtgccaggcccttttcaacaatcagatcttgcagtaactaatagagggagaactcactcatgatcgcagggttggcaggaagccattcaggagggatctacccccataagccaaatatctcccaccagcctccacctccaactctggggttcacatttctttctttctttttttttttttttttttttttttttttggagtctcactctgtcacccagactggagtgcagtggcatgatcttagctcactgcaacctctgccttccaggttcaagtgaatctcctgcctcatcctcccaagtaactgggagtacaggcatgtgctaccacacctggccaatttttgtatttttgacggggtttcaccatattggccaggctggtcttgaactcctgacctcaggtgatctgccctcctcggcctcccaaagtgctgggattacagacgtgagccgccatgcccggcacatttcaacacatgagatttggaggtgacaaatatccaaatcatgtcacaaccagtaggataaatactacttatttttcattcctcagatgagaacatttagtcacagagtgtggggcagccagccaacttctgatgttcagagtcagtgctgtctaaacttagctttcatgttctttctacctcagaaggctacttctcaatcaattatttgggatcagttggtttcatcacatggcattgcatcatgaatatgctgaacaaggccaagggaaggcaacaattaactggcagtttgtaggcttgtgattagatataattaaaagtcacataaagttccaaaaaatatttttcacttgtttcatatctcaacaacttccacttgtttaagttagtgtttttccaagttgcattgtgatgaggagaatttgacatatttttgagggctaagagtgagaatgattcaaagctgtgagatttgaagtgatgtctaaaagatttttttatcatgacttatgattttttatacacacacacagacacatacacacacatcctagtaggaaaaatatcaaaatataataactttagataataagaaaaatggtttctgtttacactgagttttcacaggtgagatatgcattaaaggcacaaaagctaaaagacaaagagaaatggcaatttaagcacttgaaagccttgctgaattttttacagactgtgtcaagtggagctggaaagtgaaaccacaaatcggaagctagaaaggaagcagctaggcaagagagagtaccttggactgctggctgcagtccccttcttttcccccaagtgacctgcacatcggacttcaccctgctactctctcttcccaaagatgaaatgaagaggttgaatgtaatgattactaagattctctttctgctcccacgatgatctgatgctgaggatttttaagacttctgtgccgttagaattgattacttctaaattgttatctactattcataaaaagaaaattattcaagcttgtacttcttggcacaaaatatacctgtgattttctaaaatattatctcttaatgcacaaagttctcaagtgctgtagctaaagggagctaccacagagtattaatagaaaatgtatgtgagaggatgttatttaataaacccctaagtcagtaattctaatgattcaaaatgactttaactttctactaattagaagccagactctcagctttgcttcttgatctgcacttctccccatcttggtgttcttggtgatggtcatgttcctggctgggtcactgcttccatgactgtttattaaaatcccctggccaaacagtgggcgtactggacttcctggaggggttccctggaatgccttgagcaaaacttgggtgccaaaagcaaagacctgctgtgttggagaaagaggaagagaagagttctgctgtctttgcatgtgtttggaaatgtctttctcatcaacagattctcatgcttggggatgccaggggtggtttgggtgggcactctcttcattaatagccattattgtggagtccttaaagtggattaatgatgttttttaggaaagataattatctcctatgctttccgggaggtacatgaactgctctaagattgcaagtacaaaacaggacattcgtggtgctactgtgtgaaaaaataaccagcagtaccttgacatttatagattttatataagcatgtgagtatggaccttgggcctcaccagccccagaacaccccaggcgtccttgtaccgcagggcctttgtatgtgctgctcttgctgcttgacctgccccacccagtatctgtaagccttgctctttctttcaattagaatctttacttaaacatcctctttttgcacaggttaccctacataaatcaacgtgcctcctgtctcctatcactctctgtccctttatcctgctttgctttttcttcacagcacttatttcctgacacagtaaatcatttataagttgcttattttccacctcctcctctggaatacatgctctgtgaatacaggctctctgcttgtcttggtctctgtttaattcctaatcctggcagagcacctgtgacatagtgaacactcaacaactgtttgctgaatgaaagaaaaaatgaaaaggttcacatggagatgagagccactggccaacaatttcagtcaaaacatattatttacttaaaaatgcaatgtctgcatatatttgacaatgataatttattgaaaacaacaacagtgaatacatgagttgatatctgtcttttcaatagatatataatgagcctctggattttatttttatttttattactcacgtattttttgaaacagagtctcactattatcacccaggctggagcacagtgtgcgatcacagctcactgcagcctcctctgcccaggctcaggtgatcctcccacctcagcctccccagtagctgggactataggtgcacaccaccacgcccaggtaattttttgtagatagggttttgccatgttgtccaagctggtcttgaactcctgggctcaagcaatccatcttccttggcctccaaaagtgctgggattacgggtgtgagccactgtgcctggccatccctggatttgaaaaggaaaggggtagagtgacaaggactggttgcatctcacattccaaactgcttgttttagtatgcgctaatgcatcaaccttttattactgcccagaccgtagacctggcttgttccttttcacatgttattctcaccagaagctacaaagtaggtgttatttgtattattattgctgttgttgttgttagaatacatattcctcatttacagacaagtacacaggctaagcatgactgcaacttttgaattgtcatgcagctcagaactgggggatctagaaactgaattcagcagctgattatttggttcccaataccatggtcttgctacttacctactagaaaggattctcatttgtctatttaagttcttctcctctactctctgaggaggattctttcagctcttagtgaaataaaactagaaatggaaagggaagtctcaaatctatgttcagaagagggaagaggtttaacctgggggtgggagggaagcagatagatgtgctagcagagcaagcagtttgagatctaatatacagccttagtgggattaaaaatatgaggtataatttgtgttcatttattctacagatgtattttgagaacatagtgaaggcatgatgcctggcccacagtaggtgctcaataaacgtgtgttgaataatacatgaaggacacgaataaatgtgtgttgaataatgaatgaaagacacaaattcaggaggtaattttgtttgctggtttgtgtccctttatctctttatcttgtgatgtggaaccacactcacagagtcccttcatcttcattcatttcattcattcttttttttttttttttgagatggagtttcactcttgtcatccagtctggagtgcaatgttgtaatcttggctcactgaaacctctgcctcccaggttcaagcgattctcctgcctcagcctcccgagtagctgaaactacagacgtgtgccactatgcctggctaatttcttgtatttttagtagaaacagggtttcaccatgttggccaggcaggtctcaaactcctgacctcagatgatctgcctaccttggcctcccaaagtgcactgccttcattcattcttaaatcattcatttctttgtggaagccccttagctccatgtagtttatggatgtgtcagaacaaactgaatattgtttattcttttactttttaaagagatgagtatttgagtcctctgattcacagtgaatttcagaattctatcagctaaatacctcttgaagctccgattaccaagactataagcccttctacagcattaagggattgctcgtaaagatactgctattatgcatctggtgtaaagcctcctcatctttagctcaattcaacaagtttccattcagtgcccagctctaaaagtcttaaatggaaattgattccctactccttctattttaactgtcaaaatcatagactgcattgtttccaactgaaaatccgctgacagctccccaccaaccaccccgtgagccttcctagggctggcgttgatgatgctgctatcaatggggaatctacattgtgcacgggtatttatgatgagaaaatcatgtggcataaaagagaataattgccttcataagtgtataattttttatactataagcttctcaatgaaaaagcattctaagggaggcataattgctaattttcggtgttaaacatacctctgaagagtatttcacagtctaactctctgagtgtcatgtcttcctgtggcccggggaagagagtgggaaggaaataaaatttcattgagcatctacataggaccaggccctgtaagttcttggatattggtttcttcttataatgacttgagaattacatggaattatccccattatatgagaagacagagtctcacaggagttaaatcacttctcataaaatcatctctcatagttatgtgagttcagaatgcacgtctatgctaccccaaagtccaagcttaatagagaaatctacagcaactctttatattctggagaggttttattactaagcttaagaattgaggtgccctaagaacgggctgcccccaaaatattttcctcaccacctcacttctgtttccagaagcccaacatgaaaatcactcttctgaaataagtcctggagtcttctttaggcttctgctaaaaagtcttattcgtgagatgtctagcgtaacttctttttttaagtcaaggaaaatgtgtagaatttaggtcaagatgcactgagaataatttgcaaaacccgtaaatccgtagctgatatatttaacaccaggtccaaactgtttctgaaggattgaatctcttgcctgaatactgaagaaaatggaggcatgatctgaggttggggaatattctaccttgccaaggataactgtagagtattgtgacaaagtgcaaagatgccacatggattctggatcagtcagacctgggttggaatcctgattctgccagtacacctttctgcctggttagcttggaacaaagcagttaatctattgagcttcattatctctctcctgaggctcttgtgaggactaaatgagacaatacctaatgcttcatacagagacagtggtcactctatcataataataggagccctcattgtttatgtctttaccatatatcattatccaatatattcctttatatcattatccaaataaatacatctgatcaaatcccccaaattgctttcttctcagcattcctcggtgcaaaatatgagatgtcctttgactatataatataaaatatactataacatataatattgaccttatattgaagatgtatttgtacccgacatacaatatttttagaaataatgtttcattataaaattttttacacgtacagaaaagtttaattttgcagtgagcactcatgtacccaccacctagattctaccgttaccatttaatccacgcattttaccacctatctttccttctgtgtgtctcccgtccatccactaatctacctcatgttttcgattggacacatttcaaaataaattgtagatatgctctccctctaaatacttcagcatgcatatttttcagtagagttcaatatttgcttacatattgtttctcttttgatgtaaaatttacacacagtgaaatgcataaatcttaagtgtgtattctgagttctaacaaatacacacatctgtgtaacccaaagcattgccaaaatgcagaattactgcagaaagttccctcaagcctcttccgagtcaattctgactcctaccacagcaaaagtaaccattgctctgattgttttctatcttggattagttttatctgttctagaacttgatataaatagaatcatgcagcacatactcttttatgtaaggcttccttgactcaacatgttgtttttaggatccttgcatgttgttgcaccgatgtgctttctgaatcgggaaaaacaaatatttttgtgtttgtagaagtctagcttaccctgatgccagatttaaattccctgtgccaaacacattgtgtgctcctggtccctgccccctttaacttccccagcatagtgcctttgttcatgttctttctttccatcactccctggactctggctgttcatattctgcccttcctctggagatcagctccaatcccaaacttttccaaagtctgcattgactcccttgggtttctgcctgagctctctctcctttggacactggactgccatcccattaactgttgatgttgtcatcagtgatcagctcctggtcataaactaaggaagagttaggtgggagcactggcactgagggtccatgtgctcacttagctttccagggaggggctagaccacaggtactcttcaccccacgagccaaaaggagtggatctagagtgaccattgcaaggcctcaaagagaaacgaagagtgaggagtgatggggaaagagccaaggggaccatccctgagtcatgggcgtgccttgggttgaggctaaaggttcaagagggaggagtaaagaagggaaggaaactgtcaggagtgattgctgtcatgtggaagaagcctaaacatgaagtcatgagagacgcaccttgtggctggtgggaatgctacacaatcatgcaacatgtgcctaattttctcaactaaattgcaagctgatgtcttactattgacaggaataaagtttcataaggtgttccctgcagtggcctgactgtgcaaggtgctgatagatacctgctagttgataatgatgcctctcacatggccagtcattttagcaattagtttcattgatattgtgggactgggcttattggagatttgactgaattgaccatttcagccactacagcctttgcagaatttgtgtctgtcaacctggccttcccaaggaaatggaggttaggcaataaggaatgtgttcattttattgccattttactaccacagcatggtagattccagctattaatcctcatggtataaggtgctttttatatcttcaaaaatagggtatagccttgatctctcttcttgctgctctggaattaaaatagaaatctttatccctatctcaaaatctttggggcaggttaggagagctgggcttcaggatcatccagcctagtgcttaggtctgtttacagctcagcaacatttccattggttgagggatattgttcagcagccactgaacatcaggctctgacctcttgtttctttgctgtctaacccagcagaccatcctcggttaatacttactctgattcagcctagcaaagaagatcagaagcaattctgtgtccgcaggctccctttcacacctttaatattttgtattttgcaaacattttgagttagttagcaggtctcttgctttctcttgagggctgggcacaaatgttcaagaataatcattgtaatggcatctctctgattaaaaagacagctggcaagattgagatagaacatcaaattctgaaacatcattagcaggattctattttggttaggtataatcttctgtgaggtcatcatgttgtcttcgatgagtctaaccattttatatcatttagatctaaacagacccatcatgtcacaggcaaatggctttatcatatttaattaacccaacaccatgtaataatctccctggtaattatccctcactagtgcttgaaagcgtgctgcaacaaataaatcatcaaagttgcaggtatacttaaactgttatttggtgccgtggcagaagaatattgacaagtcacagtgcaatcctaattatactaagaaaatgtaaatggcttcatcaaaaaaagaaagagccagatggcaggttttatatactgtatcctcctgtgttagaaaatggggtattaaaaaggcttcatgccctcagcatcagggaagaagaagaaataaaggctgatacctctgtctttatggaggccacgttgaacctctaattctggagaatggtaacattgaagaggacattagtggccattgacgtttatgtctcctgatgccaccctacatataagtgaatgaatattaccaggatgaatgctacttttcttatgataggaattgattgaggaggataggagcaattccatgatgccctagattttactttatgtttgcaaatgacaaattattcacagaaagacatgtgcccaccaggtggtgaatcaatgtgtttccattgacctggcttttctaatgcatcagcaagaacacatttaccggaatgcattgcaattaaaaagcaaaattcagttggaaacaatggacttaaacctacgaaatgtgacaggataagtcagagaggaaatttgatttcaatggtgagattaacgagcccatgaatgcatggtgcatacggcacagacaaagataactgaattggattttcaataagcatagagttctagatttccctgttcttgaattgtgtaccgtaccacccagctgctgtccccagctaattttgccagagctggatgtcagccaaagcacaactgtctatggcttgggaagttctcctttgagtcagattatttagttagctcaggctggtaactgccacagaacctggctgtgatttggtcttattagaaaacaaatttggaaagtattagagaatagtgttcgaatagtaatgttttcccttgctttccttaatatttcctttgtgtgagtgtgtgtttttgtgcacattgcactgttgttacccaaccaatcagaaattctgtttattataaaagtaattctccttaattagagaaaatttggaacgtaaaaaaggaaaaggaagaaaattgctcaaagtttgcagtccaattataatggttcttgaccgtttagttatttagtctttttcctttatgcatacattttgaaattgttggtttagtttttttatagtttgactcatcaaaaatcatatattcactatcctgcttaaaaaatcatcataagtttaatctatatagttacatattcaatcattatgctttgagttatattgacattccatagacagatgtcatttcatgatttttaagcagtcaattttcaattactgcataatattcttccatttggagatacatattttagttcagtattattgtggcacacttattttctatatttcctttttttctggagacagagtctcagtctgttgcccaagctggagtgcagtggcgtgatctcggctcactgcaacctccgcctcccaagttcaagcaattcgcctgcctcagcctcccgagtagctgggactaaaagcgcacactgccatgcccggctaatgttttgtattttagtagagatggggtttcaccacattgcccaggctggtcttgaactactaagctctgagctcaggcaatccccccgcttcggcctcccaaagtgctaggattacagccgtgagccaacacacctggcccaatagttccaattttttatgtgtatatttttaaaaaattaagttgtgactttagcgtgaattgaaatttgtttgactatacttcataaacccttttatattgttttataattttttgcaaacataatttttaacaatgcataacttgtttatcacaagtcagacccagaatatttagctcttcctttgtgttcattcactgaaatcaaggtgctttccagttttttacaatgataaataatactttgacttatcaattaattaaaatgtgttatatgtcaattatatacagagcactgggctaaactggttatctgtgtacataaactttccaagtttgggattgtctgcttagaaaggatatattaaattggtaccattggacccaatatgactggtgtttgtaagggtctaggtagaggctgcttgatagcatttgtaaagggcaattaatctattctgccgtcagcattacagctcgcttcaccacacctgtgcactcaacgactcttcctccccgaaagtggagacagtgaggcaaaggacatggagaaacggaggctcggagagtttcagtaactttccccagtccaccagcttgtatcggaattgggatttgagctcaggtctgtccagctttagaatgcaaactcttaagtgctgccttaagtttgcttccccagaagaaggtcctgggatgagaatttgtgttaaagtgatgtatcggaaaggttgctaggaaaaacgtatagggaagtgggaactgagtttggcaagagggagactgagcaagggtgtcatctcaagcgaagttccattgagataactttggcctcatcttccagggagactgggaatgatgtgatttgcacttcagtgctggcccctttggggcaaggcaacttgagtatttataactcttgacccacaagtccttggttaaaggctgctgggatagtgggcaggcaggggcacaagttgtcagatgcttctgtacttcatgtgttacagacaaagcagatccactagatgcagccttttggaaaaagacacagatgcccttgatgtgctggtgtcggttagcaatggcttggaagagctggatgttaaattgttaggaattttgcaatctggttgaccccactgacagcttgaaatcagccatggtgagagtatctacaccatggaaattggccaacattacaaattagggctcccttccctccacccagaagtgttcagtaaatatttactggcatactaccggagctgctggcctttgggaatggaagcatactgggggtccgtgtgcactaaaatggcaaagaaaatctaggggatgtggatggtgcagggacagcatctactgcagcactcatgtataccagctgcaatatggtaggaaacctgcccctgcccacacaggctaggcagaggtgtgtgagaaaaagggaactggtgagagggaggggaacatgctggatttcagagcaaggtctctcaacctgaggtggcctgggtatgagacatgctacgcagaaaaaaacctagaaataactgagattaaaatagctaactaagctactgaatacttgcactgccaggcactgagctagatgctttactttggctaatcttcataggagccctaggaggtagatttcatcatcatcatcctcactctaactattattatcatctttgtcatccttcttctacagatgataaaattgagatttagagaagtaaagtaatatgtctaacatcatagtgggatggctgagctctgaacccattcaatctgactccaaatgcaaagattgaataactttgacagaataggtcccacttcctatggactgagtacacatggttgtgggggcataggttgcttcagtggccatcaggatgacctgggagtaacctaattttacgtgattataggcttaaccatctggttatcaggaaaaaaaaccatgtagagagcgcacgagagcccagaatcagtagctgggcctcctggtgtggaaaggatagaactcaaatctcatcgagggatggaagtctggatacactcctttcatctctcagaatcagctccaggctggcccaaaacaaatgatacagaggctgagaaaggcagagcaaacctgggacatggggctgagccagcagaatcattagcagtcaggctgtgtgaatttttttgtggtaagagagataaatgtccctcttgttctttgtggtttcctttgccataagagccactgctttgtgaaagttcttctttcctttctctggcttgcccatccctggattgatgtagtagccagcagcaaggacatatgaagggtctggaagtggaaggctgccacccctgccctgctcccacttctgggcccccagggatcccctgacataaacagtcctgcaggaggaaataataggtggacttgtccctgtgacacagtggaggtaggtctggaagtttcctttgaacattaggtaggtctcagctttgtatttcaggtgcttttatcatgtgttttatcctgtaacagtacattctagagctacctttcaagtgtcatcaatctccaattcattttatattttcctctatgtatgtacatttgtatgtatgtgtgttcagttaccattatgaagtaactgacctgaagcaaactgaaaataaatcttgccttatgttgccaacattgcatttttttttctttttcttaatttatctgtgaatattgtttttcttcttcttcttctttttttttttaaatggagtttcacactgtcacccaggctggagtgcaattgcgcgatctcagctcactgcaacctccgcctcccgggttcaagcaattctcctgcttcagcctcccaagtagctgggattacagccacccaccaccacccctggctgattttttgtgtttttgggagagacagggtttcactatgttggccaggctggtctcaatctcctgacctcgtgatccacctgccttggcctcccaaagtgctgggactacaggagtaagacaccgtgcccggccagtattgttcttctttatacctaattactcatcattggaattctctttaaaaaaaaaatgtgcttccctaattggttgccaacagagaggctacatcatagtggttaagaatataggctcttttcccttgactgaagcagtgattaaaacaaaaaaataagaaagaatataggctctggtgtcatactgcctgggttggagacccagctcttcaatttacatctgtatgacttcagttcatttttttttttttttcatttctacatggcttggtttccccatctgtaaattgtggatacttacactagctatctcataggttattgtgagaaataagtgagtctgtatgtatgaagcccatagaaatatacataacatagaggaagcactacctagtgtcagggtctaccactgtgtattctttaggaggtttcaatcttgaccttcagaaaaagaattatttcattcaacaagcatttattgaaaatttccttggtgctcatctctgtgccatgtcctttcatatagattttatctgacataacttaattcttaccatcaccctgtgttaaagttatggtgttcattttctagggtttaagttctggaaatgctgtgtgctcactgtatccaccaggataggtgaggctctgctgcattcatgaacagtcacagatctcagagcctgtgagcgggtttaattctccttcatgagaagccccctggtcagggtgtgttcctgcacctggtggggcagcatggtgggctatcccctcctatggctcctctgttaccaaacaagctcttcctatagctgcagctgaggaataaaaatgctggagaatcttggcggttaaatgctttgacttggaaataaaatggatcagttctacctgcagcccaggagcaagattgggttgcagactctacctaatggccctagagactgtaatcctcccacgtgctggaaggagagtagaatagggtatggtgaacaggagatgtctctaccactcacttgggactgtgagcacctgtctatacctcggctgtcttatctgtgaaatgaggatgacagctgtacctactgcatatagttgtgatagagtgaatagataaatgcatgtaaagctcttagcacactatatggcactcagaacatagtcaaaatggggtcactgtaatcatgatatacaagaaagtcagcggagcctcctaatacagtaaagtaaccattgttttgaatagtcacgtgtggatatcaagtccagttatattacttaccagctgtatgtatgagcatggggaagttatttaccttctctgacttttacttttctcttacgtaaaatggtgtgggatcacactcaccccataggctgcatcaagggttaaatcgctaacatttactgacaccttggaaagatgagctaagcgtttaaaacctgttggctcatttatgtctatgtcaatgctatgggaaaggtactctgttatcccccattttatagcagaggaaactaagcctcagagaggttaagtaatgtacccaggcctctctaactgctaagtggtagagcaaaaagtgaaacccaggcattttgtcttctcaattaatgatcttaatacgcattacagcctccctgagatcagttgggtaaagctctgagcacagggccaggcacagtgtacacccttgcaaaaatattaatttgcctgggtgcaaggtgagggacatatccttttcctattctgaaactctactctgcttaggatgcatactgatggctctttttttgtgaatggatggaagtatgaaaggagcagtaagaaagggcactatcaggctgcatgcagtggctcacatctggaatcccagcactttggaaagctgaggccagcagatcacttgaggccaggagttcaagaccagtctggccaatgtggcaaaacactctctctcctaaaaatacaaaaattagctgaggacagtggtgcatgcctataatcccagctacttgggtgggtgaggcatgagaatcgcttgaacccaggaggcagaggttgcagtgagccgtgattgtgccactgcattccagcttgggtaacagagcaagactgttgaagaaaggaaggaagggatgaaggaaggaaggaagggattaagggagggagggagggaggagagggaagaaaaagaaggaaggaaggaaagaaggagagaaaagagaaaagaaaagaaaaggcactatctatgccatatgcttttgtgagactatcaaggcctgcatgcaaaaaaacccagtgcagagttggtggtcaattagctggagtgctttattatttttaataatcagccatgcttagtgggagtctctgaatctgtagttatgactgtagtaaatgggacacaaagggagcagctggacataccggcaagtattataatgtgcagacaacctgcaaatatgaaccttcttttcaaataagaatctcagtgctgtcactatttgttttaggaagtgctggttttaactgaatgaggaagttaaacgcatgttctgttttttgttttcattgcgcccacatgggttgactgtgggttcggttttctctccagattgaacacttagtacttaatgggggaaccaccttggaaaagcagaactgatttgaggtggcttcatccctctcttctcccaccagaaagagatgggagcttccacttcaacctggggtgaagacagagaacaaggtgtcccagcattttgcacagaaccaaagccctggaaattctggtggaagctagacattcagagtcatcaagctaacagtcacttcctgctatgtgccagatactatgcttttcacagacatctcatttacatttcccagaacatcaggttggagtgcagtgacgtgatgcaatcatagtttcctgcagccttgaacttctgagttcaaatgatccttctgcctcagcctcccaggtagctaggactacagacatacactaccacacctggctgagtttgtttgtttgtttgtgtgtttgtttgtttattttgtagcaatagcatttcactgtgttacccagagtggtctccaactcctggcctcaagcaatcctctcgcctccactttccaaagtgctaggattacaggcacgagccactgtgcccaaaagttaagattcttgtagctgctttatagaagatgaactgaggatcaagaaggtgagacttgatgtgagtcagatagtgaatatgctatagaaaactaaacccagttcctttggggacttggaatttggcatcaatattgtcaccgggctttaattttgcttaactccacactgtggtctttgtgaatggtgcctccaagagttgtgcccctgggtgggcctgagctgaaacatcaggtagatgcaataggccttgtcttttgtgacagttctgtaccatcgtctataatatatctgtattagtaatctatggttatacaacaaatcaccccaaaacttagcagcttaaaaccatatttattattccacaatttctgtgcagcaagaatatgggtgcagcttagctgggtctttgggccataatcaaggctaaaatcaaggtgtcaactgaggcagcagtcatcctaagacttgactgggcatgggttggctcctgagctcattcatgggattgctggcaggattctgctttttcaggctgctggactgagggctttgcttccttgctggctattggatggaagaaccctttaattccttgccttttggacagctccagagggaagctcacaacaggacaacttgattcgtcagagaaaataggtgagaagagccagaaagccagagggccaagaaaacagaagccacagtttttgataacagtcatagaagagatgccctgacacttttgttgccttctatgctttagaagcgagtcagtaagtccaccccaccctcagtggaggggattacacaaggacatgcatatgaggaggcagggttcactgggagccagccactgcctactacaagaaccgtgattattttaacgcaaaatgatgggtcaaattccttttattgggtagaattgtccctccagaaaaatctcttttgtcttgaatattcatgcatgctctggtacctctctttctgtgataaggacgttccagtttgaaaaacctgagtttattagtcaaattgtgctggtgtagaaatattccctctctttcaaataactttgcatccacctgctttgactcatgatgttgaatctaattttattacagagttttggatggtgggggcatttccacgttgctgctatgtactttctatacaaataagtgttgacctttgaagtagtctccctggaatagaaggttttaaactcattgatgatgcaaactttgcttaagaccttgttgtagcttctctttgggaatggcctttggaatcacgaccagaaaaaaaaaaaaaaaaaaaaaaaggtctgctttatctattctcactacacagcatttattagatatggctgccagggagatatctccttcctcactgattgttattctatgcattttcttcctaaaactagtagatttgaactcatacctatctagagccctcattatgaacaacagctttaaagcacgcaaggcactaggaacccctatttaatcatttacagaaaaaacatggcaaagaccaccacctccttccttaattccatggtggatttaaaatgcttagattagctgagtcttaggaactgaagtatccttggtgtttcatttgtgataattttaaatacaagtgttggtctgaagaaaggaaatgatcaggaattagccctggagcctgctgtgtatattaaatcaatctcagatggaagaattgagatcccggaaagcaaagaaatggctggacttagagaggaaagataatctagaagtgtaaagttagggtgggagggagaagggtaaagcttgagtaatgagtccactgaaaactattttttaaatgtaataaatacgtaagtagcagttactgtatgctagatatccttctaagtgcttgacaaatttactccttagaagctaagtactattttccccattttctagatgagaaaaccgaggtgtagggaagttgagggacatgtccaagatcacacagatagtaggcagtccagcttcagaatctgtggtctctaccagtgcactttgccacttcacagaactatccagccagaaagagcagaggccgctttgagaatttctgtgcaggtccaagcgtccacttaaatcagggctcctaacacagcagttctccaatgtcctgtagaaaacattcttgttcccttgggacaagagaaatctgaactcagttgtgcaaaaaagagggtctgggaatgaaccaagagggatggtcagtggctccaaggggcggagcgggagaaggcaaaggagaggggccaggagagaatgccaggaaaaaccagaagaaagatttaaacaaacctcataatttacctgtaaccgacagctctccttggatagtttatctgggcactctattccaccagaaccagattgttggagttgtttcaacagaggaatgcagagcttaagtgtgtctgtgctgtgtgaatatacctttgtgtatctgtgtagcaggtagtggtagaaagattttggaagtcgagggagatgactgaagtagagggaaaggtgggaggtcatggctctcatagtattttgtcacgaggtaactttgacaacccctgagaatcgatcagtcccccaagaagtcaaatacatctgcacatgtgtatcatgttactgcatcttaccttgacaggcgcactttaggggatgcagtctctgcccttttgtgccaggagcaaatccattttgcccatgatttcaggtacacaggtgatttcgccaaacaaaacaagcacagctgaaatctgtgacttaaatcaagcaacggtgtctgcaatagtctcattgcagagacttctgctcccttgttgcttgtaggaatgggggtggggaaaggtcaggactatatatttaagaaaaaaaccccacatatgtcgacccacaagtggttacaacaacattggtttacttgaaagctctgtctccactctccctacaaaaattcaagtaagaacctggaatgcaaggaggtggaagagttttctctccttgccaatctctcccttgctctctgataaaaggtgcggcaaacagggtagaaatgactgcacgggaccagaggatgtaaatattcagtcatgacagtccccataggataaatgacagcagcccatgcaatgtgccttctgcacattttcaactgactcttcccctctgcagccaagttgacatattagtaaattgattccaggtgatgctgacattttgtaattatcactatctataattttcatcttatcccatttaatattttgatcatttaaaatagagtagcatacctaatagtggtcattagtttagctcaagggaagattcatggtttaataaacttacattagaaataacttactaaaattacaattggcatgattagctacttttttaaataaaacataacagagtgactttacccatgctgacagcttttttctttcacgctggttcattgttctattgttgtcttggaggaagaaaagacatgtataacacagaagttgtaataaaaactgtaataacccgatacacaaaaacaagggttatatttcattctacatttgacagtagctgagtagtgtactttttcttgttttctgactggactggagggaggaaatcactgtgactttgaatcagggtcacatttggggtagctgtcctcttctcctgctgtctggagagactgtgaggttgcctgaaaggcagtgggatttaggcttgacttccttatttccctaggcattgattttttttaagtgtatcttctgaagtttgcctctaggttcacttgaggtatcatttctgaagaataaaagtggcagttttaatatgcaggcaattttttaaaacaatgaaatagagatgtgattattgccagggcaaggctgtttagttgccacagggaaacattataccaattggcctatagcttgaaattacagcattctctatattcgtccagctttagggaaatgcagaccacaagggtcctgcctaccgttctgcttgctggtggttcaggttttgtgaacttatacaagggcttggtatttgaatgctatcttaatgagaataagcttttttgttgtgtacattggcaacttgatggctaaggtcattctccatccatttgtctagctacccacacacctatacatccatctacccatctgtccacccactcacccatctattcacctatccatccacccagctatttatctatcatccatccatccacccacctacccacttattcaccaatccacctattaatctatccatctacccatccattcagctattcatctacctatcagtccatctatctattcaacctttcacatatccacccacttacctcccctctcatccatcaatatagccttgtatccatccacgtaaccactcatccttaaacaaaaatcagttggcaaaactgtaagcattggtaataaagagacatataagtcgcagttctgtccttaaagagcttaggatctagtacgggagtatatgtaaaccaaaaattacacaacagtgtgctcagtgcacctacagagaactgtgccgtgttgctgtgggaactctaaagaaagaatggtttactgtgtctgaaggattcaaagaaggaggcacacatgtgaacctaaatgtcatatgtggtaaaagaggaagtaaccagccaggggtgaggaacacaacagcaggaaattaagtagctgatgaatattcagacttgaagttcctcctaaagtgcccatttgttgtttggtagaaatatggatatgtaggagggggcctctaccagggtgcagaacatatggtggtattattagggcaccaggcaggagctgaagtaggggctcagaaagccaatcacaagaaccaggattcagggtgggcctgtggttttgaatggaagaaaggagaaaagagtaaacaaatgggctgggcacaatggctcacgcctgtaatcccagcactttgggaggctgaggtgggtggatcacgaggtcaggagttggagaccagcctggccaacatggtgaaactctgtctttactaaaaatacaaacattagccaggcaagtgcctgtaatcctagctactggggaggctgaggcaggagagtcacttgaactcgggaggcggaggttgcagtgagccaagatcgtaccactgcactccagcctgggcgacagtgccagactccatctcaaaaaaaaaaaaaaataataataaacaaatggatgcatgaacaagtgcataataggtagataaatacaccttaggagacagatcaaaatgcagacttgaatttaattggcacagacacttaattatgcatcttgacatctttgaccaaaaacaaaatgccaagaacaaaagcagcttcacgaccaagcacatgctggaatccggccttctgtctgccttactcccgctgctggtgaagctgcaggaatcctgacaggagcaggctgcctttcagctccaagttcctggcactaagttctgcgcaggggcctgggcgaggtctttatgactttccagaggcttccaggtctctattgaaatgcaacagctgttactaggggcaactctacttcccaaacaagaacatagactttgtggagctttcccaggtgctgtgaacccagcattgccaaacaatgcctgggacccacagcgtctccttcccccatggagtttaaatagattggaagcaaatgcttgttgacaacaggtgtggctcaatgtgagcaaacgttccattccgttattgcagggttggcaccgagggacatttcctgtgaaagaaacaggcttccaggagcatgggcaatccatactcatagccagacctgctcagctcctccccttcagggccaaagaccgcaaagctccgtgaacaggtgctcctaataaatgcagagttttccatagcccaagcaaggctagcagggaggggaggggtccctggccacaaagctccaaccagccaactgatcaggctttctgcgatgatggaagtggctgcatcatcattaactcagctagattaacctgttcagcagaagcttgcagagctgcgtgagcctgccttccactcagcttgaattaaagagattgggctgcaaggacacagagaggtgagccccaggaggtggggtcccagtcctgagattagtgacagcagccctgaggatgtagagaaaaacttcttactcctttgaaaaatgtgtgcagtgattcttttcctccctgagctgtcttggagccaaagtaagttcttcacggaactaaatggagttgcttgttcaatgagattctaatttcagtgagaggacttctcggctacatatgtattgctttgggaagtcctcccttccgaggcaagggcttctccacacctaggatttgatgtagaattactagggcagtatgtaaggacagagaaagaacagaggcagcggcaggcttctgacaagggaatactggtaatcaggctctctgcataatttttggagatttggagatggagttagtggagggaaagaaagaaacggatataattagaaaaagaaaaaaatactaatgtcttcacaatacttaatgttagaaattcaatttgtttttttcttctacctccgcaggctctacatgttcctggaggtgtgtgtggctgggcaattatcctttttcactcttgcccagtgcttgttttgaatgcaaatgtattagttcagatgggccaagttgcagtaaaagaaatccacccccaaatttcggtggtttaacagaacagatgttcttatcctgcttacccaacagctctagtgggtgtttcttctatgaagctgctcagaaactcaggctgatgggtgaccctgccattttcaacatctggtcttcaaagtgaccttagacgttgacatccctgtcggccagaatgcagaagtatcacggcgcagcatgtgggagaggttcttatggactgtgcctggaagtggcagacattgtccccatcacttggtcaaatgaccacacctaccagcaagggcaatgaggaaatgtggtccagctgtgtgtgtacaggaagaagggacagcgaatgctctcccccacaccctgctttcagggtttatccttgtcatttattgagggcctgctatgtgccctacattgtcctaggagctgaggatacagctgtccacagaatacccacggtccttgcccacacatggttagaacctagtgagggaagaagaagaattaatacctctttataaaattaattaattacactttggataagggtcataggggaaaacttcagggcaccatgagagctggtaactctctctatggtgaggtgaaggggaagtagaggaggtttctgggaaacagtgacattcaaactggcaaaaagaaagcaaaacagacttaaccaggcagatgcacagcagggtggcattttaggaagtgggaccagcagctgaaaagtccttaggcagaaaataatttcaaacattttagacccttcctccaaagggcagcgaggctgatgcacattgaagaggccagagagcgccttgaaatgagacagaagagctgctccgggctgagatggaagtcatcttcctggactcagacagttagggctactccttagcagtagtgggggcccgctcatgggtgtaagaaagaatgtagcatgatcagctgtgcttgtcaaaaatctgctctgcctgatgaagtctgaaggagggagggtactgcagtctttcaggggagagacgggggcttgcgttcggggctggcagttgaaacggagagacataagatagattgttgaaataggaaggggaagacatgagactctcttatgtctaaatgtctaacatgggttggaaaggctgcccaccagtcccaggtatgcaggcttggcacttggctcatttgaaagagagacaactaagccataactggtttatccttttcctctgcagttttatggccttcttgacttcaggcctatttaataaaatgcagctctttaaaatggatgttcagtggagctcaaattcaccctcaatgtgcacttctgcggactttgattagtatgcataatagagcagcacacctgatgtccgcagcaggcagttctaatgccggtggagagaggtacaagataaatcactccaagtaaatgactaattaatcatgcacttgattttaataacatataccatctggctcaagatttgtctgtctacaatcttgtattccattctagagatttgataatcagtaaaaccacccatggattcctaattgaggacaatttctttcctttcttttagaaaacttaggaatcaaagtgtattccagtaactgcatggaaggggctggagggagaaggttattgttatatataaagtcgcggtaccgcaaaagaaatagcagtcgaatataaaattttatttttaattctcagcaaggcaagttacttctatatagaagggtgcacccttacagatggaactatggtgagcccacatttggacaagagaggggaaggggttcttatccctgatgcacgtggcccctgctactgtgtggttcccctgttggctagggttagaccacacaggctaaactaattccgactggcaaatttaaagagaatgatggagtgagtgctttggcaggagtcaaggcagagcaggtagcaagtaatctgaatgagttagggtgagcaagtgatcagaatgagttagggtggagcaggtgatcagaatgagtcagggtggagtaggtaatggaaaacggttgctttacgaggaagttaagtttagaagtagaaggcaaagaattgcacatactgacatattctttgaaaagaaatttagaagtcatatcttacagttaaggtttgattttttttttaaatcttaaaaccatcatagatatttcaggataatttatgggacaaaatggacactatcccaatgaaaacgtgtaaaatcacttccaaaagtgtctatgccagagggcttacttgcaatgatcctttgatcctccaaatcagaaaacagttttttttttttttttttttccatagtctcatctatgcctttttggtttttcttcttcttttgtgtgtgtgtgtgtgtgttttattatactttaagttctagggtacatgtgcacaatgtgcaggttttttatgtatgtatacatgtgccatgttggtgtgctgcacccgttacctcatcatttacattaggtatatctcctaatgctatccctccccctccccccaccccacaacagggcccagtgtgtgatgttccccaccctgtgtccaagcgttctcattgttcaattcccacctatgagtgagaacatgcggtgtttggttttctgtccttgcaatcgtttgctcagaatgatggtttccagcttcattcatgtccctacaaaggtcatgaactcatccttttctatggctgcatagtattccatggtgtgtatgtgccacatagaaaacagttgtttttaagggtattggacaagggtcatgactgcttagcaaggaagcatcctctacttgtgcatggcttcaaacgcttctaaattaacaggagtatgaaccatctgaggattcacaatttccagtgagtcttggctctacttatttgaaatggatagcttcctaaagtaacatataattcacctataaaatactattttatctcataagacaaaatgagtccatggtcttattatgtaagactgttttccattggggctggtctcaggctaggcaaggtgagtatctgtaggtggaattctcctgagaacagatgctctaaactttttaaataattgatttgacttcttcaccatgtccatgtatacagctgagcatggccaatctactggtttgtattatactgtcaaaaaacaaacaactttccctaacaaaataaacagtatctcaaacagcagcacatatgtcctggggggtaaacagaaaacttgtcccatttgactcatttcattatttggaagaaatttccgtcacagaaggcagatgtcggtggactgataccagatagtagagaaattctgagtgtttactgtgtgcaaaaaaatgctgcattggggggctttaatcagaaatccatgaaaaatagtgtaagtacaatttatcgagcatttattgtatgctagacatatgcatcacctcacttcagaattagcctatgaagtagaattattattgtcctaaatggacaggtgggacctaggttgcccagagaggtgaatgggctttcacagggtttcacaaccagtgggaaaaggctggactcaatcccaaattaggctcattaatcatgctcttgattttaataacaattttgtttgttttttctctagaaaagttacgaattaagttgtattccacggactgtatggaggggggtgaagggaggaagtgtgtgtgtgatctcaaaagccatcatacatctttccggagagtttgaaaataataatctgaaaatccaaaggctgactcacaactcctgggctgtacctacgatacagtaagtaagaggatggtgtcactgtgtcctcccttctgtcctgaagcattccatgctacacaccattcataagatttaaaatcatcttcaagaagtgccctgttggaataataagtcagtgctctctggaggctataaccaaatataatttgccacataaacatgaaatgtgtgtccaagaaactagtaggaatgcatctaggaaccaaagtgtctccttcctagagagagaggaaaaaaacaaagtgaggatggtcctctgcacaggcgttgtatattttgttctcaaatccagcagccttgacttgacatgggatggttgggatggttctccacgtagccacataagctcgttactacccattacatctgcctgtacctccagcaggtgcccaggagatggctgagtcccaagagccatgcaggcctcctggacgaccgccctgatgtggtccacgtgactcttaacaggtatcatggccttggcacatgttgggcattttccagcgtcactctcagaagaccctccctccatgagttcaccactgctggtctttaactctcagcttagggaatcagactgaattagttctttgtgttattaaccggaggaacacttacattttctgacaactctaatcttggagctcagggaatagcacagagcatttgtatgaaattacccctcgttctatctataggcctaacagccagcatttgtgaatttggcagaagccagcagatctcacagttaatgtcttcctctcctgccaggatctttggaacaaggtgcttagagtgccacatgacaaagagccggacagatcctgggatgtggagcccaggtgatgttatttgcatccaattaaagaagcaggaatgggtagcataattgacatgcatgactcttaatgccttttggttcattaagcctttggatcaacttttgtaggaagacatttaaaagaaactgagcaggacttgggcacaggtagaggtgagcttccgggctgaatcccctactaggccgttagtcaattgtatgtttcctttttggactcacctctgggttgcaaaggaggttgctctgattgtttcttgttataccataaagataaggagcttgagttactttccagctgataaggcaattttcacctttttccatttgtcttggaatttcacaccccaccccatcctacccttaaggtgccctggaggggttgaagggccattcttggtcatccagtctctgtgtggttgggttgatcacagaaactagagaagtcacgaagagtaggtgttcctcaggttaattacacaaagaactaattcagtctgattccttaagctcggagttaaaaacagtgattgtgaactcatgaagggagggtcttctgagagatataaagaggctgatatatgctctttatatctcacctttgatgatacacagctcacctttgatggtcactctgaatcacatcaaggcgatgacaagaacaactgtctagacttagtggtgtggctttgaaacgacacttcgccattcagggattcaattgttttccagttttataatgagggagctgagcaagagaaatattttcaaaggccattctgggctgcacaaggatagaaacaaatgggaggtccattgggcaggacacacctgtttctacaagagcaacctacttttttgttttgttttaatcaagggagtgtcaagcaattgcttatttcataaacagggctgtgctgctatttttacacagtgtgaagtccacaggtctgaataatttcttcttgctccaagagttcctaggtcctgtgttcagattttgagagccttcatgtctcaggtcccaatagcagtttctatgactgaccagcctgtccacagagcatctcctcactggacaggcattgtgggcacgctcctgcggaggaagaatcagggtggtgaggcaattagtaggtgttctacaatcctgacatctttctcagaccagcccccatctctgtctattggcgagatttcttctttagcttctgctcactatgacatgaaggacttcttcttacctagatattctggtgctataggggggtgctgatcagtggagcttagaattactttacacacacatgcctacaccccccctcgcaacacacacacgtaccttacaaaatttctaattataggccaggcgcggtatctcatacctataatcccagccctttgggaggccgaggcaggcagatcatgaggttaggagttcaagaccagcctgatcagcagggtgaaaccccatctctactaaaaacacaaaaattagctgggcatggtggtgtgcacctgtaatcctaactactcaggaggttgaggcaggagaattgcgtgaacccgggaggcagaggttgcagtgagccaagatcgcaccactgcactccagcctgggtgacagagtgagactctgtctcaaaaaagaaaaacagaaaaattgctaattatgctgattactttagataaacatttctcaatttgggcttcaaggcatattaatagacatacaaaaaaattatttggtcaagtgaaaataaagcatatcctgcgtcccatagtagggtagtgtattagtcccttctcacgttgctttaaggaaataccggagactaggtaatttataaaggaaagaggtttaattgactcacagttcaccatggctgggaaggcctcaggaaacttacaatcatagcagtggcagaaggcagccatgattgtttaccaggcagcaggaaggagagtgccaagggaagagggaggagtcccttataaaaccatcagatcttgtgagaactcactcactaccatgagaacagcatggggaaaactgcccccatgattcaattaactccacctggtctctcccttgacatatgtggattgtgggtgagagacaggactagctggatttcctaggccaactaagaattcctaagccagctgtgcctggtggctcacgcctgtaatcccagcactttgggaggccgaggcgggcagatcacgaggtcaggagatcgagaccatcctggctaacacagtgaaattccgtctttactaaaaatactaaatattagctgggcgtggtggcaggtgcctgcagttccagctactcgggaggctgaggcaggagaatggcatgaacccgggaggcggagcttgccgtgagcagagatcacgccactgcactccagcctgggcgacaaagcgagactccgtctccaaaaaaaaaaaaaaaaaaaaaattcctaagcctagctggggaaggtgaccacacccacttttaaacacggggcttgtaactcagctcacacccaacaaatcaggttgtaaagagggttcactaaaatacaaattaggctaaagcaggaggtaaagaagtagtcaaatcatatatcgcctgagaacacagggggagcgacaatgatcgggatataaacccaggcattcgagcagggtgtggtaaccccctttgggtcccctcccattgtatgggagctctgttttcactctgttaaatcttgcaagtgaacactcttctggtctgtgcttgttagggcttgagctgagctttcgctcaccatccaccactgttgtttgctgccgtcgcagacccgtggctgacttccacccctctggatccagcagggtgtccactgtgctcctgatccagcgaggctcccattgccactcccgactgggctaaaggcttgccattgttcccgcaaggctaagtgcctgggttcgtcctaactgggctgaacactagttgctgggctccgtggttttcttctgtgacccacggcttctaatagagctataacactcactgcatgtgccaaggttccattccctggaattcatgaggccaagatccccaggtcagagaacaaaaggcttgctgccatcttgggagcggcccgccccatcttgggagctctaagaacaaagacccgcccgtatcatggggattacaattcaagatgagatttgggtggggacacaaaggctttcatggtttttggcacccgctgctgtcccctccttttgagtgtgggacggatctgtgactggcttctagcccatagaatatggcaccttccttcacataaaccatccatctctgagccatccccggttccttgacttcatagactcacaattccagataagagatgattctaccaccttgctgtcctggcatcccgggattcctgccgcgtgggctgaactgtctgcctttcccagtatggaagtcatcacttactcattcaatcatttagcaccctttctcgcttgcttggaaaatacaaggtaaaaaacacactagcctactatttgatatttgtgcgtgggtgtgtgtgtggggcgtcatatatccctcttagcatctgataaaaaaaagatcaattcattacccagaaatatgtatctgcatgtgtgcaagtcccaatacacaattcagtacaattctgggggttctggactccctgaggaccatttataagttctctccaagtcattgaccccaggtttagttgcccctctagactataaggccccctagatagaaggcaagtgtcatatgccactgcatccccaactctgaggacaaagcctggtggcaggtggaccttcattcagggtgaattgagctgaattcggtacatggctctgtactcagaaggcctttatttatttcttgtgttcctcttatcttgtcacactccaaaatagaaatgtatacctctgctagttgaatgactgtttatttggaaatcatcacccaatgcccaactgcatccaggctgcgtgacatcattccagactacaaagtgccaagcgctaattgatttgtaagaaagtccacatgaaatgcctggcactctcccaaaggcacccatgggcttggagggacgacagcattggactgttatgcgaggaaataattcttgcttgcccgcctgggatggggtgacgttctggccaggaagcagaagcagacttgactttgggcagcagtctgcccctgatggagttattcacagatggctaagttaaatgcagccctcatagcactaaggcatttcaggggcgactaaacaagtggcccatgaaatggaggcaccagaagcctctggaagcggcatcagtgcatcacccagtgaagccattgtgtcgcctgttagtaatgagcatttgcaagggcagcatggggaatttcaatcaacctgtgagaagacaaggtgtgcagacattgtggatctgagcgagatggggagaaaaggcaataaaaagcagtagcaaaggggaaaagaaaagttcgggccaggagccaagaagatactttctgtggaaaagggagggaaaaaaaaaatcactccacccctcctgtccaaatgaaaaagcatttaattgaatgttctttatagaggtgaaaaaataccctgtggagttcccagtgtttcattatccgattgagttcggtacctcaagtttcaaagaccgttctcctgaatggttattctcatttccatgtcagtctgccgtgtgcttggtgaacccctgctgggccgcatcatttaaaactcaaaaccctgaaagtatttttatgcccgatatagtaacagagcaaaccctggtatcactcattttattctccgcagcctccttcctcttgtctgtgatgtagatgactgtgctgctcgagatgcttgcaatcaacagggcgctccccaagctctgaatgaggtgaatggcctcagaggaaaacagattagaaggcttagagatgactgcatctcaggtgcaacacttgaagcaggaagatgggagtctcagaattttccccttgcagttagaaaaatatgggacaggctggggcagtaggagtggatttaagtaagtgagacagtggatcaggaaaggccaggcttttactgggtggaaatagcctggatgcaattatctgctacaagccccaccaagaagagcctccctgctggaggaaagcagaaagggaactggggtataaccaagcttgtccaatccgaggcccgtgggtcacatgctgctgagggaggatgactttgaatgaggcccaacacaagttcgtaaagtttcttaaaaggttatgaaatttttttgcaattttttttcttttcttttctttttttttttagttcatcagctgtcgttagtgttattttatgtgttgccaaagatcattcttcttcttccactgtggcccagggaagccaaaaatttgaaaacccctggtttaaatcctctctacaaactcgccagctctgcaaaataatcatctttgttggtcttaagaacactttaaatcaggtttaaatcatctgaacatcagaaaggaatttttttttcttttcttttcttttgttttttttctcccttgagagggaaatctaggggtggagtagagaatcatttaaaatatttcccttcagagaccaacggctaggaatagctgataaataacataaaagagcggtttaatagtttcatgtttgacccatgtaataccccgcacatttggttaatttagaaaatatttgacgacaacggaatccaatctcattttctcaaacagaagcttaatttctctttgactgaaatgaatagttatgttgccatgccttagccaaacaccctataaatataataccccttcagccttaatatttcaaaaactatggttttcagtttgagctgttataatgttttatctcagaagttgtagaataatttaaaccagtttttcctactttggttccttggaggctgattcttctgcctgaattcctctcacagaacatataaaccccttttacctccctcactggcacaaaagcaacttgtttccaagattcaggacttaaagaaatggctgtgggttggtctacgaaaaccattatgctgcatcctcccagtcctgagagattctgaagagaagcaggccctggcttcagagttgaagaaatgataccttccctcctttgcctcatagtctcattcatgatgtttgcttcccatactcatctccaactggctcacacattccttcaccagatagtgtgggaaggagtccatctttctgcagttggctaatccaggtgttggcatggaagttttagctctggtctgagagttctagtcatggacaattgtccatgtctattggaatgaataattttccaatggacatggacagttgtcccaggggactggaaatcaagggtgctgagtaaactcagcctcagtggaccacctgtgtgagttaatacagagaccacattctgcatcttagcaacctaaacaaaggagaggcacagcaaggtgagaagcttcaaaaggcagtcagccaatgcatcaacctgggcccggaggggtcggggaacctcaaattgtcatccttatgtaacagtgacaactaacatttttcaaggctcgttaccatgccctggccacctgtcccacattattttatggaatgctcagtcaaccctatgaattacatactatattatccccattttacagactacaaaatgaaggtttaaggagaagcttacacacctcacccaaggtcctacagttgttaagtagggggacagagacctgcatttatctgtagaccctccactcttaaccaccctattgacccagttcctaatccagctcacttctgagctctggacgtccaccaggaagaaaacaatggctgtagtggtgcagtgacccttctttgccagtttgtcttgggtcctgatgagctgccaggctcagtctggaaaagtgccctcaatccctgcatctccatctctcataggcattgtgggaccccacaaagactctgtctctattcgcttaacacagtggaaaaaaaggccacccttcattctttttttttttttttttcattcaacaaacatttattgatcttctaatgttttttcaagaatgcttttgggcctgggatacaaactaatggacccaacagatgagtcccttgccctattggcacttactggttcatgtcaggttcctgtgcctctcctggagaagcaggtgataaggtctctgtgttaaaggaggaaaccaaggttctaggcagcctcgtgggtaatacagccagtaaattgcaaagctgggtgaactcaattgacaggactctagccagaaactggttctttgccattagtctctactgacccctatggatgtatggagggagtatggggtacctgggaaacatcaagccttacctagaatcatctttccaatctcgctcttctcttccatttagaaccaccttcaacatctccccagggtacattccctaaatagccccgattattcattattttatggaactaccagatactgaattcctgttctgggccatgcactctaggagctgtgatttcaacagtgaaggaggacagggtggaccccaccatcgtggaatttacattctaaagggcacagtttttctgttgagtcttcccaggaggtgtctttttatttcatacctttgaccttcagatccattcatgatactttggcttatgggtgttccacacttgattccaagggtgatattccatatgtgtaatgcctcgctcaatcagaatggacactggccctagtggccacccaagatggattcttggagcttctttgctgtgacaaataatgaccttttagttgacgaattataaggaagttatgggagatcccagaggaaggctttaagacaggggaattcagagagcttggagcagcagctctttacgtagggccacagtgtatttcagtgtttctccaacggctgcacctgtggacctatgtgtactgggagactattgactctgctcagattacatgggtaagtttgctccttacaactagactgaatgcccattggaggcaggatcctatcaactttttcttctgccaaaccagcctgacacagtatacattgcatacgattcttccatgactatgtacttgtcatgagttattcctcatcattctaaaatttgacctcaaagctgagcaaagtctagatgaaatgaggttctagtttttataataatgttcaatagtttttcctatacgtcactctttcagtgtggggaggaatggtgacttttcagttgcttctgaatacggtttgctgtacactgtgtgttaccagtgtgatttgctataacccagctcttggagcctcatatggtatgtggttcaacagtacagtggtcagtcaagaataaatacagagcaagtactacggtagctgcagaaagagcatcgccaccatgcatcattagtgcagagccctggaccaaaggactcgagctgccgccagacctttacccattccaagtgcagactttgctaattcatcactgccttcctcaagaccccagcaagcttctcatcacatcacttttggcacttatctgatctttcaatgatctgagttagctcaagaaattacatctagttaccataccatgtcaagactgctatttaactagaaaacaaagagacttcctccactccatgcaaacacatgttgattctcatttacctgtttaggaaaaaaaaatttagattcaggctcatatactaattttattcagtgcttaaggtatgtctgttatttgggatagaattcagtgaacaatgctaaggtttacaagggcccatgtatgactttagggccgtgtgtgtgtgtgtgtgtgtgtgtgtgtgtgtgtatacatgtgtatgtgtacatacttttccccctgtaataggatttctttagatctgatgcttaataagacagaaagacaccacagccttctcagaagacctttgcaatatgtccttactactggtttgtgctttcaaagttcatgtgtgtagtggtctctcctgtcaccacgatggatccagatttaagatgtcattgagccatcacaaagtaaagagacactttctaccccaggttgctctggggtgagaaaactttgatgactaaactaaaggtaaaatcaattgcagatgcagtgtctgaattggatatgaaagaaaagaggctggcatttattagctgtctaccggaaaccaggttgctcttgaaacaccgtctcatttaatcagaaaaatgaccgcttgcagtggatatcatcctctccagtttacaaatctagaaaacaagtacatcaaagcagttaagcattttcgtaggagccgcacactcagtaagctaatattagaactcaggtctgtctgatttcagagctctttccacactacctaaaatattcatgcaccagatgaaagctttcttttttcccctagactgtttcttaaatttgtagttctgctttcaatacagggtttcttgaaatgtgatggtgtgattagacttctggttattactctccaaccatcatttctaagagaattggtgtgtgaggctgaagggatgatagtagggtgagccgtaaatacaggttaactgtcttaatgtggcctgggcaatgtctaattactcagggctgtttttggaagacacttccccattctaggataggggttacaagcacaaatgtccataggagctgggtagttactgtgaataagtgccataggctagcctgtttgggtttggggagctgagtgaggctgtactgggaaacacatgccccaggtagagctgggggttggtgtctttgctccgttaagacgattgcaagatcccagcaagggatcttgaatatttgcaggttctgggttctgtgttgagtgcttaaatggatatcttatttaataataacaggaacccttggaagtgagcacaggtttgattctcactttgcagataaagaaactgaggcccagaaaggtgcccaaggaagcagagttatttaggacctgacagaggtaggattccaacctgggcagtctatcaccagagtccttgtttaatcactaaattttgtacctcttaggactattcaaacccagcaatttgtctctgagaatgatagataaacatgaagatactggagaagtcaattatatatccccctaaaatgccttcagcgtgttcaaaagcaccgagctctccgccatgatgtttgtaagggggtgacgttagatagtgatcaaagaaaagtctaatacatgttattttttgttgtacagttcagttccttgtacataattcatgtgtcaattgatactcatgaaagttggtcttgaaatattgtatacagcccaaattaagagcttggcacccaatccccacttggactacaaatcacttcctcttgccaaattagagtctagagtaatttaccgtaagatgggcttttaaccctaatttctagacatactcagcagtctgctttgaaagctcatcagcttctagaagcagctcatcgttaaggagataccatcagggtaaacacatcagtttagtcttttttgcaacattgctaattccacgttgtaatcaaggagaaataaatggaaaactcttacttagtattagtttatttagacccatttatttccatcagtgaccttgggagatagttggttcagcacattttctcatattcggcctctaattcagtgtgggattttgtgtttttataattaacagagacatttacaaatagaaaaaaatatatttgtgcttttgggaaaagtgccaacaatgtggctatggaatttgattttctaaatggagactacacaaagtgtagattttttatttctaatgtatgtctctgcctatctactgatgatggattttggctttatggcaacccactaccaggcttttagctgtcagaattggacaacgtattgactcctaggtaggaaccgtggaaccactgcgttatcatgataagctggtacaagcagagaggatctattttctaagcagatgtttactaagggactactacactcgaatgacatcacatctttgttagcagttgtggttggtgccatgtttattaaaagacaggaagaccctttggttggctgttaactattgcatatttgtctgtcttgtcaataagcatttttttaaaggttacttttcctttatgtgtttacttggggttaaaattttgggattatgacaaaggccatattttgagattatgacaaaaaataattcaaaaatgaattattgaatgaggaagttgggtctcattcagtaggttaggtctcctttaaaattgtatttttctcgtatgaagacccagttcaatgggtttcatagccagtctgaggcaaaagctggctatttacttccaaaaggacttctcctcaaggaagagaccccctagtgatacccaaatcataaatcagagttcttaacttgggatctatggaacagagatcagggagtgagtcttagaaggcccgttaacctcccagtatgtggaaaaatgcttcagatgttgacacatttcacagaagtgtcatcacattaacaaagggctcataacccataaaagttaagaaccattaattttcaggtaattcttctaaataatgggtcctggccagctctacatgatttggagcatatttacatacatttgcatactgcttgtccttggtcatgccattcaactgccacacacctcattatagaaaagagaaagaacaggatttacctaaagctcaaaggaatagtgatcctgtgctaattaaaatttgttctggtatttgggagtctcagatgagaaatctggagtcatgttgagtttggttattttactcatttgtagtcagtattcaattattttaatttagcttgtgcattttcatgcaccttatttcctttttcctcctttcgactccatttggtacatttcatctcactaaacaaggagaaaaaaagggaataggagttcttgaaactcaaaagcagcattaagttcttgtctgtgacccttattgagcaaagattaggaccagtgtttacaaatttttcaagtactctcaggagctcttgatgcttagactctagaaaatgttgggtttgttcttaagaaacagaaagtgtccaaatcccacttggcttcctaacctctcagactcactctctgccctacagagccttagaaggatggccaccaacacctatgagatttactcctgaatcatttgtctcaagccatttcccactctgctatcagcctgtttctgttaacctggctggtgattccacgaatcattgtcccctttgaagatctatctaacctcctggcttgatgctcctcgagggacctctagcttctgtggattcaaatgctttaaggaaaaatactcagtctaatccacactgtctctagaaccagctagctttgtgcaatcattcaggaacatctctggccctccccacccacacactttccatcaatccagaaatgatcagattcagcccttgctcacagatgtgaagccacaaacggcagctagggtcaagaacagcaaggttactactggatgctgactcaaggcaagaagaggagtcaggcacaaaattctgaaattagtcattgagggaagtacaaagcttaaccgtagacaggaacctggaaatgctgggtcagcctcttcgtctacccgtacatgacatacaaaattattccatgttacttcaatacttttacccagagccttgtaacaatcttcttgaactgttgaatctatacaggtgtagattgggtcaggagatagctttaaaagtttgttgttcacgttcgtgccaactcctggtgtcttagattttgttcccaaacactcattatgacaaaaggatttaagtgcattctatttatttgtgaagtgatgcaggaaactacagtaaggagtgcggatgtgaataagtggaaggcaatacagtgtgtgtgaatggtaatgtcacctccatgggcgggtggggctcagttccgttgaggatctctggaagactacatataggctggctcagagctgtgccccactggggcagctcactgggttatttatctatcatctccctctcattggttggagcctgcttctaaggggcataatattcaggtgctttccacctgccaagagaggaggccaagcatgctccagtggccgcagaaagtcctcagcagaatcccagggtcttctaagaagaagacgtggagatcgtgagaatagtgagtgctcacagtatgtagcggggacaacaacagtgtctcccacaaccagcattacagataaccaggagtcgaccctgatgaagctggtggctttctcagctttacagaatgctcttttctgcttcgcctggcaaaacaggaggatatctgtctcaaagttttcaaagaaaggacattcagtgatctgttgagagattcagaggttctccttttctctggtggtgctctatcagggacagataggtccctaagacttagcagcaaaagggactctccctgcagaagcatgtgcatgatgtgagtaggtgtgcccacagcccagggttcatactctggggcttcatgcccttttcctattctttgtctccaaccgcatcttataagaagtgcatgttaggaaagagtacactaaagacaggaacagttactggattaatataactttaaaggtgagcatactggggaaaagtgaacagcaacccttaccagaatgtttaggtacatttctgcctccctcttcaagctgccaggaaagtgcactgtaagttaccaaggagcaaacttcagcgcttttccaacagtcacaaaggactctctgccaccatctgtgttgcatgtgtgctttacctttgctgtcctccttactttgaaataaatcccacccactacggtgtcccatttcagaaactctaaaatacttacttgaatccctggaatggattcatccaaccctgttcggttttcttccttccagtgtgctattctatagtagaaacagtgccaggccatgggatttagacatcagaggcatttccaggtttataaaaaggcgaagactgtattaaagtatttgcttttaagtttgttggccagttcttctcactgaccctggataggtctaggctactctcagcttacctaccatgtctttgtaagatgtgtagtccatggtgcttgaatagcaccacaaagacgtggagaggtaaaagacataagatgatctcaattttgaataattctccttgaggggcaattatatatttttggaaagttcattcttatttattgggccttctttatctcagaattcaggaaggggcagagtgttttcttcccaagttactgactttcttagcatgcgaggctcaaatgacaatgattatttagaatctctgagcagctcagactcagttttttttgtaatgccagcatataggtcaaatgtgaattccttacaattttttctgaatgggaagtttagggaacgactccaatgttcctgtagtcgctctaagtcgtttaggtgtgctataggatgaaaagaagaataatgaaactgtggtatatgcatgccgtgggatatcattcagtcatacaaaagaagaaagtcctaccatttgtgacaatatggatgaacctgcaggatattatgctaagtgaaataagacagtcacagaaggacagaaactgcaggattccacttatatgaggtatctaaaatagtcagactaatagaagcagagtagaatggtgatttgggggagcagaaaggggaaatttattgctcagtgggtataaagcatcaattatatgggaagaaaaagttctagagatgttttgtacaacttagtgcttttaggtaacaaaactgtaatgtgcacttaaaaatgtgttcagaggctgggcgccatggctgatgcctgtaatcccagcactttgggaggctgaggtgggcagatcacgaggtcaagagatcgagaccagcctgaccaacatggtaaaaccttgtctctactaaaaatataaaaattagctgggcgtggtggtgcgcgcctgtagtcccagctactcaggaggctgaggcaagagaatcgcttgaacccaggaggtggaggttgcagtgagctgagatcacgctactgcactccagcctggtgacagagtgagacttcatctcaaaaaaaaaaatgtgtttagagtttagatctcaggttaggggatcttgctacacacacacacacacacacacacacacacacacacgcacacacatacaaatacaaagaaatacaatgaagcttttagaggtgatggatatatttactaccttgattgtggtgatggtatcacaggtatatgcatatataaaacatatcaaattgtatacatttaacatgtgcagttttattgcacgttaaagatactttaataaagctattaagaaaaagaaataaaaacgtttgctttcatatcctcaggtcatcatggattcggatcctagttctcttgtgtgaacatcttcctcattttccccatatgaaaaatagtggatttaatatatgccttatcacatcagtttgtggattaggagacactgtatgtatgaaacaccacagtcaataattggtaggaatctccttacccttcttcccttggtatgtagcaacttcatgaatgaaaacactttccccaaataggtatctcacagagaagaaaacactatgaattcatgacccatttgcatagttttaggggttaaaagagctgtatataaattgtaaaacatattaagaaatttagagaaataatctaagggttatcaaagaatgttcaaattccctcagattttgtttttcaccttatctaaattcatattttcatccctattttaagcagaattattcatagttatctacttagcagatgttcaaggatgatattctctttgtatccatctttccttatccagaggcgtaaaggaaaagcatgaagataagggacacggcatcgttaagtatcccgggtttgttaacagtagaagagagtgtggacttgcttttcactttcattgtgtgtgtttctaggagatcctctatcttcatgctcagcccccaggtccatgtgtccttctctctaataggactgtgctatgatagctgttggtgggagagaggtcttgcaacctaaaaggaaggagagccatatgcagaagagagaagtgattagatgataaagctgaatggtgactctgaaaaacaaagtaactgtaaatttgtggaacttttggtctttcttctcatttgatgattagaaattttttagctgtccaaatccagtccttgtcttatctcagctatgcagagtggcatggctggttcaagctttcagtgaagaaacagatgtatgaggccaaatcttgcaaaatgccagaagagtgtatttgggcagaataccaaaatgagttcgggggcctatatggaactgcgggcagggccaatgacagatagttgaggactgcaatgagagatgcccaaatataagtatgacaagcaggaatgtcattctgtgagtcagagtcaaagtcaaaaagactttgtaaaaatctactttggagactaggtgtgggtgtctgatttagaacccttctcatagtctggtgatttctaatggtgcttttgccgaaggaattcttaggagcatccaagttccatcttaaagacatggctttgccagtctgttgtgggtgtgctataccatatcagacagagaaataaggatgtgtgtgaaggtatgaatctccggttgacgaactctagtgtgcaaataagacaactgtctgtcttttaacatggtacgcacatttctgttttgatcaccctttctaccagttggtgaaaactttagcaaagtccattcattgtctccataatcccctaggtttctatctaattttcattgagcttacaaggcacatggcaggtgggaggcactctggcatccactgagatgttagtgaacccatctggtcttcatttgtttccttccaagctcaagggtgattgagtttgccagccttctctccactgttttagtcttttcccaaagcatataaggactcttctcttgcttccttgctgaactgggcttggagatgcagctcagagagaagacatgcccttgtcccttcataataaaccatcaacatgtccctttttacatgtctgctatttgtctcctcttctttccagcccagggagtctttatctagataataggtcgagtaacctggaccacagtccattcttccctgtctaccattgaaggtacaaaacgtataccagacacctttaagatttagaatttgaaatacaagaatgtgggttcttacaaaacaaaacttggaattttaaagttaatttttgttattcttgagctctctgttttttgttttgttttgttttgtttttgtaacattatctctctcctgaggcaattaaacagaaaaggagtaatgagcagagtgaaagttaaggaaaggtcttatttaattcctgcccaaactttcagactgcctgatgggaaccccagttgaataatggtgggatttttgttgttgttgttgttgttaagcaaagatgatttccaagctctgcagggcagggagagctggagagttcacatgtttgtatttgaactcacatgaaacaatgaagagtgaaatacagtcctgtttctctagcagtgaaatttcagatccacagagaaacaaggctttcattctaccataaagaaggacaaaacataactgagaaatacagtgtaaaaggaggaatttgcaaagaataatatgctctagcatattccagcaaggagtgatcagatgtgggcatagcagtcatcattggggtgaaatccaagacaactatgggtagcaaaggaagcagctatctttgagaaagtaagactgataaggttttcagtccaaatgacaagtaacttctagtttctaagtataagcttttgcagttgggatcatgcctttttttttttttttcttaagaaaaaacttaaattgcttttactgacaacagacattgccagatttatccacacaaccagtgttccaaatgtcatataaaaatgcaatgcagcaattggccagattgttaagtaacgtgctataattgtttttatttgttttaatccctgtgaacaaacattttattttttgtccaaaagacaaaaaggagttgaaattttatcgttgtttttccaggcaaaagaaaatagggtatttgttgactgaagaaatgagatatttctctttggcagtttgggcggcctaattgataggaagaggtctggtagctgagaatagcagggttagaacaatagaggattccaagatcaaggggaagggtcagaggttcacaattcccaactggagtgggtgagtgggagagaactttacaaaagaaataagagcaaaaccatctgggtaaaaatgacaccatgtcttgatctctgggctaaggacccctggaagtgcaaccatttacactcgctcttgaaaatgcctcattgtgggttcagggataataacccttaagctaaagcctttatgagttggaagaagagaaaatgtgcttcctgtttcttacagaggatgaaagaagcagttaattcccaaatccagcctccaaacaccacaatggagcattttatatgtggaggaaaattgctaaaggttatttacaattagatccataaaaataattactggggacttttaacaaactttatttaggctcttccatacttaagacacaattctcaagaatatcttgggtaattttcaaactgttcttttccttaaaacgatcaaagggaattggttattatccaaggtcaacttattaacgagagacagaatattccccaattacagtatttctccagcgcagttcttactgagctctaggcaaggggcaaaatggggaggagagagtgtagtcagaagtcccagggtcttacttgggtctccagctaactagctcagtgagcctgggcaacacccctgacctgtctgcatatgtttccttgtttgcaaaatgaaatgagaggggataattctaaaaatcctttctttgtgctcttcctaattttttttagaactgctaaatcattgcacgcatgaaatgatttgcttttgttctctttgaaataatggagctcattgtctaggatctccagcttctatttctgtgaagcaagatctaacagcctttgatacctctctgtctactttctagggaattacagatataatttgtggagacacttagtcaaaaattgtcactgaatgccttatgcttttccacaatgctttcagagctgaatccttataggaggcaagtcagagatgaaataagaaggactgacaggaaggagaggtgtaaacagagctcgtgaacacacatgaaaaggcaagtgataggtacacaaggacatcaccaagaagaaggctctttttctgcccttgcagtataaaaatagttatttattttttcataagatgatgttggaaaagtttcaaaggaaaggcttctagtgtttgatgagcacctgctgtgtaacgggcacaggttaggcaattttatacaagataaagatgtttgtacccacttaatggataagaaaattgaggcacaaaggggttaagcagtcttcccaaacttacccagttattcattttaactgctgtgtcatgttcctggtgtgagtctgccaaaaattaattcatttaacctttttactattgtttttcatgattacaagcgtttctgtagtgagcatccttatacctgccctcatgtttacacataagagtatattttttaggtaggtgcaataaactaagcatgtatctgtagatatgtgtatatgtatgggtatatatacacgttatatatatgattgtgaacatgcatatacatatgtatgaatacatatgtgtttgtatatcagtgtatgtatctacatatatgtatttttctaagatcctgccaaattatcattgcaaagtggctctgtaaaatttcactcctccccaacattgaatgaaaatatctgtttcctcatactgtcaccagtgtttcgtgtcaccatattttaaacatttgccaagctattattacattattttttcatgttcatttcttcaatcacaagtgagtttgaccacctctcaagttatttacgtccaaaaaaaaaaaatcactgtaaatgaaaaatgagtagtttagccttgccctgtgctgtgcagaaagccggtgagtttcttcctgaagaggatgctgcagggtcatttgacttggagaggagggagtggtaagatcacattatcattaagaattcgctcagggcatgtaaagatggctgagcagcttctttaagcgtgtaagtgatgacgctcaaatctatcagaatactaaccctgaaatcaggtctgagtttacagccattatatctttctttggatttggttttatgtttttacccttgatttatgtacgtacttcccttagcatcccatatctcaagcaacataaaggtattaaagtgatgggatttagcaaatatgttatggttaccatctttgttcccaagagggaatttggaaatctgacaagtattatacctttcattttcaagacccgttttctgagccgtttcgctaacaagtcccctgatttaccatgccattaacaaaaataattctttctggacagcagtaaaagaagtggattagaacaatttacagccttctcaagatacatataaggtgcctgttaagaaaaaaaaagggacagatttttgattaactgatacgtagacttgcttttaaaacatgtcagttcattctctgtatgcccatctattaagggcaatgtccctcatggaggaagcctgccatcgcccggtgccttagcacgctctcatgtttgccaacagtgattaggaattacttagttgctgacaaccctccatcattgatcgaagtaagaaaccttttctgcttcaaggtaaggacatggtgcctactttctaaatgagatgttatccagagacaacattttgaatctgtaggcaaaaacgtatccagttcaacaaaagaataacctgcaataagcagagatagaatgggtgaggacctaggacagcggctcattaggcagaacccgtcctttctctttgctaaagttagggaggaaacaaatgcctgccgaacagaaggaggagatgagaggatctgtcagccagggagaggtacagctaccagaaaagcactggacagtttcctctaatccttgggaactttaatcgtctcctcaataattctcattttgagaggatctcaaagtggagggatccattagtaagttccactttggcctggaatgagagatgccgaaaatgacaagggtgcttttctgtggtggtgtaagtagcgtggccgtggatgtgggcaattggcttactccagtctgtggcattagttagcatctctgaaaccctgagacatgattctcagcccccatggctggtcaagggattaccagagaagattttcaagtacatgggattggggggtgctcccaacccttcagtcagctgtgggttttgcgtgtgaagagcataagaggggagagagaggaaatgagagaagctggaccatgcagagccttgtaggtgatgggaaggattttgctttcatcctaagaagagtgagaagccattaataggattcggggtgattgtgagtcagggggaaatggggggaggtatcaggacatggaggtctttgcaattattagttggagaacagcaatggttcttagctgcttcgtgtgccctggacccttctctcagtctgctgaagcctgggcagtccatctcagatcctgttcaggtgcatagattaaaatattttaaattacgatataagctacttatgctataccatatttatactatatcattgtggtaataaagaatttgtcatagattaatagacaggcataggtgtcctggaactggttctgtcttaccagcttgtcaaagctgattacgcgaatttctttccaaattcttactcagtgatgccaaattggtagcttgaaatcaagccacggtgagagaatttatatcatagaatatggaaaacattacagatcaggacttttcttctcaaaagtcagctgttaaacattgaccatcatagcactgtgtatatacttatgtatttaataataggctttggtggcaggtttagtaactattgcaattttgaagtagtgatgagtatgaatcccatttcaggatatttcccacaattgaaatgtgatataataacttttttcctataactggtgacaaacacaggttctgctaatactattgtgatttgttatctacattcatagttgaagaacctgcttaattttcgttagagggtaatgaaaataagggtgcatttttccattgaaagagcctctgaactacagtgtccagaaaatgagaaaaaagagggaccatagagaccaactagaaggtgatagcagtattccaaatgagttgccatggtgtcttgtattccagtgaggagatggaaaggtgtatatggaattggaaatggttagtagataaactctatgacaattgggtatgtatagacattggggtgaaggaagtgtcaggagtgacttatagggttatggcttacaccactcaacttaataaggatgagaatgccagaagggcccaggtttagggaagatgaccatgagtttggttagggcctgttgagtttgaagtgccttttgagtatcatggaaatattaaaaagatattgggacacatgcatttggaatagagacatgagtaggttctaccttcagccttggggtgggaccaggttacgaagggatgttattctttgatggatgagcagactacaaaaagctgtgccaccctttgtctctatgtattcacactgcttcccctagcacctcttctttatctcctaacaatcattgtgccaacagactgcctttagaaactggcagatggcccctcttcgaaggatcctgtgcatacagagtaactactttcccagtagctgcatggctatcttgctggatctgcaggtccagaggaggggctgggacagtagaggagcactaggaagtcattaggatatttgcaataattgaagcttgcatcctatttgaaacttccccaaagaaaaaaatgagcgagaagagtggtcagcaggaagccttgaggagttccaaaatcagtggccagcagaggtggaggagcctaaaaatgagactttggagggagcagccacaaagataggagaaaagccaggtgaggtggtggaggtgcagggaagacaagcagagagggtgcttcagtgagaagagaggagaggagtgaaactcaaagtcgcaagagaacactggaagttcttccctgcatctagtgacacggagggtgttaattttacacaggctgtgttggtggaggaaaccagatgggaggggaagaaatggagataacagttatagacacatcttttaagaagtttggcggctaaaaaggagacagatagtgaagtagttggaggtggatgtagagaaaacaaagttttttttttctttcttttttatttcctttccttctcttccttcctttttccttccttccttcctcccttccttcctcccttctttcctcccttctttcctgtaggagatactttctcataaggattcatttgagacagagagggtaggagagaagggatttatgatggcataaagcttctgagaaggtgggaaaggctagacttcaaaacataagagggacctgttaactttttaaacctgggagttgaatcaatgaaaaactgagtcaatgatgtaacacttttaaaggtagttgtttattgccccccatcttagagaagagccttttctggttacagaagacaaagtgatttaatgtgtgctgaagtaagctggaaattcaggtgttcagttgatgtttttggagtagactgtgaaattgaaattggagagacattatccaggcaggaaaactatgagttaagggctctggacaataaaaaaaataagggtgtcatccttggggaaggagatgggagatgctgatgcgtttagggcttcagagctgcacctgtgctcctcttgggatcagaactgcagtatctctgcagctgctgcaccttgtttttaacccctgcatccaagagctgagtgttgcatgactctcaagatgcagatattaaaaccttattgactgatgtagactcttctgtgcatcaaagggctcagaagtggtattagctggctgtctccttttaagtgcagagagtgcttttctgtagatagtgctatgagctacctggggttaagataaaaggcttcaaaaaggtagtgtcttcccggaggctgcttgtggccactcgctgtgtgtctgtggctatacagaccccagattgctggggctggactttgcatgtctctctctattaccttctagagcctgtgaggcccaggcttttaaagattcggcactgaaagaaactaaaaccaaacttttgagtttacaactgcctgaggctgcctccatctacaggacctttactaactgtgccattttggcgaaaagatagattttgaagttcaatcagtcttggtttcaagtattagctattcctcagatgattgtgggaccttgaacaagtctcttgccctctctgagtcagttttatcatccatgcaatagggataatattacctacctcataaaaccattgtcgagacccatctattcagcacatacttgagttcctattcaaataccggctgctgtgcttggctgtggagtctaactgcacaaaatggtcttgaccctgagggttttatagtttgagagtggatataccaaagtgcctggctgtgattattatattgtgatataataataaatacatatttggtctctgcccccagttctaatatttagtctgtgaacccagttcctggcagacagcatctaagagctttgtaatttcctgagtgacgggaacatctgacacagagctccgaaatcccttggtatttcctggctgataggagcatcttttgctctaatgagttgacttgtgctgggctcctggatacccccaggatgggtgctggtttccaggggaatcaaccatgtatttttagaaggttggggctttcatcatccaccccacctccagggaggaaagggaggctgaagactgagttgatcaccaacggtcagtgagatactcaatcgtgcctatgtaacaaagcctccatgataaccccaaaggacaggggttaaagggcttccaggttgctgaacccatggaggtttctggagggtggtgtgcccacagagggcatggaagctctgcatacctttccacatacctttccctatgcatctcttggtgtgactgttcatctatactctttgtaatattctttataataaatgcgtaaatataagtaaagtgttttcctgagcacttctgtgagtcactgtagcaaattaatagaagtcaaagagggggttgtgggaactccaatttatagtgggtcagtcagaagcacaggccacaacctgggccttgtgactggcatctgaagtaggggacagtcttggaggacctgtgggatgtggctttatctccaggtagatattactgaattgaattgaatcagaggattacccgctggtgtccactgaagaatggcttgatgtattggggaaaaacccactcatacttggtgtcaaaactgttgagtggtgtgtgacagtaggtaaaacattttgtttttttttctatccttcatattggcccagagagcttatttaataaatatctcattcatttcttttttcttatccattataccgtaggctcagctgaaaacatcgttcatgacccacctgaatgcacagtagggtacttagaaagtactgcatggttagcagacagctctgtagggagtcggaacagccacgcagtagagtcttggaagcagaagagagtaaggcacagagaccccgaatgagggccgagtgtggacatccacatcacagctccacccatgactagtcacaggaacagagacagtcgacttgcctctcactctctgcctcagtttcctcacctgcatgatggagacgataatggtacacaattctaaggtggttgtgaggattacacgagctggtggtgttgcgattctgaggtggttgtgaggattacacgagctggtagtgtgtgtcaggtgctcagaacaatgcgtggaacatggaaaacactccctacatgggagatattatttccatgttcagaaacaagctggtttcattaaagcccactgctctcaaaaggcaattcccatgggaatagtgatgacttgaaattctgtatcaaaatgctggtggatgctgcttcgtttgtagtttcttttcttttccagtctccacagggctctgttatttggatcctctaccatgaagaacagtgcccctaatcgtagactatcactttgttggccactgtgtgttgtccacccattatactgtgaggtctcaacagctttaatttcaataatttgaggtttgttcaatgcattatattccagatagttcacggatgcttttaatttaattataggcactttaacaccacagatgactgttggggaaacggaaaatgtcattctttctgaatgcaagacacgtgtttaggactgataaaatacataactgtgttttatttcagaataaaaagaaatgtattaccaagtatgtgacagtaggtagactgctgggaagcctgggtctgatacattgttgtcagaaacaggctcaattttggtgaagcgaagggtgtacggaggatgagccttgcaaacaagctaaggtgcccaaaggacagctcccccagtgacctcagggtcagcctctctcttacgtacatacaaggagcccctcctggaagcaaaccccactgcagccttccaacaggcacatccttgttcttcccactatcttattatttgtagcagcaattattcattgccatctgaattcactcagtaaatatttattgagtaccctgtatgtgtaggtagtggtgatacagcagtggacacacagacaaaaatccctactctgaaggagcttatattccggggggaaaaagagaggaaaataagtaaaatgtgtgctggttttgtgcatgaagatggcaaaggctatggagaaatcaaggaggatagagttggggaggaacagttgtaacttccatagtgtgggtggagaaggcctcactgaggcatcaacatttgagctaagtcttgaaagaggcaaaggaatgaaagaggtgccaggccaaggtaatagttcctataaaaatcctgagaatggagagtgcctggtgtgtctgaggaagcccaaggaggtcatcatggagtgagggggagataatagaagatgaacttcaaaaacgaagatgtgaaaaattgcattgatccttgtagtccatttggaagggtttagatgttttatcatcaccgtcgtcaccatcatcactaccacctgctagaaacttcggggggcggggggtgggggggaatgactcatcatctcatctctgcactcctgaagctccaactcagcacaggatacaacgaaaggataatgtgatgcttggtaccaagactttaaggacattcaggagcggacagaaaacatgacctaaaagagagggaaaaacagagactttttacagggtctcccttaggaaagggagctatcccttaggaggagatatctaagccactatgcagttgtgaggtctttagaaatcaaccaagtgcattggtcagattgaggctaagttttccaacacagagaaccctgaagtcccattctgtactttgtcttgactctcctttcatttctctttatcactcttcgccccccactgcaggtacctgttcctttttctgaccatgtctctggacttggagaaggttttctctcataagcttctatccagccctacacccagtggccatacaggtccacccctctgtatggctctgtgcattaatgagcagctcttcttagctcagcgtgctcactgtctttaggaatggtttctgctgaatccattgactgcacaataagcccagtggaatgtgtactctaggccccagttacctccaaggagaagggatgataaatataacagtgacaaaatactctcatacacacagaaatatatagttacacttaaatgcacacacatatatacatacaaatatagagtgggtgcagtggctcacacctgtaactccagcactttgggaggccgaggtgggtggatcacctgaggtcaggagttcaagaccagcctggccaaaatgatgaaaccctgtctttgctaaaaatacaaaaaaacagccaggtgtggtggtgcacacctgtagtcccagctactcaggaggctgaggtgggagaatcacttgaactcaggaggcagaggttgctgtaagccacagtcacaccactgcacttcagcctgggccacagagtgagactccatctcaaaaaatcaaatgaaaaaccacatatagttatatataaaagcatgcacgcatgcatgaatatacctatacatatacatctatgtttacatacaaatgcatgcatacatgcacatatgcacacacctataattataaatgcatgtatatatatatatgtatgtatacacacatacatttttatagaaatgcataggtatacacatgtatagagttgtagatgtatgcacatatttgcatgcatacatacatgactatacgcacaatgcacacatgtttatatatgaatgtattcactcatacatgtatggttgtgtgtgtgtgtgtgtgtgtgtgttttgggaagactaattactccaggagatttacatgtagtttcccttcttaagtagatcacaaccctgctctgcatttgctgccattgtttctgttacgtagatgaggaatttgagtctctaaaacttgaagttgcccggccaaggtcacgtagctagtaagttgtgaagctgatattcaaactaaggactaaaagataaaaaagaccactttcttccaatgcttaaaagatgttaacagaaagagagcaaagcaacaacaagaaagaaggaaccctaagtatgttcatcgagctactcacagaaaacagaaaatatgattacaacataaagtgataatttccataaaagaaaaagttacatgagcacatacaagagggaataacatttgaggaatctcttgaaggatgggtaggagttttttagaaaggggtggggaagcaaaaagattttgcttttcatttaaagttatgatagccaacatttaccttttagaggtgctcaaaaggcccactgtacctttggcttcatagctgtagaaatcgggcattttccaaaaaaaaggcagtgacggtgcctcacatctggccacaggcatctctcggcagcatgcaggtcatctagggcaagtctctgtaaaggcctttctctctggtgttgcatttgcgtattcatatgtctgcatacaaacaccaagtctgctgttagtggtgtcataactttgcaaaaggaagaaaacatggctaacggtaaaatgagttatgcctttataaaacattttcaatgacagaacttgctcccctctgagtgctttttgaggatcagtaatcataaactgtggctttgccaggaggtgctgtcgaagattgtgtggacattctttcagcaaaatcatctggcatgtgtgattgcttctatttattcaatactaaagaacagaagattgagttttatgagagagagaaaaatgcacattccacatagagattggataaatttcattgtttagagtgtttttattgccacaaagtaatcttctgattgctaggtgagtaatcctgtagttacaaaaacaatcaattaattgatctaaattaatcggataacatattttagcctgctaagcatgaaggcatatttcaagtaactttccagataaaggaggtattgaaccttttcagccaccagccagggacagtgacacagattctagtatcaaatgctgattctcaaattaacaaatgctggaattactatgagaaaggcatggactagggagtcatgaagtcctcccccttttgttatacaggaagcttctaagctgcctgtcccactgttcctccagctcttttgtcccaggcttggccctactgggaaggagacttccctaacttctgggctacccctccctttccctacctctagccacactgtgtttcagggagggcaacatgggagacagaggaaattaagacacctgcatgaaagttgacagagttacccaagaggagatgccactgggcagggactggagagcactcaagggaagggaggcaagtccgtcctttctcctcctttcttcttcaaaatgtattgaatgcctatgcttttccaggcagtttttaggcacttggaatacatcaatgaataaatacggcaaagatccctatgcttgtagaactgacattctagcagaagagacaactaatatataaataagtcacatagtattttagaaggtgatatatgcaatgggaatagaaaaagcagagccgaatgagggctagatggatgctgggatcctaggtggagcaactggctactgttaaaatttatctgagaagtggttccgagagacagcggcagcagtagaggagaacacagcagtcagacgagccaggagggttcctggctgttccctgcacatgtcattaatgtgaacactcaccagcatctcttagctccttcatctttaaaacagggataaggatatctgcaatgtggggaagtgggaatgattaaatatcattgatttgtttttactgctcctctttaaaatgacagcatcaccacaaaggagatgaaatagtcaatagtgaatggaaagcaccaagcacagagactggcacacaatgggtactgagtacacgtttacgttggtactcataaaagaccaggaagagcttatatgtggtgccctggtaatgcctcagatactgttctaaatgcttcatggatattagcacatttaatccttacaaccctttggggtaggaactaatttatgtccattttacaggtaatgaaactgaggcacagagaatttaagtaacctccccacagttttataattggttagtggtggaggcaggatttgaacacaggcatcctgcttctggaactgcactgcagttatttttagagcccaggctatggaaagaaaccattcatttattcacggaacacatttttattgattatctgctacatgacaggtctgtgatcagcactaaggctatagaaatgaaagacatagacagggttcctcccccaaaacattcttgatgtaaatgtgagactcacactataaccaccctaaggattttggtctgaaaagacattctttattaaggattatacatttatgtcctggatttcctagatctggccctgaaggtaaatattccattttcttattggagtataacaaccaacgtttgactgcaaaaaatgtggtagattattttcattcatatgaatatgcctgcccttttctctggtggagtctggcccggtaagtctgtgggacctgcctctaccaatgaggggtagagcttggtgacttttaacaatgatctcctcattagatgaggccatcagttacagcggaaatgatcattattggaaagctggagaccagctgctgtcagagagggatgggctcctgtggaagcttgcaaactgatgactacttaatccttgaacttcagcagcaacaacattagctgaaggtctgtaatgcattcacagttctcatctgacattttccccacatcattatttttctggttttacttttaaattccctataggaccattgacatgaaattctgagggggaatttggaacattaatgactgtttaaggcaaatgagtaagtgttctttccaagaggaaattgtctttataatattggcataaggctatttttaaaatttatactaatgagacgattcgaggcagataactgaatttcccaggcttgaagttggcctatgccccttggtgaattcagccttagggtgagctctgtggggccttgcaagtctggctctagatgcaagagatctgccctatccacattccttctttccataattggttagagccttgaccattcaaacctgggcttggatgttgggcttacaagtggcacagacagtcatggagcttgctgactacaagggaagaaagactttatcaaataacactacttatggatgtctcaactacaaacatgaatcaatgacttgaaagaaggagagtaatattccctgaccttaaacaataaaggactatgaccctgtttggggactggggatggtcattgagggctcccctaaaaataaatacttgctctgaacctcaaatgaagtgtaggatttagaaaggcaaggggccaggtgaaagaaaatggtttcaggaggagggaagaacaagggcttgaaggaatgtatggtccccttggaccatctatgcttcctaatcctggggattgcacctccagtgatataagaatgtgtggcaaagggaaccaggttcctcactgactttgttcccatccatagaaccaaaagggtcttccttagtaatgcctatggctattgggtattgagttcttactacaggatagaccctgctccaaggactttgtgtgaattaacttatttgacctcgacagacatttgcctcaccccactgaaacaagtgacattaacagcaatcaaaagattacccggggacacaaggctatgtaatacagcaatatatgcaatataaaaaaataaataaaacttgaatgcttccaaatgtctatcaaaagaacacaggttgaataaacaatggaatgtctacacaaatgagtactgtggagctctaaaagggaatgaggaatagggctataggctatttgggataatgttcggatatatttttaaggtagaaaaagtaagatggagaaaattgtgtgttatattactgcctgtctttgaggggatgcacattcacatacaaatttacttttttaaaaaataaaagttaggttaaatcatttttttaaaaaaatagttactgttccagttatcttttttctttgtataaacagggtctcattctgtcactcaggctggagtgcagtggtgcgatcaaagctcactgtagccttcaccttctgctcaagagatcctcctgccttagccttctgaatagctgagactacaggtgtgcaccgccacacctggctaatttttaatttttctgtagaaattgggtctccctgtgttacccaggttagtcttgaacttctgggctcaagccatcctcccaccttggcctcccaaagtgctgagattataggcataagccaccatgcccagtctatctacttattttgaagcaaattagtgccttaaaatgtcaacaccattttattatcgtctctcacagtgtagggattgtctgggctccgctaggtggatctcagggtttctgatgggcttgcagtcagtggccgaggctggagtcatctggaagtgcgctcgctcatagacctgggtgtggaacagagagacaaacctctgagggttgaggctggaactgctaaggctgccttgacatctctctatggtctctgcagcaccaaggcttacaggtagctgtatgttttacaagttggcctgaggctccaaagatgcctattccaagagagaggctggacaagctgtactaccttttatgacttagtgtcagaaggcacacagtgtcacctttgccacatttctttttttcttggcagataataaggcccacccaggttcaagaaaagtggggcagcaggggaaggggatggactttacctcctagtgagaagatgataaggtctggaagaggaggtatggcaaaaaatattgctgtggccgttactagaatatataatctgacgcagttacctaaagtgaaaagcgtgaaataaaggctgaagagatagggaaaaaaagtacatttaaaaaaaaagttgtttcatgaatttgaaaacaaaatgaaataaaaagcctattctaaaattcaaaagtcagagaaacaattgaacctaagtgtgtactcaagatgctggcataaccacttgataggaactacccctagttattttaaaacgcagttatttgactctgtccattaaagacaattgaaaaccaaaaaccaaaacaactgcaaagggaaatcttaaagtattttcaataatactgcttttggaggtagtgttggtatatttattgttatataaaatatagtataatattgtgtgtattgaaagataaatgtatatgttaatttggagaactagaatattgaagtatgggaggaagaagatgcagatataagaccagcgagattaatttaaaatgctagagaattggaagtgggattatacatatgaatttattaggtgttttatcttagaaattcatgtattctctttctactaaaaagccctagaaacagtgaccaacccaatagcaataaacttccttagcaaatagattatggtcactagtgatcattttctagcaaaagaaaccaagctgtcttgagaaaatgattgagtttatatttgaggcaggaaataaacaagaagaatctgtaaaatcttgtcataccaagaagcagagaggctatgagatgtcattagggtcatgtcatttaaagaagccagtatgagtagctcaaagatgagataatttgagcctcaaaacaaaataagtgatttcaatggatttaaatacactaaatctgtttaaatacataagttcataatgataggggaaaacaaaattatttataggttaccttacaaagatgatagaaaccatctcattattttagaaacggaaaggaaaaaaaaacataaacaactatcctgcctttgttttcagaattccttgtagaaataattaactagtggatgaagagagtttctctttctaggtaataagcaacgaaaaaatggcagaattagaatataatgaatttgcagttcttactaaattaatatatctaggcagtaaccatcaataaaaagaaagaccatatgacatttgtatgtcctgaagtaagttcacaacgccatctagtcttgagccaaaaatactgcacctgaatctgatccagcctccaggatgtatctatttataggaaacacagtggacaggcgaacatgttaaatgacaccacagagatgcaatctgcgaacttccactgtggaaacaatccaaatgattcaacacgatgttgcaaagacaaaagaattatacatgaacaggaggctggatgaattaaaaaacataagagatgtatcaatcataatctttggttctaatttggattctgatttaaaaatagactgcaaaaaaatttgttagaataatatgaacaaagactagatgtttgctgccatttagaaattctcattagtatttgttcagttatgataatgcatgctgcttctgttaaaaaaatacttttaatcttttacagataccttctaaatatttatagatgaaatcatatgatatctagaattttctttaagacaatctgtggaaggggtgagtggatgtgtgctcaggtgagctaatggtagccatgagtttaatattgaggttgagcgatggatacagagaagttcatcatacgaatctctccactttgatgttttcttgaactctccaatactaaaaatttagccaaaaaaattaacaggggcaacgaactttcttctttttccaagggctttttatcgatgattttaagaaaatggtcagacagcgcaggcgtgttttaccttagtccttccaaagcagtaaggtgcacccacttctcagccaccctccctgactttgttttcacaacccgaattcaccaggaaaataccaggagtctgctttgtattgtgccatcttttaaataatgcctcactttctagtagcaaagtacctcattctttttcttgatacttcaaaaaaacaaaatgaaacaagaacttctcattagctgaaagtgtttttatctagtgagaactgaaatcttcttggcttatttcctcttagatctaaacaatattaacttttttttttttttttttcccaaacagagtctccctctgttgccccggctggagtgactgcagtggcacgatcttggctcactgcaacctccacctcctgggttcagggaattctcctgcctcagcctcccaaatagctgggattacaagcatgcaccaccatgcccggctaattttttgtgttattagtagagatggggtttcaccatgttggccaggatggtctcaatttcctgagctcaggtgatccacctgcctcagcctcccacagtgcgaggattacaggcgcaagccactgtgcccagccttaacaatttttttttgtttgtttttgaggcaaactctgactctgacaccaggctggagtgcagtggtgcgatcttggctcactgcaacctctgcctcctgggttcaagtgattcccctgcctcaccctcccaagtagctgggactacacacgcaccccaccacaccgagctaattttttgtatttttttagtagagtcggggtttcaccatgttggccaggatggtcttgatctcctgacctcatgatctgcccacctcagcctcccaaagtgctggaattacaggcttgagccaccgcgtctggcccaacaaatatttttaagatgcattgtctactaacaggagatgcctctgattctgaagtactttgcgataaacagccacacaatagccaaatgaaatcttgaaatcagagggttgctttctcatgaagttagactgcttgagaattgcagtggcttctatatggcaggtgcttaaattgtccaagttgaaattctaatttttataatgagtagggatgagtgcatgaaatggttgtgtgtttttttatttcctacatacaatatcgaattcaatcccaaacttgaagcattgatgtaattgaaacatgttggtaattttaaatcgtgcagttctgtacatgatcagaatcctaatcattattaaaataggtgtttctattatatgcatatgtataaaaagtcctccaaaatgttaaattacctttctcatctcaggaatagagtcccaatcacttccagattgaagcacttacggggggaaaaggcgaagggctccagtaattttaaattgcttcgtacaatgaagagtgcctgtaaattactgaatgtggtaatttgttccataagcttttttgatttgtaagtaacttagtggatttgctggtgaaacagtttggcaggttcctcagataatttagagatattgagcatagacatctaaatgtgattaaaatgtggtattagcagacattgaccacaggaagggtgaggcaggttttcaagttacagcagctagagaagctgagaaagactacagtcgactctcaggggacttgggaaaggtactaagaatgcacaattgagctaattacaggaaaatgccacacggctggctttggaagaattcatccagcccctggcatgttttgcttatcctctgcctgatgataaaataggggttatttctatcagtggacacatttggcccatatcttaattcaggcaacacagccttagccttgttctgctagtgctaattatttttttgaaaaataatactgttaatatagtaaaatgtagttgttggactcttagaaatggataaagtttaggtttgtaatttcccagacagagagagagtggcataagcatcgtgtgaattcccttctaataggatgtcttcatctttactattttgcataataatgtattgtttggccataagagggatttaggtactggatctagaggcattgggtgtctttaaggtatgaaggggtcaagcaaatgtctgccactcacagagtgagggaggtggagccagaggttctgaacaaagaacctcaccaaatgatggggagaggctgtgatgcatttcatgaggcagtgatgatgtgagtcttgggctctgtaagtgagggtgcatagaagagtaggtcccgccctttttaggagtatactgtggactagagtcaatctgtagacaaagctaggctaacttcctactgggcaacgtctgacccctttcatctttgacctcaagaaagtcactattgttggtaaagtgaggaaggacatggaacctctggggagaatctgacctaaaatggcttcataaagattctcagcatgaatgcccttttttacttgatgaaaatagacctgatagtggttgggttatttgagcagaacaataatggtaaagggaaaatagtagtgagatttatggtgtaggatggtcagatgtggtatgagtatgacacggagccagaagtgcctggtcattcactgatttgtcacactaatggagttagaatactctaccttgcaaggcagagtaggagtagagtatccagtcatcctggtttgcccaattctgtcccacttttgacacagagagtctcacactccgggaaacctctcagttctagacaaacagagacagttggtcatcctattatgagaggttagagaggaagcactttctggatgggttgagtctgataggctctgttgtatttgattagacagctttctatgagatcaaggttttcaataccatcacagaaccatttctggagctgtgttgaggaagagagggcaagggttagagaaaagcttgggccgcagcattgcctctgccatgaagactctttacgtctgtttcacacacagtcagcccttcgtatccacaggctccacatctgcggattcaatgaactatggatcaaaagtatcctctggccgagtgtggtggctcacgcctgtaatcccaagactttgggaggccaaggcaaacagatgacttgaggccaggagttcaatactagcctggccaacatagtgaaaccccaattcactaaaaatagaaacctcagctaggagtgttggcgggcacctgtaatcccacctaatcccagctactcaggtggctgaggcatgagaattgcttgatcccgggaggcagaggttgcagtgagatcacaccactgcactccagcctgggcaacagaatgagggcctgtctaaaataaaaataaaaatagatgtgtttgtgtgtgtgtgtgtgtgtatatatatatatgtatacacaaacatatatatatacatatatacacacacacattcaaagaaaaaataatacaaataaaaatacagtacaactattttcatagcatttacattctattaggtattatataagtaatctagaaataatttaaagtatacaggaggatatgtatagattatatgcgaatactatgccattttacatagggtattttggtatttgagaaaaatcctggaatcagtccctcacagataccaagggacaattgtgctaaccttttagataaagtttcatagaccagagacttccacagtgaacacaagattagataccttaggctagagcgatgggttttagaaaaaaggtggacacatggaattcatggatatgaaacaatacattgtccagaagtaagggtggtccatggagactggttggagtggggtgggagaaccttttcttcatcagagtcaagtcattctgggttggcaatatatatacatgagtggactggagagactgaggaggcacaagtcgaggaggaacacatcttttattttgacttaattttctttttatcccctctccttctaccccagggttcttctccgtgtggatcacattaagggagcgtataacctttcataccgcctgactaggatgatggatgtggaaatacacagtttgggagccctgtctgcttgcctgttaagccattgactgttatatactcttgggcttgaaacaccttccaggctggaggggccagtattgcatttacttttatcccatttctgttttcacggctacccaagaggaaataatttgatttggggctgcagggggtagggtggaaaagtgcagtcggaagacagagaaaatcagcaagaagattactgaaagggaaagagggggaaaccaaccagctatatatttcctgcaacatgagttaatgaaattccgttccttcttacacagctgtattcggtttgttttacattgtttggtatgtgaaaggatttggctttgcgttacagaactaattgcttactagatattacatggatatcaaaatactttataaatattaattaatcttcacctaattccctggcaagcacaaataaccagtggcatatttattgaatgtgtaagcaataatctgattcttaaagatttgttttctctgctgaagctttctcatcatttccatttgtcaaaatgcctcatctcctttgaggaccatatcagatggtacttccataacaattgttaggaaaatagtaataaagacgatgtttagagtaaccaacattattatttgctgaactttcttcctttgccaagctcttgagtaaacatttcatagatatatctcatttaatcctacagcagtcctacaataaaaatgttattgttactacttttttttcccccagatgagggagcaaagtttttgaaagctgaatggtggcagggctgggatccatagcccattctgtccacgtgtgaaacttataataaaagccactatcttgccccttttctgattcacactacagggaggacacttggtacttatcaataactccattcatttatctattcaaaaatatgtgtttgaatgcaagtactattagaggtactgtgctaggctctgttatgacatacctggtgttgactcttgagtagggattacagagttgagcatcttttctctcctgagattcatcatggtccccatgggcagtgaacagtgttgttgtcacactatgaaatgggtatagtgcctggcacaatgaccatttcttgaacaaatggggagtgatacagtgaaagtaaaaagaggatctacagtgtcgtttgcttgtgaatggtgaggggtgggagcgcttagaagatgtaaggatgtgctctcttctttcctcacactcatcttatttgtaatgacattaatttgtgttcttacctgctcagtgtcttctcagtttgacatgccatgatggcatggactatgtctgtttcttctagcgcttcatagctgtattgacacatgtttgttgaatagaccaataccttgttttatgcataaaagaaggccagtaaaaatagtcttacatgcatattaccatgaccgtgaaaataatcccaccctgggcatagcctggctcttgtttgaaatgtgtggtacttctatgtgacaagatatagaataagtcattggaagaaaaactgtcctattactatattttatataaaagtgtatcttgtgttataatgggcctggtatacagagggtgcttagcaaatcttccgcagagctgaaactgagctgaagctacggcccccttctctgcttgctctcctttattctctagagtgctgcttcccaatgcgtggtccatggaccaagcagcttcagcatcacctgagcacttgtcagaaatgcagcacctaggcgccgcaccagacctgttgaataggaatctacattttcacaagattccagatgatttgcatacacagtggcatttgagaagcattaatccaggggcttctttgcagtcagtgatggtgatttgccaatcattagcatttcagaaaccccaggccgaaaccatacatttatccttagctaggtcggtatcaagtttctctgctttcatccagaatcctaacaattcagcttggttgattatctaagaagcttctatttgataattatatatctttcattttttttaaagtgctgggggttgggagatcctgggaaatggcataactattgcttaataaatgcagtttgcttggaagaccaaaatctttcaagtaatgagaagcagcaaaggaaacaactccaacaatgacacaaagatttcctgacaataaaggggctgaggtgaggaccccagctgtggaccacactacccgaagagaaccaacaaccaaatcaatatccaaaaaataacaataacgtccaggtcatttcacttatgagacagaagaggtaaaacaaattctcagatacaaatatttctgctgctccacattgttccatggggccaggattgtgaagtcaatcttcctaatgattaatggaatttctcaccttttgttcaaatgacttggcccctttggtttttaaatgacatctaagggcaaaacagacccaagactttgtggaatgactttccaggaaacaaccatatctaggtaaacccatgctcacaggttccctctgttaatggtgaaattacatcaaggatgaccttttgaaagaataaaactcattatcacatggaatatgatagctgtaaaagagcaacgcttggaagccaaagcaaagtcccgcatatgataaattaattagaatagaagttacataaaacctcgaccttctgtgtgacccttatcttataattacctcttctttaaaagcagaatgaaatattttatgtatgaagatgttactgttgaccctaaatgcattaagagtcaaggagacatttttcacgtattgaaaataagatttgattgagtgcttgcaagtggcctagtgaaatctcattaaaccactgtttaatactttataaatggcagaatattaaccattaattatgaacatgaaaccagtttgaaaataagttttgcaatatctaagcttgattttcaacccttattaatgcattgtctttttcatagttttcagtgttttacagcaagtaggtacttacgacttaggtgtgacttttcatctcttcttcctcctcctccttctctccttcctccttctcatcctccttattgtgttgctctaccaacatggttgtaaaaatctggatgaaaataagaaaatacagtctattaaacatagttataggctgtcactatccacagttataattagatttataaatcatgtgcaagattcccagcaaaaaaaaaaaaatgaatcttaaacattcttttcaactattatcaccccaaaatgaaacaaaacaaaatatagcaacgatatgaaattgtttcagtaacattgccatgttacagtaagcttttgcatctggatcagtcagcctggtacaaataactgtatattctgaaatgtaaatagataaaaagataatgaccttcttgagcatctactgggtgacaatcgttgaaatagtatctgaatttaactgcaccaaggaacataggcagattttgattcagatgacagcttccattatttggcagcagatgcttaagaggctgctttgggaggattctgatgttggatccagcctacatcatagaactgcagccatggattagcaatatgtgttatgtgagtgagctgcaaaaatatgccacaaaattcccatcttacagttatacctttttaccctgaaatgagtcagtgtgttatggtaacattcccagatggcagacagaaggagagccaatgtgagagaccagtgaactcagacccgtctcccaagagccttgtgtaagtcatctaaaaaacaaatgtttcggatattcagggttttctgatttcaaatgtgttcataccatgaataattgtgtagcactatcttactgtgtgctgaggacattaatgtgcttcttctttcatccttcgaatgatcctgcaaaataattctcactgacattttcgtggaggtatccaacttcagctcttatggaaaagaaagtgcctctgtggaagttgcatagatagtaaattgtggcgtggggactcaaagccaggtttgcttgacttcacagtctaaattcaacccaggaacccaacagcctgttgctgtgtgattctgatccccatgaattcactatgttgtcaaatgctgagtttgcaaagcatggtctgagtgcttcccttctggacctcccttaaccattccagggctttccattgcttgtgcagttaatgaagatggaaaatgattcccttccctcccgctctgttcttccatctgtccaggtaatagcctaatgtcaacctagtgacttcatggcatctgttttcaatctactgcctccttgtctggaattctcaggggacacttaagccagaactggggttgaaggaagccctggctctgtgcaagtccacagtacagcagctactggggagggaaaacggtgtgtggctacgctgagggtttcttcctggttgatgcgattataatgtgaaaagatcgacatgtgagcccagagcagatgcataataatgctactgcattttgtatttaacaaaacccctttctcgagaaatgtattacttaccttgtgggtggggaattgtctctgaacccaatcaggttagtcactggcccatgactatctcatttttaataaataataattttctcaattcagcgctagccagctcatctgctttcaaaagataagatatgattgctttgtattttttatattaataaccctcagcatgagaggattaactcttgatgcactaaaggcaaactaccggaccctgggagatccatttcttctcaccagataggctgacacatctttcagatgaatttaaaggtcaacgccttgtgcatgaaaagcaggggcctgcattagatggctgagctctagtcaattcttggtcatttgtactgaaacagaggcaagagagagatttcaaaaccaccacgaggaggcccctaaacatgcaggcatttctttcctttatctgtcgattcaaagagcatctattcagggccaagaaggagatcaggtttatctgacttagtcatacagccataagaaagtttccccctctaaaaaaaagaaaagagaaaaaataaagaggtgccttccattggtgaagcgtagtcattcagaacacaagctttgcagccacccacagcccacagcccacagcccacagccactgtgggtcgagttatactttgcctcttagcagctgaccagctttgggtctgagcctgtttcttcacagtggtcagcccccttgtctgcctgataaatgtctgtctgctcacgcacttggctccgcagaagtgagcttgctgggtccatggggatattcactggagattttgcacaatattatgctctggaaaggggtctgcaaactctgatctgagggccaaatccagcctgccacttgtgtgtggacaactagcaagctaaaatggtttttacatttttaagtggttgcatcttaaatgcttatataatggctacataaaatccttaattttgcctcttggcccacaaaacctaacatatttactactggctctttaagaaaatgtttgctcaggcctgctctggagtcctcaaagccacatatataattttaaattttctgatagctctgctaaaagaagtaaaaagaaacaggtgacgttaattgtagtgtgttttctttaacccaatatattcaagtagtatccctgcaacgtgtaggtaatatagaaattgcgaatgaaatattttacattcttttttcataccacgtctttaaaatccagtgtgcattttgcacttaacagcacctcttaatttggactcaccacatttcaggggtttaacaggcacatgtgaccggtggctgccgcattggacagtggcagctctagagagctggaaccaatttatgctccttctgacattcacagggaatgctccgtataaatcttggtctcttcttcctttttaaggtcacatagcacctggatttaaactccaaagctaccccaattttagctggagggaccatattccaagctgcaaatattgtacccacccagcaaatttcctgggatgtgcttcctggggaaagtgaattcagttgctgtagcccttgatttgataaaatgctcctctttctggccttacccttgctcaatcatttccaattccgctgctggttatttaacacgccaggggcagtaggtgcatacagtcctatgctcccagcttatgaggaaatgctctgtccctccacaggcttgatcagcggcctccctgctcctgttctctagatagaagtttccctagttttgctggtctcaactcatgcacaggaggaagccagaagtgccctgctgtgatgatcaatccatatgcatgtttgcctccagcaaaccaaggacatttaattcttggccagagtctcatcagctccatcagtctatgacaataaaatgaatgtatgtcttgatcacaccaggaagtctctgctaccaacacccccaggagaaaacagctccaggctcttgaggctcctcaagtagcaaagtctcatcgctcaggtctcgcatgtcagaatttgccatgattcactcacagcatgtgtcatgtgtatctggtagaatgtctgaaatgcattcttcccatatggcttttcagggccctaagtgtgaatatgaactttgcatgtgaaagatgcttcattttgcattttgtttgcttgtttttgtttttttgagatggagtttcactcttgttgcccagactggagtgcattggcgcccaggctggagtgcagtggcgcgatctcggctcactgcaacctccacctcctgggttcaagcgattctcctcccttagcttcccaagtagctgggattacaggtgcccaccaccacgcccagttatttttctgtatttttagtagagactgggtttcgccatgttaagcaggctggtcttgaactcctgacctcaggtgatccacccgccttggcctcccaaagtgctaggattacaggcatgagccgctgtgcctggccaagacgtaattattaaaattaacaatgttcatctcagtatactgcctaaaattacgtgatatgccaaagtgggtgtatgtatcccactttgaggaatactgatgagaaaggatgttaggcctacagagatcttcatcttcagaagagcacagataagttctggtataatggaaatgacagcgtcttggcattttttactgctgccttcaaacagcagacatcacagcccacgatgatgagcctgctgatgccgacttcctgcattctgtggtacacctgggctcagcttagaaaggctctaccccaactcatacttcttcatggcaagatgaggtgaattcatttctacccatagtcattctaatctgcattttcataacccacctttccattctccaagtgtgactttcatttttaggacagagttattcagtcggtgaatatgcagtccctttaaagggatatttatcacccttgaagaatcttattgccaaatcttaatagtctttcttataacaaaggctcaaattcactatcaagattaagaggtggagcttgaatgagctttgctggagcatctcatgataaaatagattaaagtcttaaaatgggcaacccatcgaggtggaagtcaaacaaatatgcaaaagcgtccctgtattttcctcaggcagtttgggcactgtgggtgagcccagagggtgaatggtgggaagtgggagttaggccacgtggattttccctcaggctcagcggggtgacctcccatgagaagctgaaactatcttaattactttgtctgtaaaatagtggtggtgagcatggggagagcttgcctacctcagaggcttgtggtgaggattacggggaaaagtccatgtaaagtgctcccccctggtttctggcacagaacaaatgaatgaaattcagatccatcatttatgtcagaggtccccaagaccacccccaggttccttgatccccaagtcctaggaagtcctagagtccccaaggccacccccagtttccttgatccccaaggaggactcatggttaagatttattacggtgaaaatatacaaaatgaaatcagcaaagggcaaaggcctgtgagcgaagtccggaggaaatcagttacaagatttccacaatcccctcccaatgcagtcacacaggatgtgcttaactcccccaagcaacatatggtgacaccgtgtgtgaaatggtttctacgagggaagctcactggaggctcagtgcccgagtttttactgggagctcatcgagctggtcacgtagacagcctctgcctgatacatagcaacattcctgactcccggaagaaaagcaagagttcagcataaaccgaatagttcatacaaacatgaggcacttggagccactcttaccagttatgggcatgggaatactctccaaacccaagttcccagatgccagccaagggccagcctttcaggcaggcctttccaacattgcagtctgcaatctgcttcgtaactcttttctgcccaggactagaggtcataaggcccctactaactctctggcttcatccccagtactacctgttaaccaacctgacattcctcccatcaccccgcagatcctggccccaaagccttaccttggtgctagcagctgcctctgttttgaaagctcttcccctgagttctccatgaccaagtcctcacccttttcattgcagatgcttgcgtgttcccatcactgagttctaatttctctaatggaagtatcattctaaagttatcctttgtccttcttttattcttgttcatgggtatctccactagaaggaggatatatttttctggcagaagaacatgcccgtcctatttattgtgttatcactagtgtccactatagggatggacaggtggtaggtgttcaatatttgcctcatggatattgggaattactatatttattgttctgtgtcccaaagaacaaatgaagcccccacacccttcctgtttattgacttaaagtattgtctttgaatgttgaaaaaagtttttagaaaatgctgaacttacagggaaattcaccaaagtaatagtaatatcatgaagatgctcattgcttctgggctttccaaatctcatctttcctcaattgtgccttctctgcatgagcctaatttgaaaaaaacctggttcacagagggctgcttaagaagttgatggttttgtttatactcaaagtcattgtggggacctctattttcaccttttttggcctaggttgtcccagtacttctctcattctgtgattgatgtcatacgtgacaagtgtgatgggtcacttcactggcctctccaggcggtttattctttagctgacttcaccttgctctggccttatgtaaaggtccctgccctctggcttttagtgggttcaacccacaagtctgcaaactttctcaaagagccagataataaattttcagacattgcaggccatccagtctctgggcagctacactactctactctgccattgtagcatgaaagcagacatacacaataggtaaaccaatgagcatggttgtgttccaataaaactttatttacaaaaactgacaataggctaagatgtggcccgtgggctttggtttgccaatcaatggtttagccagtggaggattgggacaagaactcagagggagagaggagaataaatctttgcaggctgctctgtccttccattgggggttacagttcttctcagggagccccctccatgtggccgcgtcttttgggtctggaaattgtttcctcccctggccctctaggcttagatgtgggaaaggtgccccattattactggcatgttgctttatgctgtgggccccttttccttgactctgactgtacttttgctggttcctgcgtccatctcttgtcacatagctcaatttgcgtgtgccatcaatttcctgctgggattaagatacctggcagtgcagggtttcctgggatatgggacctctaaaaccgaaacctagacagtcccagtaaatcaggaggattaatctccctaactggaacccagccctgtctcctcccttggccctgctccaattaccttcattctggccctcagtacccccaacttggataacggctttgctggccagtgactaaatacagtggccagatggggtctgtggccatcgccatgtgcacctctctgctagggcttatttgcccttggaacaaagtctgtagctgatgtttgacaagccaaggagactctagtgtagtcccccagcctactgtagaggctcttcacattatcatattttatactgcataatttttgaagatgatcccttttcttccaaattgtagtacaggagaggtatgctatttttccataagaaaaatcagacttactttgaaagagcagtaggattagcagacactttgaaatattacattaatccagcttgggttgaaaatatccaaaggactgactcatgaaatttcaagtaattgaacttctggactcaaacagacatgagaagaaaaagttatgttccttcaaactatttcagctcagatgattttttcctttttagttcaaaacctgacaaaggtttgcttgatgaggagaagagaccaccttccccacaatgaaagttaacgctataatgataataggagggcttatgactgaatctgtattcagatacaccgattttgtttgcttttagtggcaagcaggtttagcaggttagagaagagggtaatgttttgatactgtggtgaagctgaggagggcgatgtccttagtctgaggagaccagcatgaagccacctttattgccctaaaatgtctctgccttcaaacaagtgggctaaagagggagggcctgatgctctgaaaaggaaaaaaaaaaaaaaacttggccgggtgcagtggctcacacctgtaatcccagcactttgggaggcccaggtggacagatcatttgaggtcaggactttgagaccagcctgaccaacatggtgaaacctcgtctctactaaaaacacgaaagaaacagccaggtatggtggcacgtgcctgtaaccccagctacttgggtggctgaggcaggagaatcgcttaaactagggaggcggaggttgcagtgagctgagaccaccccactgcactgcagcctgggtgatggagtgagaatccatctcaaaaaaaaaaaaaaaaaagaaaaaaacttgcataatggagcaggctaattcaggttcccaggatctagatgacagtaaatatggaagctgctttaaggagatactggagacattttaatggtgttggccgtttcattgtaacacaaatgacttctctgcagctgttcaaggaagactcttttcctatgagtgttggtagatgaagagtggaaactcaggtgcttggcaaggtcagaaagttagtgtcaatgagtgaggaggcttgggtagaagaaaagtctgtatgaagacataagtacaaaccaaaaatcacttttagttgactatgaggcaaacagcagtgcaactgtgatgacagaaggcaaatggtacttgctggggacacatgggatgcatggcctgtggacatctagaaatgaggcctgtccatcaggaggtcaaccttaccatccacggagtgttgccctgtttgactccaagctcaaagctgtcccaaatccagatgctcggtgaaaatccctgatatttgaatggcagcctctgcaagctaaaggccatctagcagatacagtggccatatgggacgtgccagccatgattttttgcagcctctctgttagtgcttgcttgcccttggaacaaagcctgtggctggtgtttaactatcatgggagatactagtgtggctgaaaagtctgtgttctgaacagtactatggcactatagacaaactttcaaggtcaaattgattatcctgtagtttagcaaagcagcagctccctaattatgtcaggaggcaggattatctctgatcatttgagctaggactccagataaaacatcaaaagcaatatttaaataacacacagccatggttaaggattcattgcattttctcttactataaaaccaaaattgtggtggcccattttgttccattactggaagggttttccaggctgttttaactcatacatagtgtaaccctttcccttattacaaaatttcactctgggaaagagcaaagctgtactttgtggtacagtgttatgatggtttatgttcatgaaggtcctacaaaaattcagaaacattcttaatccaaatgatctagaaataggaactggaatacctactgtgctggagctgcttaacccatgaaagacagttgtacacagctcttcacaactccgtattcagtgatttcacattagtagcttgaaattagccatgatgggagcatttatgccctggacattgtcaaaactcagaaatcaagtcatttatttcttggggagctggtcattaaacactcactaggatgcccttgggtacccctcactgctagaagaattccctccctccctgtatttctcccttgaaatctgagccagtcttgcattctacatatatatatatatatatatgtatatatatatatatatatatatatacacatatatatatatatatatatatacacacacacacatatatatacacatatatgtatacacacacattcctatcttctcaaaaattcttgccttttaaaaagttgttatcaaagacaaggaattttttaatcatcagggtagctcagtcttgagacatctgagtccttctgagtagtaaccagtagctgcaccgaagagacagttcaaggactacaaatgatggtagtccttgaatttcaagtccttgggagttcaaggcctatcctcatttgtagttcttcacactgtaccactctttatttgtttaaaatataagagtgcacaggcaaaaatcagctaaatgggagttgtccagaacagtgctttctccagtgaccttactcacccctccatgaggactcagttaattctaatctctattttgctgtttctatgaggtcagaagtccccaactttttggcactaggactggtttcatggaagacaattttcccatgtaccagggacatgggggaggggaggatttggggatgattcaagcacattacatttatcgtacacttaatttctattattattaccttatataatgaaatagttatacaactcaccagagtgtagaatcagtgggagccctgaacttgttttcctgcaactagacagtctcatctagggtgatgggagacagtgacagatcatcaggcattagattttctgaaggagcatgcaacctagatccgttacatgtgtggttcacaaagcacctataagactctaatgttattgctggtctaacagaggtggagctcaggtggtaatgcaagtgctggggagcagctataaatacagacgcagctccactcatgggcccgccactcacctcttgctatgtggtccggttcctaaaaggctgcagatggatacccatccatggcctggggattgggcatccttgtattagattactaactccacccttaaactttttaagttgtgttttcaaagaaggtatcagcatgtcagtctttcctataatgttctgtgtttcttgaagatagggaccttgcctttttgtgtatattgacaattagtgtatattgtcttggcactgacacacagtaggcagtcagtagatgttacttgcatcaatgcatgagtccttcagaatacatccaattggcattcagtgagcagttgttcaaattccttttaattcaggatggtcaaatgtttgtatgaacatttggggaaacatcttaactgtctaccaggcagttagattttaaagaaaagacatgtattcatatactccgacccaggggaagatatgtggcattctgcttaacataatcagttccttgctttccacaccaatttgtgcttgatttgtttcttttcttctagaacttttcagagtgagaacctttagcagaaaaaaaaagcttaacaagatagacattttagttcaatagaagaatttttctggtgtgaaaaagtaaattacaaaaaggactttggttctgaaagataattaataaaaaccttcccatgtgatgacaaatctgacatcttgtctaatgtctggcagagaagaaagtgttgagagctgcacagttggaataaaatgttccactttacagcaaggccgggtaggatctgataattatttctaggcaacaaaagttcatagtctaattgttcaattgacacaacaccaggcctggctctgtgactatgcaccatcagtgaggtcttcgtttaggctttcctgatttcacaggtaaatattgccaggaatgtgggtgatcatggaatgactccctcgtggatattttggactacagctgtacttatagaactttcctttccctcttgtaagcttctcatgggctgtggtaggctgagtaatggtcccgtaataagtctacatcctcattttcagaatgtgtcaaggttacctgtatgacccagatgagtatgatgtaatcacaagcttacagaagggaagtaggaggagccagagttagaaacagaagacgatgtgatgaaggaagagagacagagaaaaacaggtgagaagaggccatgctgctggcttgaatgaagaaggaggctgtgaactaaaggatgtagatgacctagctggagaaaacacattctcctgaaggagttcagccctgtggcttcagactttagaactataaggtaataaaactctgggaggctgaggcaggcggatcacaaggtcaggaggtcaagaccatcctggctaacatggttaaaccgcctctctactaaaaatacaaaaaattagccgggcgtggtggcgggcgcctgtagtcccagctactcgggaggctgaggcaggagaatggcgtgaacccgggaggcggagtttgcagtgagccgagatcgcgccactgcactccagcctgggcgacagtgtgacactctgtctcggaaaaagaaaaaaaaaagaactataaggtaataaagtattttttttttttttttttgagacagagtctcgctctgtcacccaggctggagtgcggtgatgctatctcggctcactgtaagctccgcctcccgggttcacgctattctcctgcctcagcctcctgagtatctgggactacaggcgcccgccaccaagccctgctaatttttatttttattttttttttgtatctttagtggagatggaatttcaccgcgttagccagaatggtcttgatctcctgactttgtgatccgcctgcctcagtcccccaaagtgctgggattacaggcgtgaggcaccgcacctggccaataaagtatttttaagcctctcagattttagaactttgttacagcagcattatgaaattgatacacgcgggcatgttttcctgaaatcagagcctgagaggagaaccaggtacaggtagttttctttgggaggtgatccaggaagcaggagtaaggaaggatgagaaggcaggaaaggagagagaaccaatatattaaggaatccttgagctcactgctgtagacagccaggggccagtgcacagggacctcgagaggcacagggaatgactctcagacgtgtctgtctgcaagaaggcaggtgggagcattcagccagctgtcatttccaatgcactgagggctgtccataggagcattaactccccctcctttcccatctctgctttccctcacattagccaagctcctgcagtgtaggagaaagagccaaagcagaatgcaaagagactgagggcactctaaggggcaagcctgacttctttagaaactcatcgcagcagcaactgagatcagaggttggctgaggtattggctgcagccaccagcatcatcctctattgggctgacccctcagatgacagacctattcatttactgtttcccatcttttgtctctgtggattcaaggtttcttggtgtagaccagacaaggttcccagtgcctgccacatggtaggcattcattattttctcatttgaactccctgaggctactaaggcccacccaagagtacctcatataggggctcctttgtttgacttaagggaaacaggtattatatggcattcgacatcactaatttaattacaaaaaattcataaatagatgcaaataccaccaaccctgagcaggcacatcctctggtttctcctaagggccagccagcaagccaggcattcccagtgtagtaacttaaattcttacaaaactgtatttttccttttaagttttccaagtgagcccagtggcttaatcctggaatcttaatagtaaagagttaattccatttagacaaaaattgtgatttcactgagtgaattgttcttggctctgttttatccaaactgaaggagggcatgcatgagtcctattttgagacaaaacaccttcaaataatctggaaaacaacccagagtttatttctgccaaatggctccctgtttcttgaactggcatgctatggtgtttgcattgaccaaacttctgcgtggagcctttgttcttagaggttgtcatgtgaaaagtttcaatcatctttctaatatgtccttgtctgtgacatggtcccagtccttattttcatccaaagagcatgttgttccttcttctttatttccacaatactttatacataccctctatattaatataactataatattaatgtatacttattatataagaaatatatatcagctatcaatataaataataactagcacataacacctactgtgagccagtttctgtcctgaaacatttgatttgtgtttactcattgactcatacaaccaatgggagtagacacaattattagttgtgttttgcagatgaggaaactaaggcaaagagaatttaagtaacttgctcagggtcacatagaaactaactggaaaaattgagatttcgacccagttagtctagcctgcgaatctttactctgagctactttttaactgattctcaatgtatagtcacataggttgtagtttattatatgtccatgtgtctgtctttccttctagataataagttttttaagggttttattcatttttccatctctagtatctaggccagagcctggcagataatagaaatgttaaattttcactaagaaaatcaattttaaaatgaacctgatgatgctgtcataatggcagatcaaaatgtcccataatttgaaagaggcaattactaaaacaatagcaaaaaataaaataaaacaaaataaaataaaaaatgagagacaatgcttatttatgccaaggagaggagcacttaggacactcattgccacatcctgactctgacagccttgtcaaagcattccaaagccatgaccttcccttattctcccttccttccccacctcgccttcaaattccctctcctattcctttctaactcctctattttgccctcttcattggttttcccaaattatatttacatgttaaaataccaagtaaagggaacccatattttctgagtgtctattgtggggccaggctatagtagactgcattagttcccaatggctgctgtaacaaatgaccacaaatttagcaatttaaaacgaacatagtattgtacagttttgaatgtcagaagttcaaaatgggcttcactggactaaaatcaaggtgttggcagcgatgcattcttttctggagtctcatggggagaattccctttatgccatctccagtttctaggggccacccacattccttgactcctggccccttcctccatcttcaaagtcagcaatgtggggctgagttcatctcataacatatcactctgccctcaccttcatcatcacatctctttctcttatcctttcttccattttcaaagatacctgtgattacattgggtttacgtgattacataatccaggataagcatgctgttttaatgttagctgattcccaaccttaattaccctttgccatgtaatctaacatattcacaggtcctggggagtagggtgaggacatctttaggggactactgtctattctgtttgcgttatctcattaaagcttcccagtgaccgtttctctagcaaagagcatgtgaaggccattcactctgaattaatttaccaaaagccagagaaatcaccacacagccagaatttggacttaggttagttttggctttttgccccatgcttttccttgttttattgttttcttgtgcttcacttttttttttttttgtacttcacagatactgtatgttttacaaattgaagatttgtggtgttgaagtcaaaataaaaatgtagagatgaatctctaaatttagcatttcatttgggaagaaagacttgcaatttggggcatttatgcagattaaatagtctttggtatgttcaaagaacaaagagaaagttggaggttttgtaacaatgaaaaatgttatgtattgctctttgagaaagttcattgacactagtaaggttctgggaagctggcaagcttcagctggtgagtggcatcagtgagaaaattagtcctggagttgcagcaaattatcttgaagctatagataaaactgggttcaggttacagcagccaggcttgcagagaattacattgttggagcaatgctttgtgtccctagtgtgtttttgcctggcttcttgactttgctttagttgggtatgacaagaataacccaatttgtaggatcagctttcaccttgacaactctgcactgagcaagtttatgggtgctgtttttccaacagtatgtgatcactttgtgtctctgtctcatgttttgataattctcccggtttctttcctttttttaaattattactttgtctattttggtgatgtctgatcagtgacctttgatgttactattgtgatttttttttttttgggtggggggaggcaccacaaactgtgcccatataagatgccaaacttaattgataagtgcgtgttctgactgttccaccaactggccctttactcatctgtctccttctcctccaaacatcctatttcctgaaacacagcaatattgaagttaggccaatgaataagcctacaataaagtactttctttgcctctaagtgttcaagagaaaggaggagttgcatgtctctctctttaaatcaaacctagaaatgattaagctaagtgaggaaggcatgtcaaaagctgaggtaggctgaaagctaggtttcttgtgccaaagagtaaagttgtgaatgcaaaggaagagttcctgaaggaaactaaaggtgctactccactgaacatatgaatgataagaaagtaagacagccttattgctgacatggagaaagttttagtggtctgaatagatgatcaaaccagccgcaacgttccctcaaaccaaagcctaatcctgagcaaggccttaactctattcaattttctgaaggctgagaggtgaagaagctgcaggagaaaagttggaagctagcagaggttagtgtgtgacatttaagtaaagaaacgatccctataacataaaagtgtcaggtgaaagccaagcacagtggctcacacctgtgattccagcactttcggagaccaaagcaggtggatcacgaggtcaggagagcaacaccatcctggtcaacatggtgaagccctgtctctactaaaactacaaaaattagctgggtgtggtggcacgtacctgtaataccagctactcgggaggccaaggcaggagaatcggttgaaccagggagtaggaggtttcagtgagctgagatcacaccactgcactccagcctggtgacagagtgagactccgtctcaaaaaaataaataaataaaataaagtgtgaggtgaagcaggaagtgctgatatagaagctgcagcaagtcatccagaagatctagctaagatcattgatgaaggcggatacattaaataatacattttctacatggttaaaacattcttatactggatgaagatcccatctaggactttcatagctagagagaagaagtaaaggacaagcaaactcttttgtctgggactaatgcaactgatgactttaagttgaagccaatgcttattcaccattgcaaacatcttagggcccttaagaattgtgctgaatctactctgcgtgtgctctacaaaaggaacaacaaagcctggatgacagtacatctgtttacaacatgatttattcaatattttaagcccactattgagaactgctgctcagaaaactatattcccttcaaatcttactgttcattgacaatgtacctggacatccaaaagttttaatggaggtatataaggagattagtgttgttttcacacctgctaatataatttccatttttcagcccgtgaatccagaagaaatattgactttcaagtcttactatcaaagaaatacattttgtaaggctacagcttctaaagattgtgattcctctgatggatcaggacaaaatgagtcaaaaacctgctgaaaaggattcaccattctagatgcccactaagaacatttgtgattcatggggggtggttaaaatgtcaaaaataacaggagtttagaagatgttgatttcaatcctcatggatgattttgagaggttcaagacttcagtggaggaaggaagtgcagaagtggtcgaaatagcaagagaactagaattagaagcagagcttgaatatgtgtgtgaattgctgcaagctcatgataaaaatgtgaatggatgaggagctgcttcttatggatgagctaagaaagtggtttcttgagatggaatctaatcctggtgaagatgctgtaaacattgttgaaaagacaataaaggatttagaatcgtacctaaacttagttgataaagcagcagcagggtttgagaggactgctttctattttgaaaaaaaagttctcctgtgggttagatgctaccaaatagcatcacatgctatagagaaatcattcgtgaaaggaagagtcgatagattggcaaacctcgttgttttcttattttaagaaattgccacagcctccccaaccttcacaaccgccaccctcatcactcagcagccaccaaaatggaggcaagaccctcaccagcaaaaagacaaccacttgttgaaggctcagagatcattagcattttttagtaaaaacgtatttttaaattaaggtatgtacattgtttttagaaataatgctattgcatacttaataggctacattatagtataaacataacttttatatgcactgggaagccaaaaagttcatgtgactcactttattgtaatatttgttttattgctatggtctggaaccgaacctgcagtatctccgagggatgcctgtacatgcagcttccctgtttacagtttgaggagaatatgttgggtagcatcttttagaaataaagtctaggatgttggttcaaattttgtgtgaaagcaacaatagggccaggtacggtggctcatgcctgtaatcctagccctttgggaggctgaggcgggcgaatcgcaaggtcaggagttcgagaccagcctggccaacatggtgaaaccccgtcactactaaaaatacaaaaaattagctgggcatagtggcggatgcctgtaatcccagctactcgggagactgagtctggagaattgcttgaaccctggaggcggagggtgcagtgagccaagattgcacctctgcactccagcctgggtgacagagtgagatttcgtctcaaaaaaaaaataaaaagaaaaagaaaaagaaaaaagaaagcaacaatgggaccgacgaaactaaaagcagtctccccttttacctccccaagaactgtaaaaccatttgtaagtgtctgtgaccttaatgaccagaaacgtgtcaggttttctgtgttcctggggctgtaaaacaccaggaacattttaaggaggtcagactcagcaggggcgtggacatgagtacatgcacatgtgtgtacgtgtgtgtgtgtgtgtgtgtgtgtgcatgcacatgtcctggaatgctccattcctccatgctttccctgtaggcagtatgcctttgtaaacccttccaggactctgggtttgtgctccctgggaggataaagaattaatcaaaatacactgctgcgatatttttacatcctgcaagtcagaggcagtatcctttcttcctcacaaatctaagaccctccaaattgatctcaatacactgactttaacaagagtaaaccagagatgttttatggcagggataaagtaactatcaaccaacactaatgacaagaaagcaaaaagagttggagagaggaaagcataaaggatcccagagacactggggtgttggtttggaaaataccttcttggagctggtttaagaggggatggaacctgagagtgttctcaacctcgtgagattaattatttgtggcaggaagtttctctctttatttgtggctgctttggagacagttgtgtcatgtttttcttcagtcctgatatttttcactggcctctgggatatatctgtgatgtcagtggtatcaaagacttttctgcccttgttccatggatgtttagtgtacaatcagctgctgcaacaaacaacaccaaatctcagtgactttgcacagcgttccgtggatgtgtcttgtggggcggttctcccgagtaactgtcttctgtgcaatgactgattctgggctctttctattggatgactctgccaccttgggagtccttccttcctatttccatggataggagaagagaagatatcatgcaggacattcaggggccatgtctagaagacgtgagaatccttccacccttattctgttggccagtgcttagtcacatgtctaaaattgtaatggagcagcagcaccatgtcctattgtgagaagtagccagagactaatctcaatgacagttcttatagcttgaaaaggtatttgcaaaatctaaagcaaaagttgccaactcgaatgcctagatgtccaagcaagtgtttaactgaattgagtgagcagaaacaagaaccagggagtggtgctgagaaggaaagcttggagaggggcactctacataacatgacaatttaacttgatgacagacttctctggctaaactaaccacatctgctggccacatccatcccttatgctgccagttggcaacctacagtatgggagagaaaaagaaaaaatcctttctctggaagcaaactccaaagttgggtatattcttgaatcagtacctgtcaggataaaaaaaaaccctttctttttaagaaagaacgaaagttctgtactacagcaaataaatggaagctaaaaagaaaacctggtataaagagtgtgatttaagaatttgctttctgtgcatacatttagggtagtggctcttgcatggaagagagatctctgagctgctactttaaaggatgcttggtgtcctacagaggtaacacaactcaatcatatcaggcactgatgttctgatggtgcagctgatcctgagatgcaaacaccccatgatcttctgctgtctgattccctgctatgtccctgtatgtagtctaaacagtctattcactgaacagttttttagtaacaacaaaagtaataatatgttggtaatagtttgtcaatgtctaccctggagaatatcagtgaatcatgaatatggatttaaatataatacatagaaataataatagcaagcatttattgagcaagtactatgtaccaggaactacttaaggctctttacaataattaactcacttaatcctcataacgggtgagataccattactcctgcttttcagcttagaaaactgagacacagaaggttacttgcccaaggatagcccgctggtaaacgagattcacactgaaccaacgtggcttaaacctgtgcttatagtccgtctgaaacgtgaatctttgtagcaggctgatggtaatttttagataatagaaatcttttgttaatcatagaatttgattattgctgtgctttcaaaggtgtcttggttacctctcatttcttaggtactcactgatgcataaatggacaaacatgtcatagagtaagactatgattgccgtggcattaaagataaatttggaatgatgctcagagcatatattctagaaaatttacagaggatttggggaaaactatgtccaggtagtatttttatgcatgtgacatctcataatattggagaaagggcttgcctggttttggagtaatgtccaagttctaattcttacagcaatgaggggtgctgctttactgctttccatccccttaccaaagttactgtgaatgaaattgaagagcggatatcggtggcaagttcaagcatagatactgttttgaattctcttaagaaattaaagggcaaggctgggcttggtggcttatgcctgtaatcctagaactttgggaggccgaggcaggcggatcacgaggtcaggatatcgagaccaccctggccaacatgttgaaactctgtatctactaaaaaaatacagaaaattagctaggcgtggtggctggcacctgcagtcacagctacttgggaggctgaggcaggagaatggcatgaaaccaggaggcggggcttgcagtgagccaagatcgtgccactgcactccaacctgggtgacagagcaaggctctgtctcaaaaaaaaaaaaaaaaacagtaaaaagaaatcagaagacaatagcagtaactagaacattctactattattgactagtaagatatttagcttttggggaagtcctaaattagcctggaatcatttttaaatgcagttttgtaatttcagtgatgtgttacatgaaactcaaagagccacaaaataattcacgtgtaagcgaagagtgtgctggtttaaaagatgagtctgcattcttctccctttatgcagataattcgtaatcatctttgagatcccagcagaaatgtctcttttgtggttttgctttccttgatgctctagatgaagttagacttccctataccccaacttttacatgctcccagagagatctatattttcctttccagttaaattttaatcttggtgaatcacttaaattatgatttgttaatgcctcttttctttttgagaccataattatatttaacaattattgactccttatcctgtgtggcacctttctcattgctttggacaatgtgtagcaaagtcctcactgaatcccaggagtctaataggtatttgtgaatgaggagtgagtgaatgaatgaatgatttgactaattcttacctcactaagtcacccatggcccaggagggtactgtgtacctttatgttacaaatcatttaactttaattttgactggtaggtgaagtgtcccaagaatttgtaaagataaaactgtgcctttggggcttctcctactgctcccctcttccctaagagtcagcagctggaaaaggtttatttattttttttattttgtaactgtagaggaatcctgaatgggccctgcaaagtaatctcagagattgagccacacatagacaaagatggagaacacagctcacctgcagagtgctgtttctcatcactaactgtggtttctctcagtcctgactttttatgctgaggattctgggagaaatttcaccttctttacttcctacaggatatccagtttcctggtctgggagctgagagcagaattagccaattggaaggttaacgcataattgtaggcactgggtgtatggaggagacccttgaccatttgctatttaactgaattaatgttggccagttatagattttctgtttgcaaaattgccagcagatttttctgactcctggatctgcatcctgtgtatgtgccacttgggatgccagcattttgattgcttccagagcgatctaaccagagcctgctctcaagacaagggaatccatgattcacaagcggaaccgtacagatgccagaccacagcgttcttttcactttgatttgagggagatgatgttggtcagggtgatgactcccccatttcaatttctctgatgttgttcaggccagccacacggtgaacctcctgagattgattcttgctcccttctttggggttcagtgcatttcagagggctggtatttagagagaagccctggttccacagcttccaaccttttgacactgctttgagttctctggtggggatgataatgaattttcttcaactgtctgtgtgcagtggttaggattttgaggtctgatattgaagttttgttttctaagaaacacacagagtcgaggatttgagtgcaagtaatttgagtgatggcagaaattggtttaagaaaaatactagctggggccgggcacggtggctcacacctgtaatcccagcactttgggaggccgaggtgggtggatcacgaggtcagcagatcgagaccatcctggcgaacactgtgaaaccccgtctctactaaaaatagaaaaaattagccgggtatggtggcgggcgcctgtagtcccacttactcgggaggctgaggcgggagaatggcgtcaagctgggggcggagcttgcagtgagcagagatcatgccactgcactccagcctgggcaacagagagagactccatctcaaaaaaaaaaaaaaagaaaagaaaagaaaagaaaagaaaaatactagctgggtgcagtggctcacgcctgtagtcttggcactttgggaagtcgaggtgggtggatcacttaagctcaggagtttgagagcagcctgtgcaacatagtgaaacctcctcagtacaaaaaatagaaaaattagctgggcttggtgacgagtgcctgtagtctcagctacttgggaggctgaggtgggaggatcgcttgagcccaggaggttgggtctgcagtgagccacagttgcactccagcctgggcaacatggcaagactcggtctcaaaaaaaaaaaaaaaaaaaaaaaaaaaaggaaactttaaaagtcaaaaaaaatagaaaaaataccaatagggaatgaggaaataagtcagggaagagaaggcaggtaatgaatgtgagttatcaagctagattctctggtggactttggcactcaatcccaggtggaaactgggagacaaaatgcgtatctccaagtgatctcaccagaggggtgagggaattgggatatttacataccattccccatcagttattggttaaggaccactcccaggatgttaatttccaaacactctcttctggcactatgctcagataaaatacccttccacaagttttagagacatatctcgtacaaagaagaaaaaatgcaaagtcctgcacgttgacacagaaggtctgaggggaatgggtaggactctgacagagttcctttgaggacacttgaacctagattcagatgctggcttcacccattccaactgtatgatcttgggcaagcttgttaacctttctagaatttcgagttcgtcttctataaaatataccttataacattacacatttcataggcctgctgtggagatgatgcatatggtgagtttagcacattaatggccaaatactaagggctcaaaaatggtagctttcatttgttaagtgttacggagcctcttctctgtcccagtatgtgtggtaggtgctcagtagaaccagtggttggttgttggggggaggtaatacctgtttttatggccttatagcctttgcgtactaaaccttaagaccatttcttatttcactaagtcacaccttgcccaggagagaatcgtatacatctcatacattatgttccaaatcacgtaacctaaatttttgaccgctggatgaagtgtcttaagcatctgcaaagacagaactgtgcctttgaaagcaattgtaaattttaagttttatagtagccaagtttgcaaaaggaataagaaactggtgaaattaattttaataacatatatttaatttcatatgtaaaatattgtcatttcaacatgtaattaatatgaaattattgactattttacattcttttccttatttagacattgaaatccagtgtgtattttatacttacaacatgtcagtttcagacctatgactgttaaagtactcagtagccaccggtggttcatggtcaccatattgggccacagtgaaggcttaacaggtcctggattccttttagaagtaaattccaacagaatagttccattttctctttcctcctcttcatagatgacaatgcttctttgcttgtataaaaatgaagttggttttagcttaggcatcatggaaaattgacagtttctgtaataaaatttcacacatggaaaccatggtgagaatcttagcaggtgtaaaaatctgacgaagttatttctttaactgcaatttaatggaaactgcagcagctgttccatttgcgtattctccaaatctcagtgccaaaaagaattgttggcagccactggagaagtttcaacttacctcttcatttgggaaatgaaatcaaaacctcagcttgtttctaaaagttgcggatttggcgaaagttagcagggcaaacacataagccgctattaaaatattgatggctttggttttctcaggtgctgctgctaacatctgcagaagatttggactgcactcctggatttcagcagaaagtgttccatatcaatcagccagctgaattcattgaggaccagtcaattctaaactgtaagcaatgtcactcaaagatgcttttagactcttctcatatttgaatttactaatgtttatgactgtgtctcaggatgtggtatttcctaaactaagtgttttctgattatttttcttatgtcactgcttgacccaaagtggaaattcttgaatgagggcctggccaacttagaggttaatagagtgatatgcatctctttttagtattttatcatcagtgggtatctccatactgctgtcagaaaagggggctgtcagcctccaatgagagttgtacactgtgcaaaggaaatgaaattcatttcccctgggcagatccccaaaatcaaaatcattgccttctcgcagattgctgttctacctgtagtttctcatacatagcattagatcaaaataatggtgagagtatgacattggcttctgggaatttttagacacagacatcaaaaactcttattcttaaggctaataagatgggttttagaaagattcaaaacctctactgattattctatggattaagctcaactcatcctgaattccaattgatttatttaaaatatgcatctttcatatctgtggtgatgatctctttttgtttttaatgtcaatattatattgctttatctttaagaagtgttagggtacattgctaaatgcataacaagtacagttttagtgcaatagaatttaaaattggtggtagacaaatagctatttcattgtaggctcttgagtaccttgcttaacaactggaaatgaagaatatggaaacaactgatctaaactgatcagatgcagtcgggtgtgatggctcatgcctgtaatctcaccactttgggaggccgaggaggatggatggcttgaggccagaagttcaagaccagtctgggcaacctggtgaaaccccatctctactaaagttacaaaacttagctgggcatggtggcatatgcctatagtcccagctacgcgggaggctgcggcagaagaatcgctttaacccaggaggtggaggctgcagtgagccgagatcataccattgcactccaacctgggtgacagagcgagactgtgtctcaaaaaagaaaaaaaaaaaagaagaagaagaaaattaaaataagctgatcatacgctccaaggtcttttcaaggaaggtgattccacattggctcttatggtctcaggtttacgttccacgctagctaagttcctttagtcctatgctatgtggctgacaagtttaaaggaaagacaagaaaaaaaaaaaaaagcacacttgactggattattctgtgaggctgggacacactctaagagtcgaaaggaacacaataatgaagatgcactgttgagcatcaagggagctgtccaaggtgaagcccgtgcacctcccgatgaaatgacgccaatgaaatcatttcaataattagtctgtaatgacaaggtgcagggctggcacaataagtgaattccaatatgtgatttcctgctcatttgatctctgagtgtgactcctgggtcaggccattaggaaccctcctttgtcttttcatttttgtatttatcagaatcaatatatttcaaacagaacttgatttgtgagaaccatttttctggctctcctctcctctcttcctctgtcttccttttattttttttccaagtgattatcccaaatggcatctatgttaacatgcttggaaatgcgaagcgaccctgagtatggaaattaatagagttggtatgcaaagtagacctataaatgtgattgcttctgtaatcttcacgatagcaaacagtttttaattcgctgctgagaagctggaaacaatcatactttggggggatctttttaatttaaagtaagccatactgtacattgcagtatcacagttgtgtgtgtgtgtgtgggggggggggcggcggtgtgcgtgtgtgctttaatcccctaagtaattaagtgggttatggttgttgcttctgggtaagctagtaaatgctaaatgggactaggttcattatcaatgataacacattcagaaaaagtcagtgatatgagaattgaggacacttaaatttttatgcttgtatatgagttgttgggtcagcaaaatttgattagcccctcttggtgaaaccgtatgtccatgtatattactaaggtaaaaaaaaaaaatccaaagcagatctggttaggtactttcaagttcatctcaaagcaatgaacatattatgagtatagagcctgcagataaggttaatggtgcctaaatgaggaagaaaattgtcatagacttgagaatgcctattgaaaatagtttaggaaactctggatttctagaagtagtagcagtgctttgctttattccacttgcaagtagcggttcaattgaataaacttttatacctaaccaaccaatattttaagccagtctcactctcccctctctctcattctcagtttattttgcgtatttcttataatgcaaaacaaaaaccttctgtctctgaaaaacgtgattaatcaagaaaccaatgagtgaagtgtgctatcaaattgaagactctactggcacaaggctaaatctgaatgaaaaacgaaaagaaccaaacagaaccagaaaatgttaaatgcatagattccatttcctgaatcattgtataccaaagatccaggaaatggttagggatgttttagtctcatataaatataggtcagtgttgtacacagtgagaaaactagattagtagcatcatcttgtgccctactcatgacatttgcacttcatatttttcctttatctttgcaatatttaagagctttggttaccaatcattgtgaacttttgtgttgcagggggtgtaaacacagcataatcaatcaattgatgtctacactcttcacttttctttaaagttgtctgaaagtgctgtctctttgcctgacagacatagtatatctacccctaccctagacttgtgttcatccaattgtgtgttcagcttttagcaggttatggggaatgtttattctgtggatggcttcctgctatctttgttcagacagtaatatttccttttatcctttttcatcttcctcctcaattttcaatgacttatctttttctactttaactgttactaatggtcacctccactccttttatttccctaatattttattcactgttatctctgatacatctttctctcagttgttctgaagccttttatttgcttcacatctgaatcactctttattctactctcctttccactaactggacttgcttttgtcttaaaaacgccatttttcaacaatatgctgggaccaaaacatagcattcagctatttcttctaacgtaaccagtgggctcttcactgcatctttcagagagtgatgcaaagctcccaactcagggaaacttgggtaaaacttccttggcttcatctcagtcttgaaagtttatctgggaaaatgtgattcttcccatttgtcaatgaaaaatacaagaagaaaggagaagtcagcttagaaggcaaccactcagaaaggaggcatccatttaaggtctttgaattctgaaaggaatctgtgaaaagtttgtgggaggtgttttctggaggcctggcacccatatctccctcaaattgcccagcatggtagatcttgcttttccccaaacacgacaattgtgtgatctgggagctgacatcttagtaccaccagaattggacagcaaccctggttacatcatgacacccagaacagaagatccccagtcttagaagaatagctgtcttgggcaactgaccagccacccagctgggatgggaagatcccaagtgataaaatctgactatcctatgttctgcaaaattataaaacaggatagtctgctttgataccatcagctcagacagattttttccagcaaatggaaaaatgtgtggtcattgagctcattaggagaaaccatacccttgacctccagcctctattagcaggggatgagtgcagtctttggtgtccagaaagaagatcctcattggccacatagccaccattagaactgtacttttttttcttacccttgttcattctttatgggtcattcctcttaggccacccacatgcaaacatagacacataggtagagacagaaatcacagcatctgaatttacctacaatacaacttgcatcacatgtttaggaaagaacctgcattaacaagagcaggctaggctaggccatggtgtcaaacaactctagtgacttaacacagtgaaagtttatttctcactcagatcatgcagatgcagtcgggctgctctcctgggtaactctcctcccagtggttgccctccatgcaagaacctgatggccgaggctacttccaacttggtcctaccatcttgtagcttccagcttttatcactgagctggcagacaggggaataagaaagactatgaggaggtcactgcaggtgcttaaatacctcagccccaaagtggcatgtatcatttctgctcatattctaagatctaatcatgtcgccaacctaactgcaaaggagtctggcaaacgtagaagaacacatgggtatcgatgcaggatcacagtctctacaaagatcctaacaaaatgatgtcgcctatatcagaaagagacataaatagagacagaaatggaccacaaaggagccagctgtcttggagtaaccaaggcctacataggatgaagttagtcagtttaagcaggagagcaaggtcgtgcacctgcgactatgtcctgctttccttagtagagaaatattcccactgaacagaattagcttcttagaaacactataagctcctctccctgtgccatcttagaaacactaggggagggacagcacctactcatggactccagttgcttcctccaattggttacaatactgtggttaagatcacacagttttaaactcatatcgactagaattcaaatgtgcacacagtcatctattagctctgtggccatgagtgagttattcacatcctccaagtttgaattatctcatctccaaaagaagattaatggtagtccctgcttctagagctaatgcctcaactgatgggaaacatgcttagaacatagtcacaaataaatggaagctgctattattattattattgtccttataatttctgctgttactattattatcattactttcattcatagacctcagctagatccacttttcttataatggccatctgaaattggctttaagaagaaaaatcatgttggccattaaaaatacaaacaggtgaagaagcgactaaagcagtgattgtagggcatttgaacttcatggaccagtaatttttttaaatcctagattgatgagagtgtattttaaaaaattggtaagacttggtatgaattttttaaaagtaagtaaatgaagggaggggaaaacactaccgccatttacttttgccaggctttccttttaaaaggtcacttggcatcaaaaataaacataaaagaagtaaagactagttacagaagaaaagtcagttctttgagtaaattttgctttgtgaaaaatgcaccaaatattcttatttacttcgcttttgtggaaaccattgatctaagggattaggttgatgtcaccctttttgctcttcacttttctgatacttttctgaagttttaatatgtcgttgtttctgaagaggcaggggtatttcttaggagacattttcatgaagggactcctgtccatgttgacaaaagagagtgagtgtttctagataatgtgacaatcatatgcatgttaggaggtgtattagcctattttcatacttctataaagaactacctgagatggggtaatttatacagaaaagaggtttaattgactcacaattcagcatggctgaggggtggcctcgggaagcttacaatcatggcagaaggtgaagaggaagcaaggcaccttcttcagaaggtggcaggaaggagaagtgctgagataaggggaggagccccttataaaaccatcatttctcacgagaactcactcactataatgagaacagcatagagaaaactgcccccgtaattcagttacctccagctggtcacccccttgaaacgtgaggattatgggaatcatggggattacaattcaagatgagatctgagttgtgacacagagccagaccatgttattccgcccctggttcctcccaaatctcatgtccctttcacatttgaaaactaatcacacattctcaacagttcccgaaagtcttaattcattctggcattaacccaaaggtccaagtccaaagtctcaactgagacaaggcaagtcccttccacctagaggcctgtaaaatcaagttagctgcttcctggatacaatggaggtacgggcattgggtaaatacactcactccaaatgggaaaaattggccaaaacgaagggtctacaggccccacgcaagtccaaaatccagcagggcagataaatcttaaagctctgaaatgatcttctttgactctgtgtctcacatacaggtcaccctgatgcaagaggtgggttctcacagtcttgggcagttccacccccatggctttgtggggtacagccccactcccagctgctttcacaggctggcgttgagtgtctgtagcttttccgggaggacagtgcaagctgtcaatggatctaccattctggggtctggagggtggtggctgtctctcacagcttcactaggctgtgccccagtggggactctgtgtggggatttcaaccccacatttcccttctgcactgccttagcagaaattctccatgagggctctgcctctgcaacaaacttttgcgtggacatccaggtgtttccattaagcctctgaaatctaggcagaagttcccacacctcaattcttgacttccgtgcacctgcaggcccaacaccacgtgtaatatgcctaggcttggggcttgcaccctctgaaacaatagcctgaactgtattttggccccttttagccatggccaaaatgcagggctccaagtcctgagacggcacaaagcagcaaggccctgggtctggcccatgagaccattttttcctcctaggcctcagggcctgtgatgggaagggctgccttgaagacctctgagatgccctggagacatctccctcttacccaccagccctgttacaccattgacttggcgattaacatttggctcctttttatttctgcaaatttctgtagctggcttgaatttctccccagaaaatgtttttttcttttctatttcatcttcaggctgcaaattttccaaacttttatgctgtgcttcccttttaaataaaaattccagtttcaaatcttctctttgtgaatacgtaaagctgaatgcttttaagagcacccatgtcatgcttgaacactttgctgcttagaaatttcttctgccagataccctaaatcacctctctcaagttcaaaattctgcagatcactagggcaggggcaaaatgccgccagtctctttgctaaagtacagcaggaattacctttattccagttcccagcaagttcctcatcaccctctgagaccacatcagcctggacttcatcgtacatattactatcagcattttggtcaaagccattttacaagtctctgggaagttccaaactttcccacatcttcctgtcttcctctgagccctctaaactgttccagcccctgcctgttacacatttccaaatttgcttcctcatttttgggtatccttatagcagcaccccactctactggtaccaatttactgtattagtctgttttcttttctttttcttcttctttttttttttttttttttttttttttttgagatggagtctcactttgtcgcccaggctggagtgcagtggcacgatctcagctcactgcaacctctgcctcccgggttcaagcgattctcctgcctcagcttcctgagtagctgggactacaggcatgagccaccatgcctggctaattttttgtagttttagtacaaagagggtttaaccatgctggccagactggtctcgtattagtctgttttcatactgctgtaaagaactgcctgagactgggtagtttataaagataagaggttcaattgactcacagttcagcatgcctggggaggccttagaaaacttacaatcatggtggaaggcagagagaaagcaaggcaccttcttcacaaggaggcaggaaggagaagtgccgagataagggggaagagccctttataaaaccatcagttctcgtgagaactcactatcacgagagcagcatagaggaaaccacctccatgattcaatgacctcccccgatctctcccttgacatgtggggattatgggtatgacagttcaagatgagatttgggtggggccacaaagcctaaccatattaggaacatatgttggcatgcaagcttctgtgagtgtggacaagtatggcctccctggccttgataactgacagttactgtgtgctccctagtgtgttgagggccacctcgaacctcacaacagctcttaggggaaaggtactctcatctgcccattttacaggtgaggacatttaaggctgagctaggtgaaacaatgaacctgagatcatactgcttataattggtggtgtcaaaatttgaacccaggattttagggccctggttttcatccatagttctgtggcctagtgtctcttagtttttttgatgttggtggtgatacatcaaggaaatttgccggtgtgttttcccatcacttttatcaaccagggtgagatagagagaactgctgctgctgcgtatttgttgcttttcatagccaagctcatcctgtctctgtattatagaagaattagctttttctattctggatggacccagggccagattgtccatgacccttaactctcagctttccaccctctctgttagtttctttcaccaagacgttacttggtcatgccaccatgacactgaccttggttagcagccaggtcctccatggagtgtgtggaatcacattaatcatatttgtacttaacatacatgagtcatggcttttgagggtgcttttaattgactataaatcaagcaaggaacttgaaaaatgaaggcaattaatgaaaaagcatgtgagaggtgttttgcatcctaagggaggaaatacactgtcagtgaatttaatgtcacaacaaaggctcttttgaccctgctgaaaagatttcatgtggatagtaataaatggatgaactttgcagcctcacaggtggagaattgcctgtttcctgagttcaagctgacttaggcttttatctgtctacattctctatcttgagaacttcctagattcttttacttttgctttcatttcttgtgatttttaaaaataacaatgataattcttttcccattttctggtcattcttcacacatcctttacatattttatacaagcttgtatttactttcaggttgggagactgattaattgattagtgaggttatgtaacgtcccctgaactgcagtctggacagagctggacaaggttggggtttcaagtagtatatttgttttaatctgttgcgatgtgccaaggaaaattattctggtattgcctaattcactctatcattatgaagttgacgatacatcgggtcagaatgtggactcctatttacattaataagagtttttcctatatttaaacagagctcagtagaaatgttatgctttcacaggttttcccttccctcctaccaatccatttgtaacaatctagtagtaagtcaattaataatgattagaaacctcataaatgcattatcctacctaacaaatgtgaaatactataataaaatgacgtaagataagaaatgaacatatgtacacatcaaagacagatgtaacaaaatgtttagagatccttccattggacttgggtcctaacttgttctttaaagaatgggaaacacaagaagtaacagagtgagaaggacttctcagacgaggaacatgaacacaggtggagttcccttggcctaagttttcttatcagtagaatggaagagataaatagaccagaggtatcacactgtcagcctttgggctaaatttgcctcacagatacgtcctgtttggctgcttagtgtgagaatttgaggtgtttgataaaaggaatttgtcattaacatttagaatttcacctttagaaattcccaatttctgggtagtgttgcgtcttcagagcagacagagatgccacagttcagctgcctgggttcaaatctaaggccgatcctttaccaactaagtaactttggcaagttgggaaaaacaaaacaaaaaaactcactgtggttttattttctcatctggaaaattaatattataatggcagcaatctcaacagtctgttttgagggctaaatattaatctatgtgtgataactgctacattgtgtaattattatcattattatttgagatggagtctctccctgttacccaggctggagtgcagtggcgcaatctcaactcactgcaacctctgcctcctgggttcaagctattctcatgcctcagccttccgagtagctgggactacagaagtgcaccaccacgcctggctaatttttgtaattttaatagagcaaagttttgccatgttggccaggctggtcttgaactcctggcctcaaacgatcgtcctgattcgacctcccaaaggactgggttaggtgtgaaccactgcgctcagcgggaattttttttttttttctttttaaacacaagtcaagtgtagtagtgagaagtgcggaaggggtagaacaaggagtttgatatgtaactttatccttattaaaataccaatgaaattatttacagaaaaagaaaaaaaattctaaaatttatacagaaccccaaaagacccagaacagcagaagccatcttgagcaaaaagaacaaaattagagttatcacgttatctgacttacagttgtactacaaagctatagtaactaaaacagtgtgatactggcataaaaacagatgcatagaccaatgggacagaatagctaacccagaaatctatgcatttacagtgaactcatttttgacaaaggtgccaagaacataccttggggaaaggacagtcttttcaataaatgctgctgggaaaactggatatccatatgcagaagaatgataatagagccctatctcttgccatatacaaaaagcaaatcaaaatgaattaaagacttaaatctaagaactgaaactctgaaacgactacatgaaaacattgggggaaatactccaggacattggtcttggcaaagatttcttaagacctgagaagcatgggaaactgaaacaaaaatggacaaatgggatcgtaccaagttaaaaacttcctgcatagcaaaggaaacaatcaaaatcaagagacaacccacagaatgggagaaaatatttgagaaccacccgtttaatgagggattaatagccagaatatataaggaagtcaaacaactcaatagaaaaaaaaatctcattaaaaatgggcgaaagatatgaattgacgtttctcaaaggaagacaaatgggtaacaggtatatgaaaaaatgtccaacctcactaatcatcagagaaatgcaaaaaaatgtatatataaacatattctctccctgcagttaaaatggcttttatccaaaagacgggcaatcatgagtgctggtgagggggtggagaaaaggaaaccctcatacactgttggtgggaatgtaaattattacagccactatgcagaacactatggatggtccccaaaaaactaaaaatagaactactatatggcccaacagtcccactgctggatatatatctaaaagaaagggctggaagggtcctggggagggagaataaagtggggttggttaatgggtacacaaatacagctagaatgaataaaatctagtattttgtagcgtaatagggtaacaaaaattaataatttattatatattttacatacccaataagatgaaattggaatgtccctaacacaaagaaatgataaaggtctgaagtgatgaatactcaattactctgatttgattattacacatagtatatctgtatcaaaacatcataggtcccctctaaaaatatacaactattatgtacccataaaaatttaaattactttttaaaatattaatctatgtaaagggttttgaatagtagctgacctataatggtccctgaaatattagctgtcagaaacagcatagggatgattgtagctgaaagcttgctatggccctccaatatttatctttctgatatccagtaggcttcctagttaactctgcctgtcccacatgggcatctaaattcaccttcaggaagtcactattactcctaagactgttcatggagtcaaatgatgttccatagaagacaaaaccatcttgaagtttttgatgctgtcttgtttctgtcatatcagtaacactattgacaatacctgctattcactatcaaggaagcagaatacagtgctaaggggtgagaggacatgggctggctggtgttgatcaaagactttgaaatctgttttcagtgttttgaattgttgatacaggtaatgtatgaaaagggaaccatgtggtcagacagggtggctggctttctggaagttcagaataggaggaaggtgaaaaggatgagtgggcatggctcaggctgccatggagccatttcagaagtcctgagatggggacagtttgtatgtatatcagaggagagatcaacaagggagataggagtgttattggggagcacttgaacatgaaataagtgaaaggagagccccagggagatccaagggttgacactaacaggcatctaaaagaggttttccgaaagagaagcagaatcactggagtctaatcccagctctaactttgacttgcatgacagttttcctccctggacctttgtttttctcatttgtataatgagagcttgtgagttgggctgttttgactgtaatcaacagtaacacaactccaactagcctcagcaaaaacatataaaattatcagctcacatgattgaaaatttcacagtgtgagttggctttggaaacacttggatctagatgcattaatgatatcctcaatatcacccttcatcccccagctttgctttctataatattgatctcaatcttcactctcagagggtttccctccaagatggccaccagcaattccagtcttttattcttctagctaaaagagccagagcatctgttttcccagtgttccagcaaatatctcaaggctgaccgtccttggaccaacttggtttacgtgcttatccctaagccagttattatatccaagaaaattctgtacttctcttagccaggcctggggaaatggagatgaaattccctcaaggaaggaaatgatgctgggctggcaaaagtcagacagtccgttctaagggtattgtgctctgttgctaaggtcccattaagtactaacgtcttatgaccgcagactgtgccccaagcctgagaatttttagaacccagcatacacacaaatggaaatgttttttaggtggcaggggataaggacagccatcacaccaggtttcttgctggtgatgctggtgagcagattgcttaattaagactatcaaattctaagtgctgccatatggcctcactcttcaacctgttgagtgtcttcactcacttggttctggagctggtataaatctgtttcatttctgtttttctttaaggaattaagaatacaggaacatacggatgttacaggagcatctcctaatttaaggtattagaactacataaactgggctgctttaataagtaaggcatcaaaatataaattgggaaagattaagcatagctttaaataggctgagaaagcagaagttcttattattctgttacagatcaaatctacacacattctagtaatagaggtgccctctatttgttcttttcaccttaatgttgatggaaatttttttggcttgagagcaaaagggcaagaggtacaaatgcttgccagtcaaaatatccccaaggacttctgcatttgacaaaattcattctccttctggagatagaaatagggaatggaaaaggaaaagatgtatattgagtccctaccactcatttagccaactatagaagaaacactgaatgatcacctagtttttgccagaccctgtgctaagtataagggataaagctttgaatcagataaaaaatgtgcctcctgctgtggagctttgatgatatcagagagagaaaaaggcaaacatgatataataaacccttgagaacacaggaaaacggcacatgacaagacgatggttaagtatcatgaaggaaataaggcaaggtcatatgatagagatttctgcatggctgctgaagaatgggtggtcaaagaagatttttctaagaagccaagtcctaaactatgagaagaatccagtgaggtaaaaatcaatggtataaacacttaggctgagggagtaactcatgtcaaagccctaaaatgagagtgggttcttcagtttgagatactgtgatccaggaggagggctgtcatttgatacatttaatcatctcaaatgtcttgcaaataggattataaactctatgttatagataggggtataaagattgactaaagagcccaagatctcactaaaaagtgtcagtggtgttacaatcctctgactccaaaccccattatctttccatatggaatgctgtagctggtgttggagtcttctttcacagtaaagtgctcctgtcattgcctctgagaacagactggggtgtccttgatagtttcacaggacagtggtgtgggctcctaggttatattgcctgtctctgtcactcacaatgggtggtgtttttaagctacccaaacttccagctcctaatttttctcatctgtgaaatggagatagtatttcaaggattaaacaagatagcacatacaaaggagtgacagcagtgcctgctacatgcaatatttttattttaaaaagttggttggttttatcctttaaaagaataaggctggggtgggaaatctctgtgggatgatgctgtttgaatgggtagtgctggatgcccaccaaagatgacccacgaaattttcaatatagcttggctcctctgaaagagagcatattttcttcctacttcttctgagactctcttttaagtattttcatgttctagggatacttgttctcccccacccctgaccacttctcactcatgcttggtctctttgagctaaatgttaaaaacatactctatgaaaaatatttgagaaattagtactcccaattttaggtccagatgtgttctggaatttagaaagataataagatgcacacattgtattacacgattctacgagcggggtctcgggcagctccctgtattaaaacaggttggcatttcaatagtaaaacatatgaatgtttaccctcagtaggataaataaggaccacaaataacatcatgtcagttcaggttgggttttgctgccaaatgagttataaaaacatgtttggtatgctgagtctcttggatttcagaattgcagattgcagtccttagaacattcccgtgaaaagttgcaaaccttagtcgtgctaagatgttgagttggcgtcttcacatcccggccacttctgggagcagcagagtgtggtggctcagcccacccctcaacccctctactacttgtgaacaccttggtaaatgatgtcttggcaggccacccccgagaagtggccaagtgctgcaccagcttttttcttttccatttgaagccaaaacgattgtcagcgatccaggcttctcttaactgtgcctgtcagctgattctgaagacctcccagaggatctatttttagctaaaactggttttaaattttcatatgtatacattaaattccatagaggaaggggggattccaaatgaggaaacattgattctgaataacataaaagaaataagcagtgcttgaaaaacagttcaaaatatgagtcaaaacctcccaggaatatggttagcactgcatttttccatggaaggaagtctgttgaattgaaaacagaatgagagtaagtggggataaattatactaagaaagagactcagcatgaaattctaggtactgaagaggggaaggagaataagaatagggaggactgaacttagagggcagttgggattgccagatggatactcatggggatgtgtggccaggtaatcaaatcgcattgtccaaaagggacatggaggccatgggctaggaccaggcttttggccatactcaagagggagagagaagatacacctcccaaataaaggcctggagtctgcacatgacagctttgattatgcttccaaggttttgttcatttttggggcatgaccaaggtagttctagaatgagtgaggccaaagctgaaagtgtcacaaagtttttgcgtatgacaaaagttgcctgctttgcttttggatgctcaactcagacttcttgttttcatgatgtgcagttttgatcaggacattttagtgataggtatagcctacttctgtaccaaaggagaggttggattatctgttgaaaagcgttttgttggctataattacaatatgatgacttagttaggattctgataaatcctgactaactcaagactttaaagaaagatacttaattaaaatagaaggaagttgcatagtcacaggttcatccaaagacctgaatgacaaggtctcagaaaggacagaaactagagaagttccatgggcttaagcaatgggaactcatagaattaggacagtgcttttcaaacttttacagtgaatgacgatatttgtttcattttgttttgttttaatgtgtcacagtaacatacttttgttaaagaaaaatgtcaaatatagttttcaaaaagtttaaaacatgactcacattcatatctaaagtgaacacatcaaagattttatctatctcaacaatgcaaaaggggaccaataaaatgataagtatgattcaaagagcattcgagaaactagctatttgcatgcaatttaatagtaaaggagtgttagaataagtttgctaggttacatacgaagctggttaatgtcctgtattagtctgttttcacactgctgatacagacatacccgagactgggcaatttacaaaagaaaggtttattggacttacagttccacatgagtggggaggcctcacaatcatggtggaaggtaaaaagcatggaggagcaagttacgtcttacatggatggtggcaaaaagagaatttgtgcaggggaactcctctttttaaaatcatcagctctcatgagactcattcactatcacgagaacagtacaggaaagacccatctccataattcagtcacttcctaccggtccctcccatgacatgtaaatagtgggagttacaattcaagatgagatttgggtggggagacagctaaaccatatcatgtcctacaggacaaaaaactgtaacctctgtggttatcttttctacccatcattacttgtatctctgccagacagaaatctgtgaattaacatgtaatgttgttaagcctgaaaccatcattgagtagtgaatagtacattttcctagataattaaataatctttgaattgacaagttaatgcctgtatacgacattgaaagaacatgcaacccacatttttgtcttattttcaagttttgaaccttttttcttagtaatataatgaaaatcaagttttgtaaaattaaataaatccaaagacataaaaggtaagcttttaaaaaaatagatggaacaggtataacattactatgtcacattgctttcaacttctgtactcgtcatgggcccctaacaagaggttgggcattggtctgtggaccacacatttagtgttaagataggaataacttaactccaaataccttccagtttgggatgtctttattcaaattcctggtagagaagctgattggcctggcattgggtcaagagcccactttgtggtctagcagacaggtatcatgtttggaagcccattccctaaactagggactgtaaacaaacaaaaatcagaagcatccatacagttactgagtttggagaggtagcccaaacaaggggaggacttgggcagtgctgagctctgaccatagaaaaaaagtatctgggaactatctcaagcgtcatttaggctcccccatttcaagcatgcacccaaacagctcatatactatacagtaaatacaacttctcaaagtagaagataactggtgttaaaacaagactacatttatgagaactcacttccataagggcaaatactaccttaacagaatctcagcaacattccagaagatggaagtcagaatagatatttatagggcttgtagggagggtatagcctcaagcaatttaagataggaagatgattggtattgggtaaattcatgacatcttgatttaagattgttagacatagcaagatgagtttactgaaataagtctgacaagtaggttattgtttgatagatgagctatttatctagctaaggagactgttgtcccagataaattgatatgcatggattgtccaaatgaagcagtgaaattgttcctggtttagagccttatgtttcgtggacaaaggtttctgtgaacaattaagtcaggttgacgaaggtgatctcagttgttggtcttaagcactacgccatgttgatttaggtggtctgaattctcaggacatggtagttcacatttgttccatgttagcatttcccaaacttctgtctgtggaacactattctgcagagtggtaacagcaatgcaatggggggaaacatattttgaagttaagtaagtttgggaaattctgttttgttttttaatttaaactgtaggccctctcaagtctttatgatgtgaaaatgcacagtaaatattccagaaagcatgcaaaaataccccagaatctaactcctttccagtctgaagagctcctcaaatctctcctaaagttacttgctttacacacagccacctctattcatttttttttttttaaatttccagtagccagtgtaacctgggggccagggaagacctgaacctctaggactcaaaccctgtcatgattcttgaggagagaggaaggtggaaatacatacatacacatagacacacacacacacacacacacacacacacacacacatatacacacacacacactctatatatgtatatatattctcattctgctaaactaatcgaaagtaagatatagtaaaatgtttgaaaatacatatgtgcagctttgaaatgtcttcccatatcataatggctgtggaatcagcctcagaagccagattgtctgagccccaaggaaacgtcaaacccctctccctctccagtagcattccccagtctgtgtcacttagacgaaaaggatctcagggtgggtggcaatgctccttcactgaaatctgcagttatctctacccaaggcttacagtaaattttttgcaaattagaaagccctttgctctctcagtaaaccctggctttcaagatttttgttttagtaaagtctttagactaaatgttgaatctttcactctctttgctcctaatcatctctaagacagcaaatgcctctagcaaaaaagaggagacgtcaactgggaaaatttgaagagaaagtcacacagatacatttcagtaaggttgtctctgttacttgaggcttacaagaaggaaagaattccctctctaaacacactctaaacacacaggagttgagaacggggagatttattccagaaccccttctgtgcgttggggcttctggtagcttgcctttcttggtaacgattttctcagagactgggtagattcgagtggagcctggggcatggttgttggtccaatggcgggggttggggagacacaagcagttggcagggaacttacaaatctccaggaggttattgagaataaaaattcagatattgccatcttttccatttcaaagcaccaagagtctgtcatcagcaattgtgcctttctaggtgtcacctgaatatctaacattgaggcattgaaagatagatcaggactgattttactgagcattttcaaaggcagcaggcaggcttttcaatgctgcatgagatcctcaccttctctgaggtgacaggggcttctgttttcttgagtttccctgtttgctgatgtcatcccctcctaccccatgaccatgacaccaactacatccatgatgtatatttccaatgtgtttcaacttatggtcagctcccaccagctccatattctggtgggataagcaagccttgccttgagctttgcaggctgggcccatggttgtggacatcacagctctggtcctcatagtattggtggcaggcagatgcccagctctggcacctgaatgcttggatttggatgccagctctaatacttactagctctgtaacctagaaaaagctccttagcttctctgcactttaggtttcttttttaaggaacactgaaggaaaatctgaggctggtacagtctctgcttggcaaatggtggttatttctatccattaatgtcatctgatcatggcccctcaaacctcactttgagccttgtgagcaaatgatacatactgtttatatatatattttcctatatatgtagaaaaatatatattaaataaatataaaatatataatttaattaaatatatttaatatatatttatagtatattaatatttaatatatactatataatatatacatatattgtatattttatatacaatattatatattatatttatatgtaattgtatatttatacataatataaaatatctattatatgttacatatatttagatataatatattttacataaattataatatataataatataaccagtatgtttcattatatataatatatagatacatactgattatatatgagtatataacatatttacatgatatataatatataagtatataaaatatgaatatatattatataatttataaatatatataaattatgcaaattatatttgtgaatatataatagatttatctaaatatatgttatatttagctatagaaatatatattatatatttagatattatagaaatatataatatatattataacatcagtatgtatcattatatatagatccatacagattatatattaatatataatagattatattaatagatcatatataatcatataatggattaatagattatatatactatttatgtaatcagtatgtatatatattatttcaaacctcactttgagccatgtgagcaaatgatacatactgatcatacctactgatcagtgtatatttcagtctctttgtatcgccctatatattttccactttgcaatgagaggcctttgcttctcaagtgcagcgtcctcatgcttctcccacctgaacaaattattaaccctgtaaaccggctttcagcaagctacgtggatgaggggtctgaaggtttttagtttcttattagactgtctctcgtttcacttacatggtacccgctgggttgattgcttcatatatcggtggtactaatgtggatattgaatgtttcacctgccgagggccttcatctaattcatactgagcacatagaaaggtgatttgaatgggggcatttgctctgttattttggtgatggatttagggaaatggaaagtagcaaattgctttgtttttggacctttgccaggtccatcctggttatggataatacttgcttggttgattgaagaaggccagctgctactctaatagcccaagtcaatggccaacggtgcctgattagcaagcctgctatgcttactgtagtgaaaaacatcttataattataaattaataccctttctattatacatcaatatgctggtatatttcataagttggccagcccttcatgactaatattgatattaaggtcaactctagttttatgataccaaggcaaagaacatctttaagaaaatttagatacaactcctgactttgaatgagggaattcatactgagaacctcagtgttaccatttgtaaatcagattaaataatgcccaacatctggggctttgaaaaccaatgggataaactttgtgagaacaatttttaaagcctttagacattaccccgtggtgtctagtgtctcttcatattttcctctgggtttatcttgaccctttcaaatggaatgcgtggatgccattagtatttataacattcattttcagtgctttagtattgtttttttctttattgttgtgtaatatgtatggaaaaggcatatagcaaagggtgatcaatggctgggcttatcctaatctttgtgcatgtgcttgggtgtgtagaggcttccgttcgtgtctctgggccatcttgcataggggttcaagctcccatttggatgccatgggttgaagtctccggaaagctgacctcagatgaggattggtgtgtaggaagtttattagggagtattctgggggtcatctgctgtgggagggaggggaagaaagctggagtctgacagtcttatcaaaggctcagtcaatatcacagggactctgaagccaggatggctgttcacaatggtcctgagttggggcaagggagccaagcctgtataactccattacaatctgtttttggatgtgggctgtgggaaggagccatgaccttagaggaaaagactgtctttagccaaggtaacccatagaggactgacaggtgaaggctgtctgcagaacctgggaaacatagtccttccgtcctgaaaaggaatacaacaggcacattacagaattcactacagtcatctagaaaacaaagccatctggtatccatggagacagcttccatagtcactattgcccttggagacagacacccacattcctagtgtggttgcctgacagtggtgaggaggagggggctgactatctgagtgtccccctgcgatacgatagcatgtcacctggttcatgacccccacacccaggtctctttccagagctcacccctttttgaggctggcaccaccctggacccaccaccagcttctgtggcagtgcttactctgctgtttaacctgcagtactaattcctgtctttcaagaactctgtctttcaagttccccattattaactttaatgtatgattatttatgtgtatctattcatgcatctatgtttttattaatttaggtatgagtgagtcctcagctcagtctgattcacatcagagcttttttaaaaaaataaatatcaggaatttttagagcatgtaaattatgattcaattcacacttgtctttttatgagttactgccatggtgtgaataaagcacacaagtgtcacaaagatattaacataataataagcattaatctccactagtagagtgttactaggcagggttccttccagctgccatatcaggaatccttccagcctgggtactaatgtcatcttcctttggagaccaggcatgaagagtcactcacttcctgaagtcactgggactgaaatccaggcagtctggctctagtctccaactccgctgccaatgaccaccagcattgcaaacccgtacacatgcgtatcaggcagacctggccgctggcaggcaagctaaccagctgtgaaccatggtcaccgctgcagggtagggctcgatgatcagaatgtgttccttcatttcttaaccatgctggaaaaagtatgtagagggactaagggtgtttttattttctttggcttttttccttccttccctcccttcctatcacccttccttctttccgttctccctttttccctctctctctccctttcttccttccttttagaaaaaacaaacctaacagtatgtatgtctaatacatacaaaatctggtatttaattttaaaaatttattcatacgcttggtaagatttttaccaagccatttggttttttattcactctctctgatgtggatcatgcctattctccttcttgggatattaggagaaaaaaaggatactatgattttcttaaaatggagctgtttaaatgaaggaagcatgtataagcctacccctttaatgggagggttcaataaatcctagaatttgcctgtaatgtgtagaggtctaaagagatttgtcctatgagaaagttcactaatttcaattatctgggttttattatcaccttctaagggttagagagacaggattttatagaatgccatcacctgaggctgtgacaatggggtttcacaccattaaattcagaaagcataagagaagagataagaaatgagagggcttgaagtgcatgccagttccgttgtggaaaatatgacctactaagcagctatgagaaatgaaagcaggcagtgtcatctcatgatctattgctattgtatgtgaaatgctttctatattagctgttgttaattaccatcatccccaccatcacatcattgtatttaatagcaggagaaaggaagcagctgttgtaggcaaagctctcacacttgagtgtctatcagagtcacctgggggaacgtgtgcaaatgcagattgccaggccctttgcctagtggttcacaatgagtatgatcaggctggaacacaggaatctgcatgttttccatcgactatctcagctgattctgattcaggtggtatgaggattacactgaaatagcaaacccatgctttgtctcctgttagtctagacagtaggcatctttctgttacctcttgggtgtaatgtttagtttaaatttcagttcctcatctctacgagggagtcataaatttgcatcttgctcacagagctgctgtgaggattagctgagctcgtgcccagaatggagcagcctctaatatttgctgtgctgtctctagagagcaacagggaggcatttcatggtcttccccatcttggtcctcactgtatctttctgtccttactctgtgcctgggacagctttagggcttaatgaacataacagaatgctgaagagctcagccactggagcccagctgcttggatgcaaatcttggctctccaacttaatgcctgttcatgagcaagttatttaacctcctagtacctcagtttcctcctctgtaaaatgggcttgattatcatacccccatcataggtgtttttttttgggtgtatgagatgaattattatgactacaacacttaaaaccaataatgaagtgccatgtagatgttcattaggtgaataaatacaaatattgttgattgaatgcatgtctgcatgcacgctgtttctttccttatgctgtttctttccaacataatacagatgtattctactagctgacagacttttaaagtagaggccacttttaaaagcctgggctcccatgagaaggaaatctgcaggtataagatgggtttgtcagtcagcagaggcatgctattgagaaaaggaggcaacctggggagggggtgttagaagagagcttgggattcagttcttctaaccaggagagctgacaagtaacaaaatgagactccttctgttgtctgttgcagtagacaaagcaagatgcttagttaacagcagcaacccagtgcctgtaattttcaagtccttggaggcacaccatgtcacccaaggtaagccaggggacacaggagggaagcaagagaagccagggagaatctatttcctgtgtcccctgtaggtgtttgactcacctaaagttaacactaatagaacatttgctcagaaatgtcatcgctgaaataaacgtgttaaatttaaacttgactgccccaattcatctgttatgcaattgaactggaaacagctcagacttaaaaggcatctccaagtttttctcagccaacaagacttaggccactttgttttctcagatttttcagccttgtccaatttttggataaaaatcctttttgaaaacttcagcagccatattattttcttctccagtcatcaacttataacgtaaagacaaagctgtggggaaaatctaaagttgcgtcaaatttttattttctagccagctacagctctagtctaaagctctttcttttggggagaaaatcccatttgcacatttcctcttagttgggtggacttacccatatatacttgggtgacattcaggaggctactttgtgttttggctgtgtattctaatttttcttccggtactatatacagcaagagaaggggatgttgttcagctcttgttctacctagaacccaactgcacttttgcaagagatggatacaaagatggatgcataatgcatgatagtatattatgagcactactcttatggctttgcattgtaagtaattttaatgtaaaacatatttctatagtctggttacaaaaacaaaacattttagaaaatttggtcattctcctgaaaacagcaaaaagaagaaaaaaaatcataaaagatctgctgaaaaataatcagttttatgttttttctttcatgacagcttcatccatctatccacctatccattcttgtagctctccatccacccacccatctatatacacctcccacccccccacccactcattcattcatccacctacccatccatccatccacccatccatccatccatccacccatccatctatccattcatccatccatccatccatccatccagccatccatccattcacttatcctgccttgcatcctaccttctatccatctgtccttctaccttttcttctatctatctgtatattctttaatctatccatccattcatcctgggaagaaataatagtatctttaaaatgtagtgcattggttacaagcacaagatcttcagtgaatcattttgtgcattcaaattctgtctgtatgtatcatgcactttctatgtaaccttgggcacgtttttatgcttctatggccttttcagtctttaaaaaatggggttaataatagtgcctacctcatagggttatgtcaggatttaatgatataatccatataagatacttgacaaagtgcctggcatagaggaagttctcagtaaatattagctgtctttatcattattatcctcttgctaacttaacagagttttcaagatctggtgagaaaacatgtaaaagatacataatataatgtctattaaaattataattataaatgcagtcataaatatacacatgtatatttcatttatgttactgatatccatctgtttcatcagctcattttaaaggtttctttaatagctgaaaaatattctgtagtacaaatatttataatcaaactgttatagctattcatttagactatatcaaatttctgttgttattaataatgctgcagtgaacatccttattcagttatttccttagattaagttttcagaagtgaaattggtggttacagagtgtacacattgcaaagctgaatcatattgccacagtgcctggtgtttgcatttccatatggttttgatggccaggttttctgcactattgccagtgtatgtgttatcactgcaaacgtttgccatttcggtagacaaacatgggatgttattgctattttattaacttgtttttatttgatcaccagcaaagttaaactttgccatgtgttttttgaccatattcatttctgtttcttaaaattatcaacttagaatatttgtgcaattttttttttttacatgtggagcttgttcttaatgattctgccagggcttaaaatttttactttctaatgagaaagttttggaatttactcttttccaatttatgaaaattggacaccggctccatgcactgttctaagcctttttctgtgttctctgtgattccttagagcttactaactgtgaccctccagtcaaaaccatgtttaaccaagtgctgatgggcttgagtccattcccaagtgactcggaagttgcttacttccctacctttgagtgggtctcattttatctccgtgatgttttccttgtccttctaagtcatattcactctgctcattgaagaaaaatggttggtaattgtagtggataactactccattctgtatgccttctatgtcttttcttgatgtgtgcacctctttctttatccttatttttaaacttgtgcttattagataggtttctgtacaaccatatctgtgtaggtttctcaccctagaagcctccttttaaatagggcaaagaagctacctaaagatttctctttaatatagggaggaaaccactttcgaacttgtgcccaaagatttatcttcaccaatggtctaggacagaggtcggaaaacttttactgtaaagggccaaataatacatactttcagctttgcaggccagctggcctgtgttgtgactactacacaaaagtagtaagagtctaatttggcccaggagtttgctgattcctggtctaaatgagagtaaagaatgggaaagggaatggtgtgggaggaataggcattttcattcattgttgttaatgagaaagagtcttcaaacaccagcatgcccctgtgggttggattaggttagaaaatccttggaggactgccttttccaccccagagtcctggagagaagaatgcagcctgacaggaaggatctgggtaggtgacatgtggggagaggattaaaagaaaggagggccagtggctcacgcctgtaatcccagcgctttgggaggccaaggtgggcagatcacgtgaggtcaggagttcgagacgagtctggccaacgtggtgaaacctcatctctattaaaaatacaaaaattagctgggcgtggtggtgcacacctgtagtcccagctactctggagtctgaggcaggagaattgcttgaaccctgcggatgagaggttgcagtgatctgagctcgcaccactgcactctagcctgggtaacagagtgagactccgtctcagaaaaaaaaagaaaggagaagagtgtctcaagggtttttttttccagcaggtgaacccagcctccctagcaacccaaggttaagaacgtgttgaaaacagcatggaagcccattctggaaagcagtggtgattgtgattctgaacttaaacagcttcccttaaacacactgttacttcagaaaagtacggttttggccaaagggctgtatgtcaggtatttacttgctcatcttggtgggttttgtttgtttttgtctttttggttagccatctaagacattatttttctgagatccaagttccaaaaagcaccgaacaaccttttgggaagaaaacatacatagtgtgtaggtgctaccgatttgtatcctctatgaccttgccatagaaaggcaaatcagacgggcgctcccattgcctcattgcaggctgccattttcatataagcttcatgaaatctgggagaataaaggcaaaaggtttgatctggctgtgacagggaatattgtgaagctgctggactgggcctgtgggttgcctgtgactgtcatcaagttcttcttctctggaggcttcaaattcctcctctgtcaaatgaagggactggactagaaacagaatggcaagtacagggcaaatgccccagtgctctctgtccctgctgcctctggcagccacttctgctcccccacagcatctcctggtcgcctggacagaaagcctcctccatgcagcactgctccaggaactgttctcagccattaaagcagggttcagaaaagcttggaggaagatggccttgtagacctcccctagcactgaagttctgtgatgcttagcatatgtgaaactcaagtttcttctgttcctgaatggggattatttattgccttggacagcagccctgaaacttgatccatttagctgcccctaagtgtagttaagccccgtgaaatgtaaacttcgcaagtaaatggaccattgccatttgcctctgtcttctagatgcaattgttttctatagtctgtcttgtggccggttataaaatgtctgtcttgagcaagctggggaggagggtggatagctttcgatttgcccaagtttgttaatgtttcattgcttggggtgttttaagatcctgtgcctttaatagatttcctgaactaacagtttgccttatttacttccctgggctataatcattattgtggctgaccatgttgataagctactctgtgaagccttctctaatgaatgagagtcactcttcaagtggttattccccttaaccttattttcaatcacagaaaatcattctcacagaaagtattctttccttttgttcaaaaaatacccccttgaatgttttaaatgtcactgttttttcagttctaaataatttttaattggtttttacatgaagttaactgtagcactcttgattcaggaaaattgtgcttgtctgtctctctattatctctctctctctctctctctctacctacctacctatctaccaaccaaccaacctatctaaaatctatctataatctattagtttttcttgcttcacaaatgacttaaggcaactcgctttcgggttgatggaagaaaaaatacaagtagcaaacttggatgaagttggaagaaacttggcacccactgtgtctggcatgtgcagatatgagtgatggtctataaatttaggatcttattaacagccaaagcaaagagtacaatttttccatgtatctggtttatagtatccacaggatacaagcatgctggttgatcaaatgttgcatctatatctttgtgattaacacctgacagatatttctatgatgcgttctgacagggttacacatgacagagttggctctgtctatgttgtacttaatattattgtagaaagaaaaattgagtatatcttgtgaaaaatagttccatttgaaagtccatttctttcaaattcaaagaaagaaaacaactaaaatacgtaagtctaaagggcatggttgatttaggattttcgagtgggaagactattaaaagagatgcttgctcaagagagtatagactcttctttggaaattggcatgggccacagacctccataggtaatacatttaaaacacaaatgctttttggggtactgtctcccagtactttgtttttgaagatttgtgactacatggtttcagtgctatatctaataaaactggcttcaaaacgcagagcactagcattttcatatgtttcagtaagtctcccagccttcgtgattctagagacaccaatcagttgatgctagctgcagttgctagagattccttcctggaattttgatgtaggcttgtaaggagggaccatacttaacatggaaaattaatgacctgagagcctgtcccaaaagaaatgctccaggcaggagatcttcaacaatagccatctagagtttcagttatctaggatagaacagtgtataggctggaaagacccagccctttcagtaaggcatgtgagtttgatcactcaccaccatctccagcctcagccttcttggaaggccccagacttaatggtcatttccaaccctctttaaaaacgattcctttgctagagtcggaataaataattgaggcaggcttctccagaatctcattggtgtcagctatggagtcatcaacagatgaaattattccatcaggatagtaaattaaatggcagtcttagagtggagttttcaaggtcttcttacatttgtaacatttgttgtcctacatagtcttcatacaaactataaattgagcatgagagacattctttttttttttttttttccaagactaacttttgctctgtagcccaggctagagtgcaatggcatgatcttggctcactgcaacctccgcctcccaggttcaagcaattatcctgcctcagcctcccgaatagctgagattatatgcatgcaccaccacgcccagctaatttttgtatctttagtggagacagcattttaccgtgttggccaggctggtcttgaactcctgacctccagtgatctgcccaccgcagcctcccaaagtgctgggattacaggcgtgagccactgtgcctggccggcagcaattcttttatatacttggagggtaggcacttgaagcccagaaaggctaaaagactaggacattaagtcatagaggagggtttttttttttttttttaagttttgttgttggtcgtgatggtgttattcaattcttttattatctcagaactcatgtcatactgccccagcctctgtatcagcattatgtagcaatgatgttactgagcctgatctctgtaagaggctctgaataaaatgagttccatgctggaacttatgtggagaatctatgttctgtatctctcccttggggactcttaatttcctgggtagtgaagaggtcctctaagaaagaagcagatttcgtggaacccaggatttcccatcctctttttatctgcactgcattttaggagcttttaaatttctgttctggagttgggcatctcttcaaggttaagactcaagggctgtttgtattcctcttggatttgcctacatttagcaaagcagaaactcaacacattgttgaaaatactgaatttcactgggcatatattttgggttgtctggaagatcccacctattgagtacactgcaccatcacccctccaactgctcatgcacttatcggacatatgttgttatttttggatcagaaaataccatcccagtagaagtaggagtgatcagtgtgacagagagctgtctgtattgcggctgtaaatgccagtgaccatggcattgagcagaccataggttatacttactgtcgtggttctcacctaaagtacacatcacactttgggtttccataggaccaggcaacataatgacccacctgaagatgaaatgattttgaaataccaggcccttatcatgggctagggacagtgtggacattcatatatgtgaatgctccttaaagcttccctataaccttggatactgctggtcacgtgtcccttaaatatagatgaggaaattacagctctgagacaattgttgttggtcagtatccttttgatcctttgtttgtaaatcttgcccagttggggctgcatgaggttgaaagctcagactgcttcacttccaacctcagctcgtccctttatgaagggaggcagctcaactgcctcccttccaacctcagctcatccctttatgagctcatagccttgggcaaattacttaacctgttggtgttcagtttcctcatatgtgaaatgaaaatgatggtatcatttcctcctaatgctgacttgaggattaaatgagttaacacacataacgcttaggatggtggtggacgtacaaaacactcaataagaatttgcttttgttattattacttgttcacatctatgcagcatttgtgcctgcatgctcacacactctagtcttacgcagcttattcaccaacattggttcgggatgacatttgactgttttcaaaagtcaaatccacttttcatggacaaagattttccttcataagtgttattcaaaagattgtgctgtctgccctgaaaacagttcttatggaggagaccaaaagtatttttggtaaatgacagtctgtgtagagtgagtcatgtcactagatgtgtacttggaagggcaaaacagttatttcaatgtacaaattattgcctcattactttatcacataccagaagagagtttgggatggatctaagaagtataacaaaaccactgcaagttgttctgtcatttagcatttaattaaaaataactagagaaacaactatttgaaatgctcagtgtttttcttctttttttttcatgtaacaatatgtttagtgaatttttcaaattactaaaagcattcaggcagttctagaaatttgcatcttgtaaccctttagttgtttttatttagaatgttggcattttacagtagtgtcaagtatggtaattatttttcatagatattgaatttaaaagagtaatccctaaacacattttgacatttggctctccaagacaaagtttgtaaaaaaattgtgacctgtgaacggtaactttactatatacttgtttgaccattatctaagaaatatgcctttaatgaataagagggaaaaagatgaggtcagacatcaaagtccctgtaattctaatgtgaacaaccatgattcctgaattccatgtaaattagcactacagaatgaaagcaaacaaacaagcaaacctcaaacagagaaacctcaaaattactagagccaattagatattcaaaggaaaagtctcagtttttaataccttataaaatcacacaaatacatacacatatgtgttggcatcagcagttttgatagacatggcttaaaataggagaaatccaaaaatagataaaggcacttttaatatggcctaagccatagcaggaagtattaataacatgccgattttttactccaaaaagaactgagtgtgcaaagcaaaccaagaaagaaatgtggactgggccaactaatgggtttctaatcattgttaatctacaagtgtgatcagtttattataaagtgttaatttttcctgtgggtaatacttggagaaatacagtataccactcatttccaaagtgatgaaatggctttctgtttggcatgcaggaaagtgaacctctttagtttagaatatgggttggatatgcttgccaggtctgggctattccctgctgcctctgagcgaaagctcaggaagccagaacctgaatctcttcgaggaagttctacagctgacttttaatcattgggccatagcacaacacctattagctcgcttacgtctaggtcagtagaacctcctctggacctcagctactcttcccactctgcatctcgagacacttgccttctttccatgtgacttatcgctaagctcctgactgcatgaacctccttccttccactggtccaagtgacatcattcccccgtcctcactcccaataccaccacttcagtaacctcccacatgttttcctgctctactttaatccagtctacacagagagagcagccagccactatcctgttttatttatttatttttttacttccttaacagacgtttactggatatgtcctgaatcccagtcactgtgttaggaagtagctcaatccgttgtctgtacacctccatgcatccgttccttcattcaatgatgagtacataggacaggccagttttgttctccaggctggtctcgaactcctgggctcaagcaatccacctgtcttggccttccaaagagatgagattacaggtgtgagccactctgcccagctccagggcaggattaaaggattgttctcccatgttggaagaaaacagagttcaggccccaaggcaactgacattttactgggccagacagtgccttaacaataatagggcaggcgtggtggctcaagcctgtaatcccagcactttgagaggctgaggcgagtggatcacctgaagtcaagagttcgagaccagcctggccaaaatggtgaaacgtcatctctactaataatacaaaaattagccaggcatggtggcgtgcacctgtaaccccagctacttgggaggctgaggcaagagaatcgcttgaacccaggagacagaggttgcagtgagccaagattgtgccactgcactccagcctgggcaacacagcaaaacctccatctcaaaaaaagagaaaaagaaaacaataatataattcaggtagtgaaaacatcccagaaaaaaataaaataaaatagagacgatgggaagtaatgggaaggctgtagctagcatggccacggcaggccttcccagcagggcatttgagggagacagaaataaaatgagaggcaagtgacgtgaatatgtgtgagtgtgctctaaccagagaggaagactatggcgaaggccttggtgagtctgagaaatgccaagaaggaaggccaggctagggagtcgtgagcaaggtggcggatgggaaaggtggggacacagaggtagggaagggggatgatcttgtggggccttttatgccacggtaaggaggttggattgtatcagccatgatgttttccttcttcctgtcaaggtgaaatttatatgacgtagaatcactcattttaaggtgaacaattcagtggcatttagcgtatttgcagtgctttgcaatcaccacctctacctagttcaaaacattttcatcaccccaaaaggagagctcatactcattaagcagccgttctgcattcctctacctccagcccttgacatccaccaatactactttctgtctctaaaaatttaccttttttgatattaagaagaaaagacacccacacatatactcaattgtgtccttccctggcttgttaccctccctccttcatcacacttaggctcaaacacaaatttgccaccatcccctcatcatctggtccttttccatttctttagtctaacttcctgctagtcttttcttcactctttaagagtaaaggcccagactcactggttctcctcaagtggtgtgtttgttacaattgatgaacccacattgacacacaattaccaaccaaagatgccatgctttatatcagggttcactcttaatattatgcgctgtatgggttgggataaatgacatgcattcaccatcatagaaactttgaattatgtgaggtagtagatgatgaaacaaacattacatactaggaaagggacgcctctccctttttttttttttaaagaggggtgttttctgcttggttttgtccattataaactgttagattaaccatttgtacagccaatgaaatagctttaagggaggcactcaggagcttgaacacgtccacagaaattccaaggtctctccagtatcaacttgcagtacgtcaagccagtacacatgggagagccttgaaggggtacaagatcagcctcccctctgctctttgaacacactgagcttgtggctgcctcaaagccttcgcaggcattatccctcttgcaaattttttcatgggtagtgcttcctgtcattcagttctcagatcaaacactacctctttaagagctcttcactgcctactttaaggcatcaccctgttttatgttgtttatataatatttcacaacctgacattctctcattcattcattcgtatcttacctgtttccctgtagaagtataggcttcatggtgagcaatagccttattttccttgttaacgggtgtatttccagcacttcttacaacactgccaggcatattgcagattgagatagtctgagtcttctgagaactaggattaggatttttttttttttttttttttttttttttttttgaaacaaggtcttcctctgtctcccaggctggagtgcagtggcgctatcacagcttattgcagtcttggcctcctggactcaagtaatcctcccacctctcatcctcctgagaagctgggactacaggggttccccactatgcctgggtaatttttgtattttttttttagagattgggttttgccatgttgttcaggctggtctcaaactcctgggctcaagcaatccgcctgccttggccttccaaagagatgggattacaggtgtgagccaaggtgcccagctccaggacaggattaaagtgtgaaaaaattattaggggatatacctgggagatcaaatgaggtgggagttgggagactggaagagctgtcagaccagatgcaggtctgactctcagtgaataagagacgaaagaaagaaagattgagtggaattattttagactgctgtgcaattcttttttttttttttttttttttttttttgagacggagtctcactttgtcacccaggctggagtgtagtggtgcagtctcggctcactgcaagctccgcctcccaggttcacagcattctcctgcctcagcctccccagtcgctgggactacaggtgcccgccatcacgcccagctaatttttttgtatttttagtagagatggggtttcatcatgttagccaggatggtctcagtatcctgacctcgtgatttcctgcctcggcctcccaaagtgctgggattacaggcatgagccaccgtgccctgccacactgctgtgcaattctaaagaattctgggagtgctgtcagagagtacttgagccaaagttgcccatcaaaaaagttttaaattcacaggagtgggtttgccttagcatagcttttgaactaagtaactggccagcagcagcatgtggaagcatgaccttggcaagaaatgtggccacagatatcagcacacagcagctggggtagctgatcaatgtacttccttcaatgagagatctgtgaggtgcatttccatggccaccacagagatgtataagaaatattagttcaatgaatgaataatgaataaatgaatgaatgaaagaattactccttcatgttatgtttataactggctcttcctccaggttttctgcctcacttttggctctctcagctactttattactgagaatttatctgtactgtctagttttacagcaacgctgggagctgctattatccatccccattttatagatgaggaaaataagcctccagataggttatgcaacttactcaaccaagctcaacaactaataaatgactcagctctgtcttctgaagttgacacttaaagcccatacccttagctattaatgctgtacattgccaatgcaaggtggataaagacgtggagaaatactctgccctgctgagtagagtcctgaaactgcaaggggtggggaaatagcaatgaatcctaggcttaggccaggtaactaagatgtgcctttatgagtttatcttgatcatttctttattcattcatttatcattggccatttattcattgttcactagtcggcaaacatttatcaaactcctttgcatgccagtccatggactaagtgttaatctttatgcctctgatgcttatcatctgcaccgtccaatacagtaagccacgtggagctattgagcacttgaaatacagttggcctcaattgagatgtgttgtgaatataaaacatatacagttctcaaagagtgaataaagaaaaaattatttttaaaatctcatgaatagtttttatactgattacatattaaaatgatagtttttggtcatataatgttaaacgaaacatattgttaaaattaattccacccatttctttttataattattaaggtgacattagacaattaaaaatgaacatggccgggcgtggtggctcattccagtaatctcagcattttgggaggccaaggtgggtggatcacccgagatcaggagtctgagaccagcctggccaacatcgtgaaaccccgtctctactaaaaatacaaaagttagccgggcatgctggcatgtgcctgtaattccggctactcaggaggtggagacaggagaattacttgaacctgggaggcagaggttgcagtgagccaagatctcgccactgccctacagcttgggagacagattgagactccatctcaaaaaaatgaacatatggttcctattataattctcttgaattatagcactggtctcatggatgatatagatagtggtctaaaagtccagaggtttctgaggtcacagagcccggagcaaatgtctgtggggaatgtttacagaggtgggagatttcacctgggccttgatgagagcactagattttacctgatggatgaagcagggaatggtcttcccagtgaatgatggaagggtggagtagtggagagaaaagcttcatccagttatttggggctggaattctaagtgaagttgtctcaagttgggttttctaggaaacagagtctgagctgcagtttagcatttttatttattaaagtgcttgtttattaaagagtatgcttaacttcactcagtatgtagatatgggcttccctggaaggggcaaaaccttggatgaggcagctctctgcagctgaggtaattcccaagaggaccagcattcagactgtcccccaagatcacactcatcaactaggatgacaagtcctttttgaaggaccatctgaagggtccatcacagtgtccacttcagttgtctagagaaatagagggcacagtgtgccttcctttactgcaagctcagtccacagggtctcacattagctgagtgtgtgggaggaagaccaagtgtctgtgatgtcaggtgggtatttcggagtgtatataaattacagtaagggcagtgtcaaatgagtatgtgtaatgcatctacccatggtccctagagtccactagaagacaatttcttggtgtttaagagattattcttttaataattcattgatcttaacaatacaatacatcaatggtttacgcaaaagccatgttttatctgcaatgcacttctaaattgaaaggtatcataaaatggcacttaactttcagaatccttatgttatctaaagctcagtttcagatttgtttgatgataacgaatatcctgtctattttattatctagtacaagccctagtttcggaactcagaaataaatgaggcaatgcctgcaggtgggtggcacgtgtaggtgcctgtgtgtgtgtgtgtgtttgcgtgttttggagtatgcatggatttggccttatagtttattgagagcatttttgcactggtttatagtcatgcagtgaagcacctctgcatttctcacctggcccatttagtgtggacacattcctttgtcaacaaggacataaagccacaatctcctcctccaaacaaaacaaagtgaatcgctatgtgttcggtataatgggattgagaagtagagttctctttgctgttatttctccataataggcccatgatttcctggcccctggcattcaggatagtgagcatgtgcaagtgattacgagggcagagcagttgccagttttccctgtagctttcagaatgtcatcagaaatctacacgtatgggcagtgaggtctggctctcccatgtctcccctgccccatcttgattgctctctctctctcttgctttctatttcccagaaacatgaacttactttgacttttccaaatataccatgttccttaccacccagtgtccttgcagctgccattccctctgccaagagtgattcttgctgggccccttttagatcacatctttattcctggtggacagaaagaaccaggacaacaagcccatgcctgtcccaagtatagctgagtgcttgacacttagagaatgtgaataagtgaatgagcacagcataaatgaaataccacaaacaggccaagccaaataaactctgaagttgagttttacttggttattaatgatctttggcacaagagtttcagtgacttgataaggccacaagccaagtgtggcctggttcaagaagtacagggatgatacagacaagacagaaaggaaataaattctatcaaaaagctcagctgtcttgaaaaagcaagagataagaaataacttcagaggtgggtagaattgagaaaaggatttctattttgttattttccccgaataaataagccttaaacatgtttgtaagctgctgtgaagtaaccagcagagaggaagtgattgaagatgagagagagaaacagagtaattgatgaaccaacgtccccgaggagacgggagggatgaaatcaagagtataggtcaagaggcgagcctgggagaggccagtgctaaggcaggtgatatttctgcccggccgttagcttttgtgcagaatagtgaaggaagaatcaatcacttcctttctggctgggtaaatgccaagaaattctatggcagaaacttccccaggcaggagactcagaattaattgttaggattaagcataaaccaaaacgagcagggaaatcccaagcactaaatcccaggaatggggccttcatggataaaggaacttcatctgtgaatgatccaggagcccagaatgccaagggaagtttctaggttcttggagatcaagttaatgcccctcataaggttgtttcacatgagccaaaatgtatattgattttttttttttttttgcctttattacacttccagaaagagagcatgatctcctggaatctgtttagggaataaaaatgtccgtacagaagaaaaaggttgttttttgaccttctgctgacactgtcttcttgctctcatcacagcttattttctagcaatatgaggcccacaaattaggaatctccttgcaggccttcaaatatgatttacctgattaataaaatcttagtggaatagatagtattctcctgtgtgtgtgtgtgtgtgtgtgtgtgtgtgtgtgtgtgtgtgtctgatgattggggttcttggatacttagggtgcagggatgagggcaagctgaccttgtttttcatctaggagacctgacaaagatggtgggctgagatagccgtgtaaagctaaaacagaaatacttagtgaacaagcaagtgtgtgagtgaatagatcaaagaatgaatgaaactaccctctgcactctaggttctagaaggcaccctgaaaaaggcatgttgcttggggtataataattgctcaatatatttttcagtaaggaataaaagaaccaacaaatattgattggattaaatggattaataactgataaacacttacagggctgcggcatgtgctaggtataatgtattacatagataaaatggatacgaaccatataccaggccctgtgccaattgcctgcatgtaactcaaaacaaaagacaaaggtcttgccctcatggagcctgaagtccagtgagggtttcgttaaacttgtaggacaccatttccatgccttccatcagtagagcagattctctgtgcagatacttttcacacaaacaatgcctaaccatcccagaaaatctgagcggtgttagcaacctcactttctctgagataaagctgagatttcttttagtgacttgtccaaggtcacatagctattacgtggcagagtcaagactcaaacacaagtctgtctcatttcaaaacttgggctgtttgcctatatcaaactgcctttaatttgcccattttaaagcaggaaagaactaaaaggcttgctttgatggatgtgaggtgatttgttaaaagcttaagagactgccatttttcatgatatgcgtaaatgtgccctaacctcctgaagcaatataaagtggttctttatgttcttagggtattccccatctaaggtaaaaattatcaaaactactggggagaaagcttctctggagatttgccttataaaataaacagaaatcaattttgacttgttttctaatcatgataaatgaagccaggttaggagaaaaaaaaaaaaaagtcccagcattagttgaggatcattttgccaggatacattggtctttgacaagcaattaagaagtcctgtgattgtgcctggcagtgccacagctcagcacactcctgattaattctcattttctttctttcctcgggatttatttactcgtttcacttggaatgtgtttagcttcttaacctcccccacccctcttttctcacgtgcttctttgcttggccccctacaactctacctatacattaatcagtgtcatattcattactgctggtgaaatgccatacaacattggcattcattcatttttgtctcttctgttgagccattcatggtagatttccccaacgaaacctaccatgtttgttttctgtatttcccaccagatgttcttttaaaagccagaagatgtctgccttggtctggttggtataaagagggttcatccaatataaactgccaacagtaggttggaaatactcatcagtatggaaagggcgaagtctgggcaaattggatgggtcttggagaagctctaagagttggaatctacatcatcatctttgtcttcatggctagcaactgttgactcctttctctagttcaggcattctgtctgactcttacattatttctttgaatccttacaacaactctataaagatggtaatggaaaaagacaagatgaccaagattcagagactttaaagcacatgagcagtaagtggtgaaaccacctcaggcctctgcctgttgacttattcataggataacccacagaaacactaattcaaacatggtgtcagaaacagcagcagtaatgaatgcctcaatgaaaaacatttggcccagcaccttggttaggttgagtttgcatggcaaccctattgaatcatgggtttctcagagctgggagctgcaccatgccatctacctgcacctgtcctctttggaggctgggttggtgtttgaccctgtgaagagctttggattgctttgcctacccgcagtggacttgctcacacataagtgggagccctagctcatggtctccaaatttttatcctcatcgtttcttcccacctagttttttcctaattctggcccttcctggccacccaccctgccattatctttctctgacgcttaggacttgaacccttttttcatcctttttgttttattctggtgttttagtcgtgagctaactggaaaatgcttctcacagtttaattgccgtggaaactttctacttggaatcagaccctaacgggttttttccctttccttagggggctgtgcatataggaaaagggaacatatatgttatccctcatgtgttaggggctgtatagtaacaagcctggaataacccttagagcaccttcatagggaaggtagggtttattatccatgtttcgtaaataagagcactgaggttgagagaggtgatgcagattgctgaagtgcctatagctaggaagtggcaagtcacaatggggccccagttctgtctgctctaaagcccagtctgtctgtctgcttctctgtatgtctctctttttctctctccctattcttctggaagtcatagaatcctgtgattctcttccaaactgcttttttttctattaaaattataacccgttattaaaatatttaagcacacaaattaactggtgctaattatgatattttgaatggtaataagcaattagagtgagatttaaagaagaaaaaaacacctgtatataacttggcatcttttgtaataaatacaaacacctaaatataacttggcatcttttgtaataaatacaaacttttgtcaatcatgacttgatctaaccgatatgcctcaggtctgcacagaacggaaatgttttttggaaatcctagtacttcagaaggctttggcatccaaatccattgcaagtagctttctatttagtctctcattttctctctaaagagagattgatatgatgatttttagcttaatttgagagatgttgagttttctccaagacaccctcgttggttcaccttgctctgaatcctttgtcttctcaccctttgtggcaaattgagacgggggaaaactattaggttggggcgaaagtaatttctgtttctgccattacttttgccccaacctaatacctcccagcaaaatgcaggggttgcggagagaaagggagtgatgtatggagagtcagtcatagtacatgtgcaattcaagatacctgggtgggcatagtagtctttcccctggagttctatgtcattgcagcctcctctcccatcacagcataatttaagtgaagcaggtttaacgggtggtcagtatttaccagagccagccttctgcttctggccagctgggtgacttgactagcagaccattactccatgtgggccaccgtttcccatgaatagagtgcgacatttgaactaaatgaacctaggtttgtcccatggagtgcagtttctccctaaatgaacctaggtttctcccatggagtgcagtttctccctaaatgaacccaggtttctcccatggagtgcagtttctccctaaatgaacccaggtttcttcaaaattctagaggctctgactctagcagctgcaattggactcttccctagaagcatctcgctgagtctgagaaaggcacgtcaatgattcttcaagggaagtagggggaagcagaggcagtgccattcacaatgagccacggctgctgacagcagttctgtaaccatccggtgtgtttagacgggagaaagagcttgagaatcgcgattatatggatcatctctctctagatggacttcttttatgggagataatactgaggttaagaggttaagcaacttgctcaggtcacgcagcaatttataatataacaagatatttatgagtaaaacatatatgaactaattatatatctgatagtcgtttttaaggaggaagaagttaccataagaaaaagaaaaacaggacttgggtgttataccatgaatcacacgtgtgtgtgtgtgtgtgtgtgtgtgtgtgtgtgtgtaagataattttttcagcaaattaaaaacaaagcctaagaaaaatgagaacttcctgaacaaaaatattcaaaatgatgactaactagaaagtatcagaaaccacattttccttaaccagtactgtctcatacaaatataacataagtcacacaagtaagtttaaattttctagtaggtgcatcaaaaaagcaaaaagaaccaggtaaaattaattttaataatgtactttaacccatatctaaaatgtgacttcattgtgtaatcaatatgataaattattcacatatttgacctttttgtactaagttgttagaatccagtgtgtatttattttgcacttgtggcatgtctcgattaggacgagccacatttcaaatgcttagtaaccacacatggctactggctacagcattgtacagtgtggcaaaagtttctctcctttttctcttttcccaggctctgttgaaatttttctttcagaaaaatatttaaataggatatactctgactttgaaaaaatacacatatgtgtatgtttatataagtatatgaatatatacatgcatatttctatctatctacctgtctaatatctgtcatcgatctatctacctacctacctacctgtacatctatctctctagagatcttctccacaaaagcaaggaaagagaatctctgacactatattttcttaatgaagatggagaagtttttgcagttctcattatttcatttcaggctttcagatgttcaggagccctttactagaaggttgatagattaataatctccccactaagcttatagcttagcagacctccatggtggccatgatgaggattcctttaacacatgattggcccttagtccccatttctctggtgtgagttttcagcttttgttaccacatcaaagctccggcaatttgtgcaggaaaccccttgaagcaatcatgaacccacttgtactgtaagagttcttacttccatgtcctaaaagaataataaccacaaaaggatatttccttgctaatggactggggagaatggactgtgacaaaggctggtttctcattgccaggattttaatgaggggactcacctgaaaatgtctagtgcacattaggctcttctaatagtttccgagagctggagtaacagattaccactaactcaaatggcttaaaacaacagaaatgtgttttctcacagttctagtggttagaattccatattcatggtttcggcagggctgtactccctccgaaggctccaggggaggatccttccccaccccttcctagatgctggtggctcctggcagtccttggcattccctgcaggtgcatcttgccaacctctgcttccattgtctcatgacctcctcttctgcctctctgtctgtgtgtcctcatgtgtttttgtaaggacaccagtctttgagtttagagcctaccctaatctaaaatgaccgtaactttgtcacatctgcaaaggccttatttccaaataaggttgcattctgaggttctggatgaacatggattttggggaggcatcatttaacccagagcaactgtcactaaaattttcctaccaagatcccttactctagtttaattggcctcttattcaaggcctactccataagttattttggaatatagaatttcagaacagaaatgggatctgatgattgcctagttcagtggaaccctttctttaaatggaaatttagtcacagtaaaggacagaaaagaacgcgaaccaaagcttaggtgatatgtttgcaggaggaaggggtggcccacagtgacccccgctgccccctcctctttacccctcactaggctcccggaagacttccagagcatcccaagggctccacaaacccctgtttaatcataatccctttactgtagggattaaaaactactgtttagggagatatagtgaattttcccaagtcacactgcaacttgaatctgaggcttgacccatctatgaaatatccaaactgtcggtccattcatttctgcattaccaacaatggtcagttatatatttttctttgagaagagaaaagcaaaacagtccatgcttgcaattcttttcttcctttttgtaaactatgacagaaaattcatggtgaggccaaagccatgacaacacctgtgttgcctcacattgattttctgtttccaactggaggaagaggttcccggaacagccacttttgagtcaagtgtgtgaggaaggagtctctcttgccaaggactgctgtagatgattcctgcatagccagcgctgtgcagggcctccacttgagtgagcactctgttcccattctatttctcactagtattttgagtatgttccccccaaagtagagatagtatgtctttgaatgcaaaccatgggctgagccctccaaattacttttaaaaaattagcttcttcaaaaaatttttttccacttccctactgtcttaaatatactggtgcttctgccctaagacctttcaggaaaggtacatgttctacctgatttacaacaataggttattctgggtaaataatatatctgttggatttattgtgcttattattttattggaccacactatccttaacctagagaagaagcttgaggaaaggagctagggtcaggcagaagacaggtatgttttgaaataagaaaggaaaaggaaaacgtctggaaccttgacattccacaggatattgtcccatgaatacaaaaggtgatgggtagctagaacctgagggaggaggtgccttcttttggaattaaaattccagaatgttctggaaagtgccagatgcaagaccaagtaggaccagctagtaatggaaattcctcccatattgacaaggttgatgaacacatggtgggtgcagctcatggaacactgggaggtcaaaagcggtctcagttacctttgtacaatggacatggcaccccaggttaacacaggggccacctgcccagcaggcatgggcatcagatgaaggcattttttaaacaccttatttaacaattcagagtctagatacgagtacattctcattttaaatagttcagaaaaacagatattcccttttcctccttccaaacatattcttcccttagaggcaaccaacattattagtttaatgaatcactttccagacctttctctcacatttaggtacatacaatcacccctcggtatctgtgggggccaaaatccagaaacctctgtgaataccaaaatctgcagatactcaagtctcttttataatatagtgtaatgtttgcgtaaaacctaggcacattctccctatacggttgacccttgaactacatgggtttgaactgaatggctccacttatccacatgtttttaccaaatggcaaattgaaaatacagtattcataagatataaaacctgcatataaggagggtcactttttcatacacaagggttccacggggctgactgtggggcttgagtatgcatgggtcagggtatatatgtgggggtcctgaaaccaatcttctccatatacagagggacaactatactttaaatcatctctagattacttatgatatgtaatacaatgtaaatactttgtaaatagttgtactgtattttaaaatttgtattatgttttatagttgcattgttatttttattgttttaaacaatattttcaatccatgattggtcaaattcacagatgtggaacccacagaaactgaggactgactgtatatgtgtgtgtgtgtgtgtgtgtgtgtgtgtgtgtgtgtgtgtagacacgtagaattttgtgatctagaagtgttaaatataagaggtaattatgtgaggtaaataaaatgtgtgcgttaaatataacaggaatactactatatgaatttttctgaaatttgtgttttaacattttaagttgtttttaactattctttggtacggacattgtattagtctgttctcatgctgctgataaagccatacccgagactgggtaatttataaagaaaatagttttaactgactaacagttccacatggctggggagacctcacagtcatggcggaaggcaaatgaggagcaacgtcacatcttttgtggtggcaggcaagagagctcatgcatgggaactcccatttgtaaaaccaccggatctcatgagatgaggggaacagcatgagaaagacccaaccccatgattcaattacctcccaccgggttcctcccacaacacatgagaattatgggagatctcatcttattcaagatgagatctgggtggggacacagccaaacgatatcagatgtacttcgcatatcatgtatagatgagaaaacaggcatttcttcccaatttttgcccatacacatgtggtggacatttttcatgtgcaccaatatctggtccttttctgcttcctggttacaagaggttttattaataccttccctccctgccttcttggagttagctgtggccatgccactggatctgaccactgaaatgtacttggaagtagtggcatgcgacccttctcagccaaagtatacaattgccggtgttcaattctccacccctctttacgcatcccatcaaatgccgatgtctgagtcatctgtgtccctgggtgtctatgctcatcagaatcctgctgctgacctgcatgcagcatgtggcacaggcaagaattaaacccttgttgtttgacatcatgcagactttggaactacttgtcatcactacataatccagcctattctggccgatactcatagctatgagcagccttgtacatgcttctctctgcacctgtgatgacatttctccagtaatgaatgtctattgaaaagttaaaacattaaattgcttttaaagtaccttcttatccctccagcccctaccttttgtccctaggctcctctgcatctgttgactttagattttttttgtattatttattcatgttttattagataaatatcttccccagacaaaccttgaactccctggagtcaaccgattcccttgcccaagcctctggtgttagtgattgtttcattaaactctagtctcaaggctaatccttgttggaaaattcgttctgtcctataagaaggctcccaggctcctagtctcaaaccactaaacaggccgcacaggtgtttagtggtacttattggtggccatgtgacattgttatttctctttgcatatttctcatatgattcacagtgtttaaaaggattacctttttggttttggaggtgcagatttagagaatgggatttccaaagccatattgtccctttcagagcacagtgagggtgttctttcttacccagagggtcaacagtgccacaggcttgccagtggatgagtttaatcaactctgactgtgtggccagtgagcaaagaacatgacaggggtttctttgaggtgagcaatgccctccgccagaacctagaagtagggtaatgatgctgaggttggtgtacactcagaactcagtactgccgcagagtaaggcagacccatcccacctgggctgtagctcccacgatggtgagtccctagatcgtaagttgatgggaagcataagaaggtcagaaccaaaccagagctttgagcgttctctcactgcattccatagtttccccgagcgctgaaattctttgcaacttccattcatttgcacatctcatctggctgtaaggcataatgtggtctgtgtgaaaaagaaacttctgcaaaagagtcagattcagagtttatggcaacatcaaggaatagtttatcagttcagctgagtataaccacttgatttagcacttccttttcatcatgcctctcccctcatcacaaaactgcaaaggctccctgtgacatccaaagcctctttgtctttccctgtttaggaaaaagtgacctagagggaactctgcaggggctacatacggaatcttgatgttgcctcctgcctgctgtactgtcctggttaaatccttcctcttctctaactctgtgtctccatctgtaaaatggggatggtaatagagcctatcctgcaggataattgtcaggattaaaagagttaacccaaaacagataataaggggttctgaagatccaccaggagcctcactcagacaccttgatgcagacagcacctggtaaacatgggtgttcagaagtatggtccttcccttacggccccttactcaatggccatccattgtctgctgagcctaggtccctcacacctatgccccaggctcctgtcctggaatcctggcttttaccaccaaattccccaaaagccccgtgagtggctgttttgagctgagggcacctgctcctactggcttcctggagccttagacgcacccagtgctctggacctcccacaccttgttgaaccacccggcacttgctgactcctctcctgaacctcatgtgcttgtgacccacgattcagccactgtctaaccagctcttccgtgtgcagccctcagagccccagctcccacggctctaattccacggccgcccctgccgtctcttcagccatcccatcccgccatcaccatggaaacctgtgggaacagcagcttttcctcatcctcttctccccttaatctccagcccactcctcctccctcttcttgtctgtgtccttcccctgagacatgttcaaatgttgtttctgcatgttaatattttcttaactatttagtgaattcatcatggcggagggagtgagcacgaatggactctgtcatacttcacagaaattaaacctgagccagctaaatatcctttcctgctccattctaaacctttatgggtctccacaataaccagtaactccatggttgtagagttcagataatcatgacataaatgtaggaatgaaggcaaacaggccggcccttcccccagatgactggggtcttcccagctggtgtaaaaccctcttctaggtcaaaacatttcttaaagtaaatgagtgatgactatgacaggtgggaaagtacataaaataatgtgattgaaatactcttagttggttctgctccattgaccctagggaggaagaaacaactaatttgtgctttctgttattgcattgaaagagagtggtgactcgccgggcgcggtggctcacgcctgtaatcccagcactttgggaggccgaggtgggcggatcacgaggtcaggagatcgaaaccatcctggctaatacggtgaaaccccgtctctactaaaaatacaaaatattagctgggcgtggtggcgggcacctgtagtcccagctacttgggaggctgaggcaggagaatggcgtgaacccgggaggcggagcttgcagtgagccgagatcacgccactgcactccagcctgggtgacagagcgagactgtgactaaaaaaaaaaaaaaaagagtggtgcttcaaaattgtgtctttttcaacgtttgttgtctctacatggtaaaatctgaatttaggcctaattcaaaatccatgagattgggaatgggattgggaatctcattatttgcattaatgtatgagactctctgagtaagtgttggtttaagtaaatttttttcttaaaaaactcagtagaaatggaactcagattttaaaatggactttaaaatggtctaaaaagtgtttctaggtacaaaatgaattggagtttacctattttttccaaagggcaggtagcaggtctgaagtgagagagggaaacgttcgatgctgcgttgttctgggagatgtgagccgccggctcattcagaatgtgcagggatgtccattcccacaggagcatgtgtcgttcagccaggtgcatgttttaccttgatctactgtgcttggagccttttctttcccagatctaggtctgatacctgcccctcctccttaccctggactgtaattaaagggaatatgtggaaatccaggccacaactattttactttctgtgaataaggccatcaagttgatggcttgttactgtgggtcgatgggtcaaacatgaggcaatttggggaaacagcctaaggtggctataccacagaggccagcagagcaggtaaccaggcacaagatgcgatcgctgacgagagagctgctgtgacagagtaaggagtgcatggggaggagggaccactgaggtttgtctgcgtgtgggtaccccatgcgcagatcctcaacagccgttccaaggaagtagtcatttgggagatgaagggggtgcaggtagaggagtgggggattgagacagggaggggaagccacctagctagtgaggtttgtgtagcaagaaggtaaccactcggagcacctggagtttaatccttaaggagactgctgagaaacagagtggtgcacacttagggttattttactgagaggcaggagatgtagacagcgctgggggatgtagacaccacttgttaaaatctggcagaagagaatttagagaagaaaggtattgctgtgtggtaagagcaatgacttggtcaggatgagggtgggcatggagctctgaggaagggacgtacagaaaccaggacagaactctagccattatctcctttcttctagcgatctgacaaggtcctgctagatccttcactagactctagggcaggcttctacttagtacaactgataccaccgccatgcagccatcatggcccctcccagggcccatttgttagtaataataataataatgcttaagaagcattgagtcctaactgtgtgtcctataaactatcataacccgtatagtcttcataaagatgccttcaaggagacactcttattatccccattttacagggagaaaaaaatgagcctacgttcagcaattttaagcaaattttctattgtctcatgactagtaaatagtggaataggccagttttgttttttcaccttgactgactgcaaatgtctcagtcatgattcctgaccatcttctaaccctctaaggacccagacactcctaagtagttaaagagtctgacgttatcaatcaatggaaatattttcaaaaggtaaagagaaaagaaattaaagttatgatgatcttttaaggcaaatcctgctttcttgaagcttggtcagccctggcacaggcaaaagtgcatgtcatttcaaggcatggggcaggtgaaatggaacacggctgtcctggcgtccacaactcacaggagagtggagaatgtggaagttacatgctccatttagacatcagtgttctctactacaaaatcgtttctgcagttcattaatcagactctccaaatttgtttaactcattatttataacagcattaaatccagtgacaccaaacggtgtcaccatgagtatcaggaagtctgattttaatcctcagaaaatgtgttcaatgtctttccctccctcctccacacttaacagggacagtgaatggaagccagtgttaaatttgcacgatgtgcagtggtctaaactttcactgaatcctaatcaacttaatatcctgttgcctttttgaaatccagtgatgaaatgtaaccctgagacagcttaaacagaactcaagcctggatgctctctgcaaaatggtctaatttggtggttatagcgctagtattgtatgtacaatgatcaaatcctgtgttttcaattgtcctttttatggtcaatcaaggcggtcttaggatatagatttaatatcgcaagagtctaatgtaacaggctaatgcatgccctccagttacagggagaatgtctttttgtgacagtggttctctgggtacgtcttacaggcttctatttttgaacttgactccaagggccaaagcagcacattttggaaatggttttgtaaactgtaacgaaggtatctttcttcagcagcttcctgcccaaagacgccagagtgctttacaaacttatcaaagtgatatacagggatcgttttagcctctgctgaaatacaggggcccaggggggaaattacagtcattgttgaaaaatcttagattgtcaggtcgacaggaggagggagagtgtacagcacctaaaatatcctcccaaactggatggcatgtcccaagggctgtggtcttatctactgcctgctgcaggtgacgtttgtgaaaggggtcctgtgagttttgatgattgtctctcttagacatgctggtaatacagctccttgtaaagctgattcttcccttggatttgctcatctcatatcagagactttaaggtaccctctgacatacaccctctacaaaataggcatgttgcattttttggcatactagaccatcagaaggggaactgctatatcacagcctctggaatcctggctaactacagggaagagatgtctgaattatagcagaacatgaaagaaggcagcttgtgctttaaaggaggtgttcaaagcatgtctgagcagagacttttgggctctgttttaattaatactttaaaataattcatatttaaaatatcagatgtttccataaagaggaggatgtttaaatgcctccagactacattcctttttattcttgattttacctgggagtccaaagttcaattccataaagcaagcgtttatttgtcactttcaatatacatcgattgccatgcttaagatgcaatatgggctgcggaaataggttaacccacaggctcccagggcccagtgtagaaggtgagagattcgtgtaaaatgattcaaataaaaggaagaccctggccgggtgccgtagctcacgcctgtaatcccagcactttgggaggccgaagcgagtggatgacgaggttaggagttggagaccagcctggccaacatcgtgaaaccccgtctctactaaaaatacaaaaattagccgggcatggtggcaggcacctgtaatcctagctagttgggaggctgaggcaggagaatcgtttgaatctgggagttggaggttgcagtgagctgagatcgcgccacagcactccagcctgggtgacagggtgagactctgtctcaaaaaaaaaataaataaataaagtaaaaataaaaaggaagaccttgataaatgccatgatagatacattctcataaagcccagtagcatattcgggaggtttatgagaacatatcaataatttttatgtttgttaaaatattttaaacaatatttttatgtttgttaaaatatttagttgtagtttatcttaattttaattttgaagtaacagagcaggagacctaaaaaatattccctactaggagatagttgtggaatatatagcatttgtatttctacatttttatgtgacacatttaggtgttccttaaataaaatgaaattgaccaaagttctggttagtatgtagcaaactaaaattatgtgaaaatatccaaagccttaacagagctaggatattcccgcatccacactcacacagctactcactgtaaaagtgatcgttgacaaacataaggaggcaaataaaagggcatagcctttgtcttttaaaccactgtgacaggaaaagttatggggagtgggtcagtgaggaaggaagtctgaacattgctgcattcaacagagaaagtaaatgaaaggaagacgcttacaaataagagagaagaaaggaccgcattaactctaaagaaggggctagcaggtcctgtggagccgatggggcagtgcaaaagcctgaccatgctgatctccattgggtgggtccaatggaagaacgctcagggttacgtcaggaaggtgccctagttttggggaaagaacatttcaactcaggttcagaggaaaatttagatatgttaaaactttagataagttaatagacagggcagaaatgaaagaaagaaagattcttcacagggaagtcctggctatctaactgtgaaaacctgaaagatagttgagaaaggcaagagaggcaagaaggagtggaaatgagggggattcagtgagacatacgcaaagaaagggagagaataaaatgatacattcaaagaagcgtattgtgacaaaatgtgaacttctctaataaactcagtttaaaagagaacatataggccaggtaccatggctcacgcctgtaatcccagcactttgggaggctgaggcaggcggatcatttgaggtcaggagtttaagaccagcctgaccaacatggtgaaacctcggctctactaaaaacacccaaaaaattagccaggcttggtggctggcgcctgttatctcagatacttgggaggctgaggcgggagaattgcttgaacccaggacgcagaggttgcagtgagccgagatctcactactgcactccagcctgggcaacagagagagactccatgtcaaaaaaaaaaaaaaaaaaggcatgtaaagtaaatggatgcacatgtgaggagcagcatccatgacccatcacaagtgtatgggatcctaaagcttcctgacaattgcaaatgttaaataagccaaagatcacaaaaagaggtttgttttggcagttgtgcacaaacctgctgcgaggcagctggtgccctggtaaaaggtggcagagcaaatgcagaaccacacaggtgccgggtacctcctttctgtggtcaaagaaaataatcatcaccctgcaaaagggttggacaaatataaataggagaaaattgaaatccaagatagttgagaagattataagtgtatcctactgatttaaacgagttcacacctatgaaactagatgaattatttctcacagaagacccggagaaaatggtgattagaatctctgcaccagtttctgtgatttttttgagacatcctgaagatgagaggtgagtagacagcagatgggcagggccagcatggtttttgtctggttatttatttctgtggaataagttcctagaaataggatgtctctctgggtcaaaaggtatgtacactttcacttttttttttttttttttttgagacatagtgtcactctgtcacccaggctggagtgcaatggcactatctccgatccctggaacttctgcctcccaggttcaagcgctcctcctgcctcagcttccccagtagctgggattacaggtacccactgccacgcctggctaatttttgtatttttagtagagacagggtttcaacgtgttggccaggctggtcttgaattcctgacctcaggtgatctgcctacctcaaccccccgacaaaatgctgctattatgggtgtgagcccctacgcctggcccacactgtaacttttgatacatattgactaattgctcctctccagagtttgtacccaaattataaagccacccagagtatattagaggaccatttattatacctgtttgataaaactatgcatttttatcaaccaaatttttaaaaattaatgtggctttattgctcataaggtttaacttttttcatgtatttattggccatttacatttctttagtaaaatacaagtaatgttccttagtacatttttctgtttggctttttgttttatagtactcatagtaattgatatgacaagaatatcaattttttgttggcctatatattccaaatgtgttttttaaatgttatatttcaatcttactttttacatctttgtcatatggcatctttactttttaaactgttattttagattcaggagaatatatgcaggttagttatataggtaaactcatgtcatagagatttgttgtacagattatgtgatcagcctcgtactaagcctagtatccaatagttatttttttctgatcctctttctcctcccaccctccaccctcaaataggtcccagtgtctgttgtttcccctttgtgtccatgtattctcatcatttagctccaacttataagtgagaacttgtggtatttggttttctgttcttgtgttagcttgctaaggatgatggcctccagctccatctgtgttcctgaaaaggtcatgatcttgttcttttctatggctgcataatactccacagtgtacttgtaccacattttctttatccagctcaccattgatgggcatttagtttgattccatgtttattgtgaatagtgctatagtgaacatatgtgtgcatgtggccaacattttaaaagaaatggagaaggtaagttctggaaactggtagcagaacttaagccgcggtataattctgaacaggtccatctgttcgtcatcattcatctactctaaatccatgcatctctgttcattcagcaaatattgattatgtgcagtgtgctaggcattaggaaatatgctagaaaacaaacagaaataatagtccttgccttattgaaacttagagtcaaatgaggggaattattaaacacgttttgtgaattttaagagggcaatagtgagatttgtttgatagaaagagtaatatcgagatcaaaatgtgtgtgggtggggtcacgatctttgtgttagtcagggcctttgctactgcaagtgccagaaacttaaatcaaagtggctgaagcaaaagaacactgcatgcctcatgtatgcgagaagtccatgaatagggctggcttcaggcctggctgggtgtataaattcagatggcaccctccaccaggacttcgtcttcatctctttgcttggcttttgtctgtgttggctccattccccatgcgtcaccccttcccaaacctcttacatgtttttattttcccataagttctcccctcataatgcaaaggtagttgccagcagctccaggctcacatccatccttcagagaaactccaatggaaagagtctaacacagttcaaaccaaagcacaggatgaagttcacttaaatgaatatgggtcctgtgctcgtccatgaatcagtgatgtggccaacaaagacaacatacactggtgatcatgacctgggtcaaagtcaaatgcccctcctacaactaggaatggagtcaccccatctgtaaacagactgagagtctgtgggaacaaggcagtttcctatggaaaagaaaagaatgctgtctggtgaggctgtctccactgcaggccccactgtggatggtgctggtcagagactatcaggggtattaggatccattttttaatcttatattctctctcacacactctcttttttccccctctcttggcttgatttcactagttagagccttctttacaaaatcagacagaagggttaagaatggacatcattgccttgtttctgatgttaagtggaaagtatttcatctattaaacatttataccactaagtatgatgctccctgaaggcttttcagatgtgctctttatcatattgagtgagccccattcaatttcaaatttgttaaaaatcttttatcatgaataagtgttagattttatcaaattttttttctgcatcttttgagatgattgttgtttttgtcctctagtctattaattaagcttattgtattaattgattcttgaatattaaaccaaccttgcatacctttaataaagcctagttggttattttccttgaggtgtacaatccttttgataagttgtattagttttctgtggctgctgtaacagattaccataaatttggtggcttaaaacaagaaatttattttcttacagttctggagcccagaagtccaaaatcggcatcagtgggtggaattaagtgctggcagagctacactctctccagaagctctcggggagcttcatttcttgcttcttccagcttctggtggcagctggcattcctttgcttgtagtcacatcactttgatcctcaaggccactatcttcaagtatcccttttctctggtgtcacattgccttctctatctctcatagaatctccttctcaattccatttataagaaaacagtgctggcatttagggaccacctgaataacctaggatcatctccccatcctaaaatatttaattcaatcacatatgcacagacatttttttccaattcaggtagtatttacaggttgcagggctcaggatctgacatctttgggacccattatcagtctactaactatgttattaaatatagcttgcaaatatgttgtcgaggattttgtttttatattcctgagagatattggtctttttttctttagatatctttaaatggctttggtagtaatgtaataatgtaatagtggcctcatagaatgagttgggaagtgttctctcctcctatattttttgggagagtttgtaaaatactggtattatttcctctttaaatgcttgataaaacttacctgtaaatctatctgggtctgagcttttctttgcagaaatattctaaattactgattcaatttattattattattatttgtttttaactgttttctgctattaagatttttaatttcttcttgaaccagtttggtaatttgtgtcattctagaaatgttttctatttcatctaaatagtctaactgttggcataaaattattcatagcatttccttataatcatttaaatttctgtaagatcagtggtggtatgccctttgttatttattaatttggtgatctgtgtcttctctcttttatcttggttagtttaggtaagatttgtcaattttgttgacattttcaaagagcaaatttttggtcttattgattttctctgatgcatttgtaccttttttgtgtacttcaaagaagccattggcaaattaaatatgactggacaacttttcacataagtaactaggaaaggtaaggaaagacacagaatataattcaagtccctgaaggcctgtattacagaagaagacataggcagattctttcacatgccagggagtagaactcagattagtgtatagaagtttcgaagaagcaaacatgagtgttgttgcccccatcctagaacacagactctagaatcaatcagatttagaccctaattctggccttgcccctcttcttgttgtatgtattaattaaggtaatgtatgctgctataacaggtatgccttcaaaactcaggatcttaacaagttggtacttatttcctgctctggagagaaaagctcacagagaagaattttatgacccatgcctgaaagtgagaattctacttatgtgcacattctgttgactagacctaagggaggctagaaaattagtcaaatcatgtgcccgagaggaaaataaaatctctttggtgagccactagctagtctgtgccacactgtataacctggggtttaactactttttgagcttctgattccttaaatgtgagaagggtatacaggcctaccttgttgatattgaggatttgattccagacaacggcaatcaaggaaatattgcaataaagcaagtcacacatattttttgtatcccagtgaatatgagtcatatttatactgtagtctcttaagtgtgcaatagcatcatgtattttagaaagtatataccttaaagaacattttattgcaaaaaaaatgttgacatagagactcaaagaacacatgttttaggaaaaatggcgccaatagacttgctcaatgcagggttgccacgaagctgcaatttgtaaaaactgcaatatctgtgaaatgcaataaagggaagcataataaaaggaagtatgcctgtaataatttctgtcacatgggtgtgtccatactgctcagtatctggcacaaggtgggaatttgatgaacatttgttccatgagtgaagtgagtttaaggactggtgtgcatggtatgctcagaactacatttggtttatagtaagggttcagtacataagcatatttactgctgttattgttcttaagactttagagaggaataaagccagacaagaacattttaagctgaagtttgaagagtgaagtttccatctctaaaagttttcaggcaaaggccaactcttagggaggtcacagagtcctacttttgtactctgaggctatggaatctagtggggcatcagacaaaccatagtttcatttactatcttgtaacttcaaggaagccactttactttcctgagtctgtttccttggatccaaaaacctacttagtaggatagccatgaaaattcagtgagataaatcatatgaaaccagaacacagctgatacatgcagtgaagcggctcttaaatatgtgcttctttcctcttacttcgcttcctctttattttttcctggtctatgatacagaaaatcgtctgaattaattgcatttgaaacgaacattggttgtaatttaagataaagagaaaattcctaggttgggaattgggatcctggttctgcattttcccagcccttcctctctgcaaatgatcacagaattacatagtctggaccccaaaagcaatatcttctgttacttaggattcaaggcacacatgtttgtaacaattggcttctcaaaacttgtaagaactactgatgggtaaacaagtcatgaatcagttttttatattcaatcaaagttgatggagattacccaattaaataactggtatataactagtttccctatttccttttccctgtttcatagaaaaactagttatacattgcttttctgtaagaaggtggtaaatgtaaattgagaagctcgaggttagcaaaacagaagataatgatcaaaggactccatgtctatgtggttgctttatgataatgctgaatagcagccttgttcatgcagagacaatataaaagcctttccccaacttctccccctcctccaattcgtaaaagtcaacataatgttaaaacaaaacaagaagtttagaattaggatgaaacccatctagtaatacagtaatgtcaggaggacaatatcaaaacaaatatttatttactcaggtggtggttgcggttttcgggctttttctcagctgcggtgcatttgtggcttttatttctgcactgccgcttgttacttggagccattacttcctatctgtgttgtcaatcgtgtcttgaggttattctagcaccttacgaaaagccaccatccacctaattttagagcttttaagataaagcccgggagcactaggaaggtgagtgagttaccgttatcaatctggaatgtgaggtttccagtgcagtagcaccacctcttctaggtcaccatggccagcccttctcagaatacagaatgatgtaataaataatgcctgtgtgaagtgaaagctttgagcaatggaaccagctaacatctagaattttattaggcacaaactttctcagatgttctcagtgctattattaccccctcgttaaagctggtaattcttgtttttaaagcactttggagacactcattgatacatgcctgaaaaaaaaatagatgtttattttttccttaaaaacttcgcatgagactttagaaccgtatacgaataatactctgattactgaagtgggtggattttccagtctttatttttcttccattaatcatcttaagagatccaaactttccctgccatgaaatgccagacttcatgctgcaagattcccctagttgaggggaagggcagagccaaccagagcccctggccctctgtcaggggctgcctcctttagctctcagtaataccatcagctcctggcctccttatcaaagagggaggaggtgacataaaattagagaaatggcccagagaggtggcccctcagagcacccctagctggtgtttaaaggggagcagttatgacgttgttactgcagataattgccagttgagtgtggaggccctgtgttgccagtcccacccactgatcaggaaaagctggtaatcagccatggcatttgtatgctgggaaggaagaacaatgggctacaccagctttatgtcaatcagcattgccctgacatcccctatcagacttctgcttaaatctttttggctagaacaggtcatgcactagctgcagaggaggttgacaaagtgagtattcgtgtccccagccattgtggcagatgaagatcaggggaaggtttttaggaatgggtatggcatggccaacctgaacactgcctaccaacatgtagacatgatattggctgggtattaaaggaaacaaacatgtcagacagccagaaatggcccacagcccatgaatttaaaacctctacctaagagcagcccattgctagctctcgcaccctctctgcccttgacctcaataatataccatatcttgattcactggctccaggtctcctaccaccgaggacttgccttactttttttttgttgttttctccatggagtccatctgttggaacattctgtctacaaactccttttgttaggtaataatgagttttcccattttaaaaaattcagcaaagactagcagagctgccaaccagagcctctgatcaacacaggataaccagcaggagagttggtggaattccagacagtggtaagaaaaaaaataaaaataaaaaagacattttaattagtctgtgcagctttatcttgcataaatggatacattccactaggccagggattcctaactttttctataaaggtccaggtagtaaacattttagactttacaggccacagggtctttgttgcaactattacttcttgccattagtgtgcaaaagcaccctagacaatatttaaaatgaatggacatgacagtgttccagtaaaacgttatttccaaaaaaaaaaaagaaaaaaaaaggccagaagaccattgttttgcagatctcttgcatgaggcttttaaaggtattaaaacattttcgcacccctgtgcctgttttcctgaaagtttagagatcctgagttggaacactgatttgcattataaaccttgccctgaacaattctcagcctgtccagattgctaagttctgcatgacattcttagtaatgatgtccccactttcttccctctgctctgaagctcattcttgttgagcttgatggcattttaggcttgactttctctagaagtcttcactagattcctagaagagggaggcacagaagctcacaagctctaggtacaaaagccttgaagctttcgagaagacagataagccaggaagtgattctagctctgctgtatatctgtgtaaccatagttattcacccaacctctgagcagtgtgaggcatggacaggaggacttcaaccaaactggggttttcatctcagccatgttcatccaggggtatcattggtccattagtgatgaagatgttgtattaatactttactatgtgttttattccagtgtccggttataattgtataagaaaccatcataaacttaccatcttaaagcaataacaatcatttgttttactcacaaatgtgtcatttgtgagggctcaatggggactattcatctctgtttttcacggtgtcagttagggtagcttgaaggctggggtaactcaatagctggaggttgggctcctttattcattccttaatgtgcttggtggttgattctggctgttggccacagtatccacacatggcctctccacgtggctgcttgggcttcctcacaggatggtaggtggtgccaagagtgagcatcccaagggaacaaggtagaaatgagtgatattttatgactgaggcttgactttaccatattttatagcagttggggcagtcatagattcccctgaggtcaaggagacagaaaataaactcctactcacggagagtcatgtcaccattaccttgcatcgtgagcatgagagatgtaatatgatggctattttgggaaaattcagtctcccatacagaatataacttgagctattttcagcccatgttttaccatcttcataatgccttatagttgaagtaatataaggatacctcacgtgagtagaggctgcgggtatttagaagacccaaaacagatgttaaatgttcatatgtgccattttctcttcctataactatttttcttcttctttctctgggaaactccagcttacattttacttttcggcctagaaactgttcctcaagaactcttccctagtaagtgatcccatagaacgccatgtttccccatcatattcctcatcacactgtattgtcattgccagcttatgactttggtcgtgagtgataacaggtaaggaaccatgcctgtgttactcaccgctcagtcctcagcccaggcaccctgcctaacacacagccgatcatcaacaatgtacttattgagtgaatgagtgaccagtgctaatgagttactgaatattgagagaattggttggtacttcataaacaattcttgaacccttcttaaatagcagtcattgtattagatattggggctataagacatggtctagttggggagatatatggttctaataataatttacatttagtagctatgtttttgctgtgtatctctcatgcttttcatgcattgtgatggggatggtgacatgcctctcagcgagagtagcagattgttttatttcagaactatgatcataccatttgtactatttggtcatttttctccattcaataatataaagtaggcagtcgtgtatgtgtgtgtgtgtgtgtgtgtgtgtatgcgtgtgtaatccacataaggctttttgatgactgcatattatttctcatcattgctgtcttctaattcatttgaccagtcctgtaattgatgggcatccaggttgcctctaggttttcacttcttataagcattgcataaatgatatttcttcatgtggacccattgcatgtggcattgaattatagaaatgatactgttgaattgaagataggcccaattaaaattttgacacagaccattaactgtcacacagatttatattgccaccaggagcatttgaaagtgttctattcaattccacacaccagggatactatcatccttactcaatatctgccaatcctttgggcaacatagaatattctactgttgttttcatttgcatttctcttaagaccttatctggagaattatgttttttcaacataaataaataagaattgtccaaggtaagagttgtgtaggctctgtaaaaactccccaagtttcagtaatttacagatttgaatggataaacatccttattgttcttaaatactaaagtaagagcagatgtaagaagagcttacactttttattatatctgacattcaatgggaaaccactggaaaggttggagattggggtgaccagtgtttctgagatgaactgaaaacacttagcctcttttcttcttatgtccattcttctgtgtattgataaagcctccatttttctgacattggaatgggaagagatgtttcagtctcagtctaggttcaatattaccaaagtgcataacattatattcaatttttgcctggcactttctaagagatctctgatttgtagttgtagtgatgactttcataatctatttttggaaccattgtttgtattttttaaatgattagatcacctttaaaaaatatgctatcattccaatcaggttgataccatttgtttttaattgttcactaaagtatagcatatatcatagaaggaatgtttgtgctccccagaattcatattttgaaacctagcttccaatgtgatggtgtctggaggtagggctttcatgaggtggtaaaatcattaggactttactctcaggatattatgagattagtgtctttataaaagagaccccagtgaactcgctcgtccttttctactacatgaggacacaatgaaaagacagccattgcctgtaatcccagcactttgggaggctgaggcggggtggatcacaaggtcaggagatcgagaccatcctggctagatggtctagccaggtgaaaccccgtctctactaaaaatacaaaaaaattagctgggcatggtagtgggcgcctgtagtcccagcgactcgggaggctgaagcaggagaatggcatgaactcgggaggcggagcttgcagtgagcaaacgtcacgccactgcactccagcttgggggacagagtgagactccatctcaaaaaaaaaaaaaaaaaaaaaaaaaaaaaaaagaagacagccgttgatgaacctgaaaagaagccctcacagacaccaaacttgctggtgccttgatcttgtacttccacctccagagctataagaaataaatttctgctgttaaaaagccacccagtcaatcatatcctgttacagcatcccgaagagaccaagaaacatacctgtagaaaggagtagtcataacaaatctatagattgattagttttcacaaaccaaacacatacacataacaacactcagagaaacagagttatgactggccaccggaagccccatgccctctcagtcatattccacaagggaaatcactatcatgacttctaataaaatgcattagtttgtctctttttttttttttttttttttttgagatagagtcttactctgttgcccaggctggagtgtattggtgcaatctcagctcactacaacctctgcctcccaatataacctttgtatttttaagagagatggcattttgccagttggctaggctggtctcgaactcctggccttaagagattcacctgcctctgcctcccaaactgctgggattacaagcatgagccgctacgtccggcctgttctttatgtaaatggaatcatagagagtgtactcttgtgtgtctgtatgggactctctctttttgaatactgtaatagatcaacagctaacatttaacagagatgcaccaggtacttttctaagcactttatatatgttatattaaacataggtgtcttaactatggattatatgggaatgttttaactttttcttgaagtaactttatggtttgtatacggatgccaaatatagatacatatctaatttatctattttatttttttagaaataatttcttagaattaggaacctcttcagagccataattgcaaaaagagctccccgtcagctctctttgcagtcgaggtttgtaattattcttaaaaagaaaacatattaagatgttcttaggactctgagtagttatgccctcagataaatgatattaaactaagcacttaaaattaaagctataaagcattggtgatgcccagatatatcagtactccagttcaccctaggtgagaagggcagtggggattaatagccccctctgtccatttcctttttaggaaatgatgacctatcagagaggacataaatcactcctcttcccaaattagattaaaatcctgagctttaaaacttgcttttacctgcagactctaatgttcgacttgtggctttgtcatttccccacaggggcagcttccgctggttttacaggacagaaaagttctgtttctattactgaagaggttgaaccctctgctgaagctaattccaaacaaagtaggcaccatatcttctttcaaaagatcccttagggaataattgcaaagagatgctgtgattaggtaattacatgtgtgactctgcccaagaaacctgctttctacctaatttatactttgatttccctctctcgtgtcaaaaagcatatctagccttatttatctgactaccctgcacagaattttctcatcatgtaattgaaggtcactagaaaataatacttttttgaaagcgtgtctgataacaaacaaacaaaaaatggttagaatcactgctaaatatgaataattctattttccaatgctaaaaatgcacatctgttccagaaagacttggactcacatcctacttttcaaaatgcttcagccattcaacccttgatgctatgggcataaatgaagtttagaagttctataagcagtggggaagctagaattggaccttgaggtcccccccttttttttttttttgatgtttgttaggaattaagatggccttaggtattagtctgttttcatgctgctgataaagacatacctgagactgggtaatttataaagaaaaagaagtttaatggactcacagttccatgtggctggggaggcctcacaatcatggcagaaggcaaaggcatgacttacatggcagcagacaagagagaaaatgagagccaaatgaaaggaggaaccccttatagaaacatcagatctcatgagacttatttactaccaagagaacagtatggaggaaaccatccccatgattcattatttcccacatggtcccacctacaacatgtgggaattatgggagctacaattcaagatgagatttgggtgaggacacagccaaaccatatcaccttacaagttccatgtctagtacagagcttgaccctaagtggatgttcagaaagcatcttcagaatgaaaaggggggcacagttaagacctctggtaaattgtacgatagcttgtggggggaaaatcactgtagttagtgggaagaatgtggcttctttgcttaggacagttgtggatttactggctgaaggaatcactcacagaagtcattctacattagtggtcaaaagcatatgcttttgagtcatatagatgtaggcaaatcattttaaagattgttgctatatttttagtataagtgtgtcctgcccaacattgacacacacttattctaaaaaattgtttatctgagattcaaatgtagctgggcaccttattattgtatttgtttgtttgctttgaaatcctaactcagtcccactagtcccatttttgtaatgtttagctttcaggcaacaaccgctgaagaggtaaagagattatttttgaagagtcatgtgattttggctgctcctagctgacctactagagaaaaatcttaacattttccacaaacttttccattaaaatagaggataggtcattgctaaagaactggcagagcttcccaagacaaaacttgtggatagagtggaaactatgatctagcccgtccagtgaggtagactcaagatcaggtacataaactttactgaaaaaatgtgttttttctcatgggacgtatttacttgaggaagtatttaatcccttagcatagacctttaggttttcaatgaaaatatgatgagttgaaacatttgatatgctgatggcattctgactgatacttttcataacaaattcagaagtgaaaaataatttggtatgctgaaatggtggcctaaagtgtgaacgattaacttaataggaacaaatgtaagattccgtacttgattctaaacaatgaactttactagtagagaagttgactagtagagaatgaagtttactagtagagaaattgggaagccatgatttagtagaggcataaatgaaagcaagggttagcattttaatttaattttaatatcagtatattgacttaccaatttcatatttttttatatttttatgacatatctttgagaaaggggtttgcatgaatctttaggaaggctgaatcaaatgattcagggttgggggagtgatattggcagttacatgttgtattagtccattctcatgcagccatgaagacatacttcagactgggtcatttataaagaaaagaggttttaattgattcatggttttgcatggctggtgaggcctcaggaaagttacagtatggccgaaggggaagcaaatatgtccttcacatggcagcaggagagagaagtgcagagcaaaggggagaaaagccccctataaaactatcagattttgggagaactcattcactatcatgagaacagcatggggagactgccctcatgatccaatcaccactcatgaggtccctcccccaacacgtggggattacaattcagattaccattcaagatgagatttgggtggggacacagaaccagaccatagcattctgccacttgcccctctcaaatctcatgtttctcacatttcaaaacaaaattatgccttcccaacagtttcccaaagtcgtaactcattttggcattaacccaaaagtccaagtccatagtctgatttgagacaaggcaagtcccttccacctatgagcctgtaaaatcaaaagcaagttaggtacttcctagatacaatggagatacaggcattgggtaaatatgctcattccaaatgggaaaaactggccaaaacataggggctacaggatccgggcaagtctgaaatccaacaaggcagtaattaactcttaaagctccaaaataatctcctttgactctgtgtctcacatccaggtcacattgatgcaggaagtgtgttcccatggccttgggcagctttgtccctgtggctttgcagggtacagccctcctcctggctgctttcatgggctggcagcgtctatgacttttccaggtgctctgtgcaagctgtccatggatctaccatcctggggtctggaggacagtggcccttttctcacagctcaactaggcagtgccccagtggggactatgtgtggtggctctgatcccacattccccttctgcacttccctagcagaggttctgcatgagggctctgcccctgcagcagacttctgcctggacatccaggcatttccatacatcttctgaagtctaggcagatgttcccaaactccaattcttgatttctgtgcatctgcaggctcaacaccacatggaagctgccaaggctcgaggcttgcaccctctgaagccacagtctgagctgtaccttggccccttttatccatggctggagaagctgggacacagagcactaagtccttaggctgcacacagctggggggccctggctccagcccacaaaaccattttttccatctaggcctcagggcctgtgatggcaggggctaccatgaagatctgtgacatgccctgcaatttccccattgtcttggtgattaacatttagctccttgttacttatgcaaatttctgcagcaggcttgaatttctccccagaacatgggtttttcttttctattgcattgtcaggttgcaaattttccaaacttatatgctctgcttcctcttgcaagctttgctgcttagaaatttcttccaccagataccctacatcatctctctcaggtttaagttccacagatctctagggcaagggcaagggcaaaatgccatcagtctctttgctaaagcatagcaagagtgacctttgcttcagttctcaacaagttcctcatctctgtctgagatcacctcagcctggacttcattgtccatatcaccatcagcattttggtcaaagccattcaacaagtatctagtaagttccaaactttaccacattttcctgtgttcttctgagtcctccaaactgttccaacctctgcctgttacacagttccaaagtcacttccacatttttgggtatccttacggcagcaccccgctccctcggtaccaatttgctttattagtctattctcacactgctacaaagacatacctgagactgggtgatttataaagtaaagtggtttaattgactcacagttttgcagggttggggaggcctcatgaacttacaatgatggtggatggggaagcaaatacgttcatcttcacatggcagcaagatggagaagtgcagagtgaagggagagacagctccttataaagccattagatcccatgagaactcactcactatcatgagaacagcatgaggggaaggctcccatgacctaatcacctcccatgaggtccctcccccaacacgtggggattatgatttggattacaattcaagatgagatttgggtggggacataaagccagaccgtatgacatggtgaaatagttacaactgttttcatgaagcttttttggtctcaagatctgtgtgctatttgaataaatgagatgcagctggtttccaacgtgttttcctagcattggggtttaaagaaaaaagtaaaaaggacctaccttggaaatcatttcagaaaactgattcttaagcagtgattctcgaacttgagtgtatatcagaatcacgtatagcaggggtccccaacctctgggctatggaccacagcaggagagtcagcaataaccccctgagctccacctcctgtcagattggtagtgtcattagagtctcatagaaagtggctatgttgcctggggtatataccctggggtttcttgttgtgtaccaggaaaatttaggtcatggacacacacgaggagtttaggagtggaggtttaacacgtagaagagaagagaaagagaaacagcttcctctatagaggaagtggtcttggagcagaaaaagaccagcgggtggcagctgtgctgaattttatagtcaggtttaaagaggcagtgtctgatttgcatagtgctcacccattggttctgtcaggtatgatgtttacacagggcatgggcaaggctggtcaccccaccctaatcttatgcaaatgggctttccagttgattggcaccatcttgtctgcttcttactgtacatgtggctggcagagaaaggaagacggagctgccatcttgaacatgtctagtccttagttcctgccagcattcacctgtgcaagtctccagcttgcttgtctatgtctgcagctcaactttacattttctttgttagaaaattatttggggttgctttttattaaaaagaaaagccttaccaaggattcccatgcccttaccatctgcctgtgtaatttcttcttaactcctgtatcatcaggaacgtgaaccctattgtgaattgtacatgccagggatctagattgtgtgctccttatgagaatgtaatgcctgatgatctgaggtagaacagtttcaacccgaatccaccccacccaccaactttccccatcccatgaaaaaattagcttccacaaaactggtccttggtgctgaaaaggttggaagactgctgatctatagggtttattaaaacagtaggccccccaccttcagcatttttaactcagaagttcagggatgaggactgagaatttgcatttctaactagtcccccgagtggtgatgctactttagatcgtaacgttcatattgaaacatttgtcctacctacggatgccaatgaccaaggcatatgttggacgagcactgtgagaataggtagaatcaactctacttgagtgcattgcccacacaactgcttagtcttgtgtgcgtttagggaaagaacaggtggggagtgggggaggtacacttcgcccaaccatttgcttgtagatcttcatggactcctcccagagttcacctttgaagactaaggtatggtagtgccaagagtggagatactcctttatcagggcctctggggtcatggtcctgggctgtgacctcagcacgacatcagcacaaccaaaacaaaccacaggctggtgtttaggttcttgtcaagacctcatgcatcattaaacagagggcaactgcagagctctccattctgttttaagaaaatagaaatagtaactagcattaaactaaacccacaaacgcctgttccctcttgatagggtggtcacgctactgctgcattgttttgctttttcttttttttctgatgcagctatagtacaagccgtgactcatgctaggtgctagcctcacagatatacataaacattcacaatcaggtttccaaagctgtttccttacttccctttgttgctattttacttttcattggaggttgggcgaggcaatctttaaatgaagctattttttctttgtctctctgtccctctgtgtctctctctgtgtctcacacacatacacatgcacacacacacacacacagacacacacacacacacacacacagtctagctgaatcacgaattccgtgagaacagagtcagcatttgtatattttctcagagatctattcctaaccttaatgccatacctagcacatagcagacacacaaaatttgtgactgactgaatgaataaacatgtatattattgcaagccagttgcaaacagatatattgttgcaaacagaaggttacctgttgatccttcctatgttatctctgaactgcaggaacttcattttttctatgaaccaaatgtaggtcatcatgaatcaagcgtccataatatctgtttgtccacatataacctattttatagcagagcttatattctgatgatttgtagatttaatgttgtttattcatcatatctatcacatttgttttttaaatatttctaaacagctgattaaagtacaattggatggaggtaaaaatatttttaaagacgtataatataaaaggacagtaattggatatagttattcaaatgtaacacttaatttactttgagtttttacttaaccctgtaacaatggaattgtgttagcttacataattttcattgtttaattgaaagaagaagaaaaagaaaaagcagctgcaacagcggtagcaacaacacgccaaaaaacggaaagataatactttttccacttggcatttatttctgggaagaatgtatcttaagagcctttactgaaaagggcattgagttacacaggcaatagctttttcaacagctatttttccagaggtgtaaaaacagcctttgcctggttacattgtatatcttacctcagtaaagtcatgaaaaggaatcgtgataaggtgaatgcactcctacagagcgctaagcttcctggcgatttgacttgattcgggaatagaactcagtaaactgagcagattaaatgatcaatgtttcttttagattagccctctcaaatatcaatggtctctgccagccttagatgagataatgaggtaatttcaatactgagcttttgacagagtgtctgaagtgtaaagagtctgtggtattagaaacatgtctcagcatggcactgcccagcatcagcaggggccttctgagaggccaccgttgtccagagtctaagacactggtccagtggggacacatgagatgacatgggtttgtgtgtgtcttaattgcagtcctcgagaagagacaaggatgtgagtgtgtatagtttatttaaaaggtgcaggaagcatcagtactgcacacaagacaaggaaaaagaaaggagagtcaacgtagggtgcagtattaagctatggtaggcaactaaagtttaatcctgtaagaaaactctggaagtaatgtagaagacacacttcagagttatccatcctgaggagggagggagttcccttcagctggaggtacttatttcagtgctcttggttgaggactactcccagaaaaagggtgttgatttgggaacacttccaaccagaggggcatcacacctgccacatacacaggaagattcatcttctgtggttctgggaaaagccttcaggcacagaactgcacatcctgcaatgggaggttgtctggagcacagtgaagtggggtgcagtctgaggaatttggcaagacactgacagcatctcctctggtgtggaaaatggcattagaaagcagtggtcacaaggctgggtgcagtggctcacgcctgcaatcccagacatttcagaggctgaggcagatggatcacctgagctcaggggtttgagatcagcctgggcaacatggtgaaaccctgttctactagaaatacaaaaattagccaggtgtgctggtgtgcacctgtagttccagctactcaataggctgagacagaaggaatgcttgagccagggagacggaggttgcagtgagctgagatggcaccattgcactccagcctgggtgacagagtaagaccttagctcaaaaaaaattaaataaaagggagcaagggagagggagggagagggagagagggagggagggagggagggaaggagggaggcctgttgacagaacaatgaataattacgcacatacctaaagcgaatactcaggtgagatccccaagtacactctttcaagtatgggttagatattctaactgaagcaaatgtaaaaattgaatgttaacagtgggtctcttctattagtgtggttgtttgctgtcttctccagaatggatgtttttaagaagtcctttctcctcaccggttcccactagctgcaaaggttacccttacatccttgaatctctggattttttaaacccatttctctaatgctgcttataatattgttgataatatttgtcaccccttggcttgttcaaatatatttcattccactataggtatattcgcacgttttcacgctgctgataaagacatgccctcgactgggtaataaggaaaaagaggtttgatggactcacagccctcacaatcatggtggaaggtgaagaggagcaaaatcgtgtctcatgtggcagcagacaggagagaatgagaaccaaatgaaaggggtttccccttataaaaccatcagatttcatgagacttattcactaccatgagaacagtatgggggaaagtgcccccatgattcaattatttcccaccaggtccctcccacaacgtgtgggaattattaattcaagatgagatttgggttggggacgcagccaaaccatatcagtaggtcaaatgcaaagcctgaaatatggagaggaagacatcagtataaatcctggttccgtcacttgaatacgttgccttgagcaaattattcccttgcagaatctcagtttttccacctgtaaaatggagacggcaaaaattaacagtcacctcggggagtaattatgacaccagaatgagctaataaacatcactgttttgctcggtggtgaggttgagtccaaaccttagcagttatgattgtggttgttgctgttgtccttactaattactccatagattgatttgagttttgcaatcagtttgatgccttgttccatagtttcttttttacttccagatttggttcaggtaaagttggcaaagcaaggagagctggattcttcttacctgcttcaccttagctggttcctgcttcatacatctttcaagatgtttgtagaaaactaatcagcgtctacgtttgttttctaattttcttttgctcacacatactgtggccacttgattaccaatcagtgctgtgttggcaggcacatacaggccctattcctactaatcagagatgtgggaagcaaatgctggtgtttaaagggaacccttatttgagctcttgtcccatgactcctaattgttgtatttctcaaactcaacccagctgcaagctttattagggaaacatttattcagataaaagcctcagttatgaaagaggggtaattattttgcaaatgtgtttgaatcactgtatgctgtagtgcaactcatccccaaatggagaaggtgcacatttgggctgaaatgttgctttgtagatggacaatacaacaagcatatgacggggaacttctggcaaacgataggaaaatggtcaaatgaaaagacaccagtaaaatgagagattggatgaaaagtgatcaggaagctctgaaagctgaccagagtgaacaaaatgcctaaattccgttcatccacattcatttatttattcattcattaaccattgaatattttggggctcctatacatagtttgctctcaaagaattttaggttttagttgggagagagcaatgaaaatatgttaactgcatgccaactgggatctcccattcagtgaaatctagatagcgttggaccaaaaccctgttctgtgccttgagaatgctcagtgatatccatgacatttctggaatttcacgggggtgggtgctcacctaccaaaggtcccctcctagctctaagatcagcttctgcttatttcgttgttttgcttcatcatctttacattgcacaatccacgtgtagaaaatagcccttccctttcctttgtgcgccaaaatttacataaagcattgtgtggatagcacactttattgaaattctagaaagttgtatttggagattgtatcaactcccagtggaatattaaacacggctattcttaaatgtcctccaggcaccaggcacattttcttttgttgcttgtaccgagctctctatctctaaccacctccgagttttctttttccatccctgttcccatctctccttctcttaatgttctgcccagtatatgggggctatcacatggcatgattattctatattcttgctccctcattgagttccagtctcaagcacttatattcatacccaggaagttgttctccagaatataacagttctcttccatttaaaagaaacttccctcagtggtaattcaaggagttcttcatatatcctgaatataagtctgtcagatgcatgaattacaagtctcttccctttgtgtcttgtctttcactttcttaatggtgtcgtttgataaacagatgttctgtattttaatgaaggctaattatttatttttcctatcaggcttattgcttcttgtgtcctgtttaagaaatatttgcataccccaaggtcacagacattctccactaggttttctaaaagcttgcttttcgtaggtttcatgattaattttcatcttaagttaattttgtgtatggtgtgaggtagaggtcaagatgtatgatttttccagttgctgccgcaaaatgtattgagaagatcaccctttccgtcactgaattgcagccataaatcaaataaccaatatgtgtgatctatttccgcactgtctttccctggtctttatatttaaccttgtgccaatatgagggtggtaaattttaatcatcttcctttttatgtaggcatttaaaactatcctgttataagtgctctggtaatagaaatacagactataacacacgccagaggatttgacctaagggaagagggtcagagttggctttctgagcggatgtgccatttaggtggagaagtactttgtgcgtctgcattctagggcatgccctgcttggcagttttctcattttatgatgggtcctgtgatgtggccaatgtgaaccatgctgtatgtgcactggcctggaatagataacaacaataaaagaaggaagatgcccaagaagaagtcaaataacctcattgtaaagatgtgaaattgaggtttaaagagaacatgtgatatgcccaaggtcacagagttgatgagttacaatgctgggattggaactcaggtttcccaatagatccaccctcttcccatgaccctgcattgcctgtaggtacaaatgctcaaagttgctgagctataatgtggtgatgcttggactcgtactcagttctgtttaacttcagagtctgtgctctaccccgtatccttgattacctccttggaaaagctgaatttatttgtatgcctaactaagaatgagctaattgattcccattttaatatgacagctctgccttagcactatcaatatgtgtccaaaaaatcttatggtgcatgactaattgcactttggaatcgtatacatttaattatatatttgatttgagagtttagcatttacaattattgtcatctcccacttactgagcttccattcttccattctgattgtctctgttacagactttttttctcatgcatagagaagaaataaaggcacaatttcctttttccatatttatgtgttatatattcctttagcatcatgagccacatatgatagtattgctagatcagttctcataatgtaccctttgcaggatagactgtgaaaatctaattttggcaaaatgactgaaatcccagtgaatgattttttcttttcttatataaacctaagcatccaatagtgaaagtttatatgactcaaatggaagaagaattcatgacaaaaggtgtgattattcgcataagaccctgaaattcctttctgggtgaaataggccctttcttccttccataagaggctctgactgatgagttggcttttattaggcaatgtatgtctgatgcaatatctgtggataaaaccaccagcccctatcaagtcaatcaaatatttactgagcacttattatgtccaagacactttggagaacaaagaaatataacctggccttgcccttcaggctgtatcaattgagatagaatttggactgctgcaatcaattacacagatgtctctcaaggtagtgtcttgatgcttgagggaaacaagacaaaatgctattaataatgacttagttttctttgtcaagcaatcggcttgccacatcattgaggtaacttcacattttcttgcatcttttacaattagcagcttcagctgactctgcaacctgttgagaaagagggcccaggcaatgttgtccttggcatcttattcaggtctggcttccactgcagtgaatgcactcagatagccctttatcagctgagtccccttgagattaagtatttaatgtctcttgatctccagccttaggaaataacccaattcattactcagccattatgtaattcattactgtcattagagatcaggagaatcgtcttaggagaactgagaatacaaggcaaaccacacctttctttgtccagcatgattaacggactgtggaagggccctaatttggagttccattcatgggatttggttttatgacatcctccagtcccaggcttctggtatgacttgcagaggcattggttaacctggtggaaaatggattactactcaacgtgtttaccgatactgtgtgtctgtagtgggctttggtggactcctttatgggattgttgatctctcaacagaacagagaagttggtcaggaaggttattaagggagaatgcataagggagctgctttttctagactggagtgagggtcatggattgcttcccagggaacatttggcaatgtctggagataattttttgttgtgacagtgtggaccaggagtgggaggagaacatgactagcatctagtgggtgaaggccaggggtggtgttaacatcctacaatatacaggactgcctatcatagcagaattatctggcccaaaatttcagcagtaccactgttgagaaaccctgggtacctgcccattactgctcccttctaaaacaacacatatttcttcataggcccttgtgaatttatttgttttatttgatgagagagagaaagagagagagagagacagacagagactgatacatttgtacctatctatctatttacaacttctccattccctacttcatttcacaaggtattaggtaaagcaggtatataaataacactcaataaagtagttaagagaaattttaaaaaaatacacagggggaaatacaaattaaagtaggcagtagcaactgtagaaaatatattatactggtaatctgacagtctgacttataattgctgtcattttctttgagcttcctgagagccaaaacaaaaatagaaacagtcattatactttttgttatccatgaggagaaaacagtgtagagaaagcttttaataacacaaagacatttctcaagtagaacttaatgtaaataagtgttggcaaaggacaagatagtaaatattttcaactttgtgggccatgaagtttctgtggcagtcactcaactgtgcccgtgtagtccccaaagtgtccacagacaatatggaaacaaatgggtgtgactgtgttctaataaaacttaatacaaaaaaacaaagggtcagatttggctcttggaccatagttggtcaagcctcagtgtaggtcttcagaaacactcctggatcaagtacgaaatggatattaagatgatgtttcctaggccactgactgaaaccgagagctttcccttacagggtgctaaacgactttctgcaccatcggtagtttctacgaggatggaagaacaataacaataataacaaaatatcttcttagggcatttactgtggtgcatatcaaggattttgtgttttttttcttcgcggttgtttagttttgctttgggtgacaccccttctcatttgctgtgaagataccgcaggatgataaactccctcttctatactaagtcccatctgcaaggaaaggaaacttcactctgctccttccatcttgctgaatatttaaagggtattgacacaaggcgttttgataggccaaaagtattattatcctaaaaaatatttcctgtgatttaggcacatggagaggcaccgtgttagagagtcaagataaaatacctacctaaagactcttcctctgagtcatttcctagggacactctcagttcctttggtggccacagtttggctgtcatttcctctgtgaattcttctacgactctttggaggaaggatgtggtcttcacctttgtccttccgtatgttttgtaattctgaattttatagcacttctcctggcgtcttataactttatatttctctttcccctgatcaactgagcttcttgaggggacagtataagtctttctgatcttttgccctcccctgtgtcttttgcaacatgtagaacatactagatttccataactatttgttgattaaattaatgactagatggatggatggatggatggatacatggatgaatggagggagggagggaggaagagagggatggataaatggatgtgggagggaagggtggaaggatggaataatggaaagaagaacatcagcagcttctcaaaaatgtaagttctaacataagtagtaatattacttatgaaatattttattgatagtcaagcaccctgattaaacttgtcctatttcatcatataaaattaagcttaatcttcatttaggccaggtgtggtggctgatgcctgtaatcccagcactttgtgaggccaaggcaggcagatcacttgaggccagggagttcaagaccagcctggccaagatggcaaaacctcatctctactaaaagtacaaaaattagcctggcgtggtggcctgtgcctgtaatcccagctgcttaggaggctgaggcgtgaaaattgcttgaaaccaggaggtggaggttgcagtgagccaagatcacaccactgcactccagcgtgggtgacagaatgaaactctgtctcaaaaaaaagaaagaaaaaacatactcattcagtaacaaaacaaaatctcaaggcaacatatctgatttatggttcactaacataaatacatatgcctagaaattcactgaacgtcaaaatgatttatacatacaatcactagagtgaagttgaaagtgttttaagcagaatctgcatttaaaatgcatatatatttattagaaaggatgccataacagattggatacatacaatcaaattgttgctaataacactaggccaaagtctttataagtgcgcacgcctgtgtgtgtgtgtgtgtgtgtgtgtgtgtgtgtgtgtgtgtgtgatgttgtaagaaagtttaaggctatctcccttccttattcctctctctgattactgtcaatgctagctagttgatgtcagtaatgacaagtttgtattttaatttttaagcttgagtgatccatcacacctcaaccagagtaggtggttattcctactacctgcttggatgtcaaatgcatcagttggcaatttgtatttcttcagctttctctccctcctattttctgtgtttattctgtctatctacttatttcttacacaagagtgaccaagagtgtgtacccaggaggtgacggtcaagagtataacgtttcagaattaaaaaatattatagttgcaaactggatattttggataatactggaaaaacggaaatattagatcatgaaatcagatattatccatacttctgtgttaactacgataattatcttaatttgatgtttcggtttttccatttgcttattgtatgtaattttgacacatctgccttaattaataagaatggtacaaaattaagtaaattttacaaaaagacattttaaaagaactctttattcaaggaggaaacttaacaaatttaattttctttgatataaaatatcaaaagccataactagatattttattcaaatattaagcttgcaagtttgggagtaggggtgggaatcccactacagtcaaattattttgatgttactttccaggcttagagtttatcttccatatttccaatgagaatcagttcctcaagtggaattttatgataaactgctgaaagtagtatttaaaatggaaaccctgacaagaatgagtgtcacagggagtaatgaattcatgatggaactagttgggagtgtgtgacattttaagtgcctcatcactctgaattcactgggcatttattgtaatagaaaggaccatattgaattcatttggcattcatgtggacttcacatgtatttatggagatgtaacatggtaatttaatatttattctactaagcattctttaatggacattgaaagatattgtcatacaatgcttagtaaagccggtaactctaacgttattcttctatcaaaacaaagaaatgaaacaccattttgattcccaaagcacccgagtaagttatttggataagccaacattatgtatttactcccccaaatctgctttctaaatttttaagccacaaggttgactctaggaccaagacaataaagcagaagttcagtttaggattctttatattctaaaattgtctgcaaatacattaatctcagtctaaaaatattaggggaagattttcttggaacatcagcagtaaatttaacacatggcatgccttcaatagatttctcttcttccccctttagagttcagtttgctgtcttcatcacagtcccaaaaaatacatttgtgtttcttccttgaagaagaattatttttagaacaaacacatcattatttgggaacaatcaaaagatcaaaggcataagaatctttgctggaaagtgaaggaagagttcttcaaccaaccaaaatgacaatcttttatttttattctaagaacagagttgttccaggacacagcctaatgcaaactctgctactagtcactttcaaaatgttgtctagaatgccttgtttttaaattttctctcagttgccttctttacaccactcaaaagcagaacctttattacaaacacaccaaaaggtaccatataactaatcttcctggtttgaatgtaaccaatgttcaaatatgattgtagagtattaattattttgacatcaatttactgaacacattttaatgaggaccagaaggaaagacaaagtttacttactttcgtgatatatatctggtccagaccttgtaagtaatagcactttcaaacttactatagaaaattcagtgactgtaaacatctttcaactctacattgtgagagagttttcaaatctttggcaaattaccctgtgtaaacctccttatgacccaaagagatattttgaatgaggggatgtattagtttcttagggctgacatgaaaaagtactgggtgacttaaaacagaaactacttgtctcatagctctggaagctagaagtctgaaatcaaagtgctgtcaagggccacactactttcagagtgtctaggggaggattcggcctcaccttttttaggttctggcagccccaggtgttccttggcttgtagctgaatcactgcaatctctgctttgttcctcacacagtgttctccctgcgtctctgtcttcacatggcattttcttatatggaccccacgcatactggaataggtccactctaacggcttcctcttaactcgatgacatgtgcacagattctattcccaaataaggtcacttttgcagattccaggggttaggagttggacgtttcttttagggggacacaattcaacccctaaatggggatctcctgacagttcttaatagggtcaatatttcaatgcgtgcatttgttttttataatgatcttttctatgatactgggtgagataaaaaccaacttatttgcctttaagagcttctttgttttctgccatttgtgctagcaacagtcagagaaaactttttttttatagcaaattgtttttctcaacacattctgtctggaaaagaatgttctctagttaccacctctttggtctaagggcatctccttggtttctgtgttacagcctctttgtgttaattataagttgctttgctttacagactcaaaatgaatgttacagtgactgataaaagccaggatcctgagttcaagatcctgaccaattgggtgcttcatttgaaatcagaatctgtgttcactgtggtttacttggggtatgtgttagatttctcttggttgcaagcaaaaggaattcacaatggttagtatcaagcaggtaagaaaagggaagaaagaagattgttgaggtgtgtcttagttcactagggctcctataacaaagtgccacaaactgggtggcttaaacaaaataaatttcctgtcaatctcttctagaggctggaagtctaaggtcaaggtgtaggtagggctggtttcttctgagggctgtgaggggaatctgttcatgcctctctcagcttctggaggtttgctagaaacctttggcattccttagcttatagccgcatcatcccaatctcaaccttccctttgcatgccagtctccctgtgtctatgtctgcctctgagtccaaatctcccattttttttggtaaggacgtggtatggtttggctgtgtccccacccaaatctcatcttgaattgtagctcccataattcccacgtgttatgggagggactgggtgggagataattgaatcatgggggtggtttctaccatactgttcttgtggtagtgagtaagtctcaggagatctgatggttttagaagtggtctccctattcgcttggttctcattctctttttcacttgctgctgatgtaagatgtgcctttcgcctttcaccatgattgtgaggcctctccagccacgtgtaactgtgagtccattaaacatctttttctttataaacatgtctttatcagcattgtgaaaatggactaatacaggataccagtgatactggattaaggtctacccatgactttattttaacttgattacctctgtaaagaccctatctccaaataaagtcactgagagttagaactcccacatcttttttttttttttttttggtggtggttggcgaggacagtgaaacccacagcagtgagagagttgtatgcacatggacacaaaagagcatctgatcataaagagaaggaaaccaaacctgtctgggcactgcaatgtgtgaatctagaactctccaactgctatgcttcagcttagatgttgcgcatcaccatatttctgtgtcctgaatttcacatcttcgagaagaattttattggtccagttgagcccagataccttcccttggctcaatcttcaatggccagggagtgagggcacaggtcacaatggccatgttttgagggatgtgcaagtttgtgtgtgtgcttgtgtacatgtgtgaggattttgtcctctacaaaagtcagtggaatcattgtgagactgtgagctggcaagaggatatctccttcccccacatccctcaccccatcccaatctctggagaggaaagactgcctgtgctctcaaagaagaagtggcttttcattgattcagaaagaaatgtcagttgatatctgcttcctataaggtgttctgtcctgagctggaggtatagatacaagaaatgggtcctgatattcagctattggcatgggtaagactgaagtaggaaaggacttttcatctcctcccaagccgaggacacagctcaccatgaggtcgttgggtacgctggcttcatctaaaagaaccacatttaggttcttatgcgagaccacggcatgagctcagtccatggcaatgagtcctattttgttgagatgcccaagcaggagtttccttactgccagcatctacagggctgccatgtgctccccacaactctcccaggcttggctcaagtgcagggaggcccaggtaactccaaagagagggtccattcatcatggacccaggctttctctgatgtccataactgtctccccctggggattttgatgaatattcaaggacataaattcacacacgggctcagctgttgtacacccatgggaatcaggaggctcagtatatcttcctaagtgttccatttctttcccaggagccacagaagtgcaacaaagagatgagccccataaaccactgcatgtgtgtgtttgtcatttttctttagtgcaaggtttacaagactccctcccaacagggtcgtcatctcaacacatgtcacttggctatacgcttcactggaacattgtgttgtgctggggctgaattaaatgtgcaattactgcacattttctcgaaaggagttttgacaatgataaatgcatagacatttttccacactcagacaacgtgactccttgctcatcaagtggctcaggattcactttgaagaactggtctcttgttaacaggagaacgtgggtgctgcccgagaagcgcatgggcctgagttcaagtgccacttctacctgtcatgtaccatctgagcgtgggcagctttcttactcctgctagcccgagttttcaatgagcaatcattgcacctctgataaacctcattggctatggtatttctatatgcaaagctgagacaacacttggaaagtaattaccatagtccctggttaatagtaagctttcaatgagtgttggctagcattcatgcccgtaagttatcctcttgcctagagcagtgatggctctaatgtgagttcagatccctacaataggagaaacagtgcttgttgcttttcaaaaagcagagaataaccataacttttctacagatccttgaatataataacagtagctaatatctgtttacttattacctgctaggcaatgtgatcaattttctgtggatcagatgattcaattctcatacaaaccctgtgaactttttggtatttattttacatattaggaatcctggtgggccaactgcagcccactggcccctccaggtccactgtccaccattctctactctctggtgccacaagatgcttatctgtatgaagccttaggaaggaaaccagaagaactgacaccctgtcttgttctccctccacctctgattcctcactagtgcttctaatttactgaagccagctggaaaccagaagacaaggctgccaggtgctctgacaaaggacggagcagggtatagaagggagagtaaattcagaggactaagcaaatgtactcagcacatctgcttgtgaacatactgccagcaagtgccatttgttttaagcgatagagaattagatatcctctttgctgtactgttccaaactgcttatttctttctccttctttttcctcatagactatgatcttttgatattatagcaggaaacttggcgtgggctagcatcttggtgtaatccaacctctcttagatttgtggatatttcattgtgaaaaggtcaagataaaaaatacattactaaatatccatttatcctttattttctcatcatatacagaaaggttattgccaaatatggccataaaggttttattgctccaatttttatagcaaaaacagatacacttcttaatgaattttggtttattagatcaccagtgaccaacatggggtttctagctcttaggagaccctgatggtggcaatgaaggtctgcaagctattttaaatatttcagaaaatctaatataatcttacttttacaaatgataaagcttcacaaacaaaaacatcaagatgttttgcttttgactgaaatgatattagctctgcatggtgaacttagtaatttaattctgatcagcagctctggttggcagttatatgtgcctttgattaataaaacatgggtgagaaaataaattattacttaatctgtgcagtttgctagataaagtctttgaaaacctggagtcaattggatggaaaataatgaactgggtgctcagtggtgaaataataagcacaataccagcttggcatgtctcacatatgtaggaaagccaagacaggcttccagatgggccgagatctgataaacaattccagtcaattatttgtttttagtaataacaacgacaataataatgatgatagtaggtaacaattattaagtggccagacatagtgctgaaatgctctgcatgtaatattttatttcttccttccaatagacctaggaggaatgcactctgattatcccttatttcaggttggtctccttcagaagcagactcagacatttatgggctcagatagtttatttgggaggtaatgccaagaagcactgtagggaatgaagaaagtcagctggggaaggcaaggaaggcaacaccaggatgcactgaatggtagattgtctctgtgggcacctgggatgccaccccccttggcacgtctggggacagtgtagaacacacctttgagttgtaccacacaatcagtgaggaagctgggtattgctcttccgactcctgtttgtaattagttcagagctgctttcagggaagtcgacttcccggaacttccagttcaccctgtggaagggaaggggctgagcatgttctggtggctagagaaagccctcaggtacagagatacaggggtttccagaaagcctctggtgacgcacaaggatgtgagcacacaagaacagtacctgctgcacttccgtcctacaagagaggaagtcaagaattcatgagttgaaataacttatccagagtcacaaagcgcttgtgatggtgtgctcttccaaagaatttttttgctccctgtgtctgaaggctaccaatgtccaataatgtaccaaatgagcccttgttcttagagtttttttaaacaacagctttattgagatataattcacataccatactattcactcttttaaagtgtagcactccatggttttcagtctattcacagaattgtgcaaccgtcgccacaatgaactttagaatattttttaaatctcctggaaaaaaaaaaaaacactatcctgagtcatacctcattttccaccattatatcctcagctcctggcagccacaaaatctcattctgtctctgtttcattcccttttatggacattttatagaaactgaatataatatctgatcttttgtgcctgccttctttcacttaggatagtgttttaaatgttcatccctgttgtagcgtgtatcaatacttcagtctttgcattgccaaataatattccattgcctggatatatcacatttgtttatccacttattgctcaatgaacattttagttgtttccactttggggcgattttgaataacgttgctgtgaaaatatgcctataatctttggtgtggatatgcacctacctaggattagaattgctaggttatcggcaactctatttttaaccttttgaggaactgccagattctttttccaagcagtcttagagtttattgatgattttaatttgctgtttaattaagcaagatgcctgccttacactgtttggcaaaggagaaaaatcagcatcaggcacttgcagacatagatttccagaattcctaaaacattcaagaaggatgttatcggtacatgatcagagttgagtaggttctggattttaatgcctgtacttgctttttacttataaatgattaatactttagcttcataattatccatttagtttatgattatgggttgcctggttaaccctactgggtgtagtgatgcatgctttcatcagaaacatttttggcctgcagtttctaagtagccagattttaaagcatatacaggtggcagttcattaaacatgcattcgtttttgtttttatttggcacctactgtgaatcagtcactgtgttaggtgctgtgaatacagtggggggacaaaaacagatacaattgtgttagagaaaaataaactttgaaggaaactgcactagaagatacagcatttagtcattgctgggattctcttcattgcaagcagctactgcattccgattattcaccctgaatctaaggcaagctctgctctaaaatgtcacacaagaaagaagtggaaaacctcttctccaggaggggtttgcaatgtaaataaagagacaaagaatgccttaggtgtttcctctacctagcataatcaaatactactatgaaatatgcaagagtctgtgtcatcactgacattcagtcttggatttattttttttaactctgtgtactagacactgcctcttggatgtcccatagttcattgaactctccaagtgcaaagttaaactcaatctccccaccaacctctaacctcaacccagccccagacttttttttccagtgtatgctttctattttagcaaatcaagggtgctactcaccgtgctgttgccaaaaccacaaacatgggcatgattctcggtgtttctgtaggcttctctcacctaccctctagtcaggcaggtcttcatcatttaaccttctacttctctctgacagatttgcttctgtctatcctcatcttcatcctagatctaaaccaccattatctcttgcctgcaaccttttattcctaattctagtctttaatatctaatttctgctccaaatggcagctgaaggattattttcaagctcagatgtatcctgccacaccctttggaactcctcatggatcgttattacccccaggtttaagtccattttctttaacatatcagagccttgctccaaatggcagctgaaggattattttcaagctcaggtatatcctgccacaccctttggaactcctcttggatcatcattacccccgagtttaagtccattttctttaatacagcagcgcctgtccttcatgacccagcccctgatgccatctctggttttatctttacccactcccttagcagatgcttgtgttgagcagagccaaaccaaatctcttactatccctagaatgtgccaggttctttcacattggaaagtttgcataagatgagctttgaaaagtactttttcaataacttgtgtctcagtggatttctattaattaggatatgggtttggatgccatagcaaagattcaaatgtcagtggcttcaataagatagatgcatattactctctcaagtgatggttcaggcaggagcagttctagattgacatggtggccccactgtgtcacttagagacaaagtggagacaggggtggagagacataaatctatctgagagatgtgtaggaagctgaatctttaaaacctggcttccctcttattttatggcatttgtggaatgtatcctgtgtcctcatggccccagacaactcaccaccacatccacattctatcccagtcagtgggaaaggggaaaggggagccatatcccttctcttgaaatacacaagtggaaagttgcatctaccacctctcctcatatcttcttggcgagctgttgaccatatgactaaatctagctgcaaggaaaatcaagagctattggtctttctttgggggacaaatagaagtttctggtaattattttatgtaaaactaatccgaagaaataagtacattttccttccaaacatggcaatcctggcagggttgtgggcactggaatcacaccattttttgctaactaaacaaatttccaagtcaacaatgtcagatattggaagttcaagatagataaaggccactagtatgttggcaatagcatgccctctttacaaatgataaaatttagagaagtcaggtgcctcccaagtacccataacatgtacacgcccccctgctatcttctgaatccaccctctgtgctgaacaaacatgcagggcagtatactttagtgattaagaacaccagctttggactcagaaaggtctggatgcataatcacttattattgtgatatttacaaattccctaagttttctgagctttattttcccacaaggatgttatatgcattaaatgggataatatctagaaattacctaggaaatatctggccaatgattagcacttaagaaatgatctctagtataactataatgaatatctcttaaactttttctgctatgaccagttattgcttcttttggagacatgatagctggaaaatgtgcactcataattttgccagtgtttatttcttcataaggcaagacaaaaggagtcctgtggaagacgcctcttcactttcttcttaatgtacttggtctaaggtatccacacttgtctgagagatggcagaggtgggtgaggcaccacagctctgtctttctcttagtaaactcacagattcctaactaagtactcagagtctgctgtgtgccatacctaacctaaaatcccaattctacccattcctggctgtcagatcttggaaaagattcttgacctctcttagcaccaacctctgcttctaaaaatgagaataacttgaatacctacttaacaattgtcctcggaggaatagctgagacgcttcacctagaagtgcttaaaactgtgtctgatatatcgttcatgcttgataaatatgagctgacttaaattcccccatttaagcatgaatttcagcagaggcagtaggggtaaaaaggagaggatgcggtgaagaaaaatttagaaggcataatggaaaggacccagtgatggtccagtgtcagggagatggcccagatagaaatgtagcaaaattatcctgaaaaatttgattatttgatagaatggttcaccaagatggaaaacacagtcggggaggagagggcttgagaggaagacaatgagtaaaacgttaggcatggtcaatttgagtggtcaagggattcaccatggagatattaaacaggcattagatagccaggtctgaagctctgtagagaagtgtaagttcaaaacattcatttaggagtcacttgacccaggaggcaccagccgcaggtcacaggctccattgtcttcagggaccagtagcagtcatgtgaaaagcaggaaagagagacggttaacttggggtcaacaatgcgatgcacgccctgcccaaaggccttcaagtgcattcacctgggtgagtactcagcctgaggtctgaatggaaccttccacctgggaagatgttaaagtggttatgaacgaatgaaatctacccccaaggttttcctggtgcagaaagagaagactgaagatcaaatttacaacgtgcttagacttctacagtgttgctgaaatctacatcagacagtattttggcgaggagcaaggcttccccagcagtgttcatgatctgacagctgtaaccaatacctgacatttcccttttggatataaataattatctttcacagttatggcacatacacaacaagtaaatttccccttttatttggaaagcctctactttacaattcatgtttaccttcctgaatcttttctacatttcaaattcatgttttgtttaaaaagatgacagacacaggaaagcgttggttatggcaatataattaaaggacattcatttcactcaaacctgcatggtgatttttggcaggggagggggctggcaaatgatgttttgcctcctgtattagttttctatttcttctgtaaaaatttatgacaaaatttgtggcttaaagcaacccatggatgtctgaatggctttggttcctttctggaggcccaagggcagaatccactttcttccctctcccagtttctagaggctcacagccccttccttcattttcaaagccacaaaagttggatctctccagccattttctgagtagttacatctcctttgcactcttttcgacctccatctctaattttcaggacccttgtgattgcattgggttcacctgggtaagtgagaagactctttttaaggtcagctgattaacaacccaaattccacctgcataggttctgtttgccatataagtttataagttcctttatatctccgagtagtactgcgtggcatggatgtaccacacggttgttgttgtttttaaccctctacctgctgaaagacatctggtttgcttccagttttagcatttatgagtacggcagctatgcacaattgtgtacagatttttcttttaatggaggttttcattctctgagatgaattcgcccaaaagtgcaatgtctgggttatataattgcatgtgttgttttattttttaaaaaaacattgctaaactgttttccagagcggctataccattttacattctattgaagagttttgagcagtaaggtgatgcaatcctattcatgttttaaaaacattctctggatgatggatcaagaatgccagtagggagggcaaatgcagaagcagggagatcagaagggagcctctgcagtggttcaggtgagaggtgagagagagagtcaaagcatgggtgggtgtggctgagatgatgagaagcagtaggataagggacatatattgatgatataattgacagttgctgcagaattgtttgtggaaattgggagaaaagattcaaggaggatttctgtgctttgggcttgaggatggtggttcatgatggacctatttgtcttgataatgggaggacaggggtgggagctgacatgggaaagagatgagtgcctgttaaattctacagtggaaatcttgagtgggtggttagaaataagagtctggagccaaggggagatgtgggaagctggagagaaagtggaaaaggactatgtctataaatatgcccgatgcaaagcgtggcatagtcacaggcaaaagctatccacttgatctcaagaacaatcttttttcaccttctgggcttcacaaacaaaatagcaccttcagtttccatttcggtatagcaggtacggtaaccacaagaacgtgcaaagcagaaacaaagagcacttggcacccaagtcttatagaggctcatttctgatatcttctagggaacttctttgtataaggacgtcatagagaaggtttgtctttcatttgtctgtagcaaggtcgtaattttttttaatctttaaaaaaaattattgttaatacaaataagtctattgtgatttttaattctaggaagaatgccatacaaatcttttttagtacacgtttctgttttatactgtgatttggaggggtaaaaagggtaatacaaaatatggatagttttttcattgctggaatgttccacattgggttctgccttggcaacgtctcctgtgagctacagttgagggccaaagcagatgctccgtttttatgcatctgtcgatagccacatgactctgcaactgccactgcctccccacaccccctgagctggcgccagcacggagcagctgaatccgactcaggcttcatcccagctcacattccaccttcccgacaaggacactgaggcccagagatgaagtgggacttcccaccacaagtcaatgaggagatggggtagccaggcctaaaaccccggcctttggcttacagccgcccgtcattttcccaggtgcccacctcagaggccatccttggaaaaggaaacgtcactaacctatggttctggggaaatggagacgagagaggaagtaatatgttgttcttcttttctttaggcttctttccactgggtaaatcttctccatacataataaaatgaaggccccagatgatttgtgaaagagttgaaatgaacttcctgcaattgaacaaactattatgaagcccctactgtctttatcagcaattcacagtcttttgtccataagaataagcaggggacttaaaaaaaaaaaaaaaaaaaaaaaactactggtacttgggccttaccccagactaactaaattagaccctctagggtggactttgctctcagtatttttcaaagttacccatgctattccaacgtacagccaggaatgagaacaaactggtctatggtactgtgctaattgatcctgtctttggttctcaagttggggtgatttggcctctgcagaggataaaaggaaatgtctggagacttttggttgtcaccgttgggatgggggctgccgttggcttctagtgggtagaggtcagtgatgctttttaacctcctacaatgcactagacaacctccaccacaaagaattatctggccccaaacatcgatagtgccaaggtggagaaaccctaggcttatggatgccatgggaaacaccagttacctggatgtaaatccatggtaaaataacatagatgctatgacatgtggcccactggaagacacccatgtcaaatcccaggagccagtgaatgtgagcttatttggcaaaagagtctttgcagaggtaattaagttgggggtcttgagatcaaataatcctgaattatctgagcgtatcctaaattgaatttcaagtggccttgtaagagtcatagaggaaaacagatacacaggggagagggtgatataaccatagaggcagaaattacagcaatatggccccaagccaaggattcccagagccaccaggaggtggatgaagcaaggaaggatccttttttagagacttccaaaaaagcgtggccctgctgacaccttgatttaggtcttctggcctccagaggtatgagagaataaatccctattgtttttttgccacaaggtttgtagtaatttggtatggcagcaataggaaaccgatcagatgcctgtgcctttgtttgcaaaattcaacaaagcacattaggagagatggggtccatgagaagggataggatgcatgcaactcataaggctgaagacagacgggagtgggagtaggaaggtctagaagagaatctgacaaagatgcgggtgaaactctgaacccctggccagggcagggaagtcatgaaggccaagcaacacatccagtgatgattcttctgtcgacatttcatttctgaaaactggttgtttcattaaattttttggtttttcagatctcaaggtgtcagtatcttgtaacagtaatgagcttgattcgctgtgaaaagcaagacgtgtgaaatagaaacaaacttaaacttttaataatttcatttactaatggtcactaatgacctagaacccaagacacatatctttaaaaaaattagattagggaaatgatatataagcaaaataataatttagtaaaaggtgtaattatttttcttccttttgtaaaagttatttgtaattaacaaatgatcatttgtatatttttctagtaacacctaaaacttcctgatctttatccgtttaaccaacatgtatggtgttaaagaaacaggccaggtgtggtggctcacacctgtaatcccagcagtttgggaggctgaggcgggcagatcacctgaggtcaggagttgaagaccagcctggccaacatggtgaaaccccatctctactaaaaatacaaaaaaaaaaaaaattgccaggtgtggtggtgggcacctgtaatcccagctactagggaggctgaggcagaagaatcgcttgaacctgagaggcagaagttgtggtggaccaagaatgcaccattgcactccagcctgggcaacaagagtgaaactctgtctcaaagaaaagaaaagaaataactggaaagaaagtaccagcaaggaacgtcctttctcaatacctcttacatgatccctgtcccctacgtcctatggtttcaccgtatcacatcctcacacactcccctctaactccactttttaagtgactctgtttcctcttacattttcccatagtctgtcttccccttatataactgtcattatataactcattctgtaatgatttacttaaacctgacttccccattaggaagtatgctccatggggagagagcgcatatctgcttcgtatttcccccctaaatcctcaacacctgttacaattcccagtgtacagtaagcagtccataaagctggatgattactctgcatgtgttagtgacatgcatgaagtacccatttccccttggcacgggaagcccaggggaacagcattttcctgcctgacttctgaagccctcatactcatgatcctacgggagcaatggcaagggcaccggaaagccaggtcggagaatagagacccccagcctgctctcacagttggactcagcagtgcaacatcagtgactcctttgtgggagtcccacacaccgctgttcacacagggaacaccagtgcccggtggagctgcgggcttttgagacctcccgagtcgctttgtgtgcacaatgccgtgactctggatttgtacagtatgaccctcagacgctggaacaggagcacacgccaaagagaaaaaggagtggagatcactgagatctcataaatccataatgggcctgctctgtattaataaaacaatctcaatggtggagctccataaaagagaggcataggctgatgtaatttccttgaagtcccctgtaaagcattttactctgtaatacagctacatttatgaagtggttttatcttgaaagatcccaaagggcttactagactgaaaaggaaaatatcaagtacacgacatctcaaaacaccaccaatgtacttcggtgataacagttggggattctgtgacagcaggtagccctcttaaaaagcagacagcggcttagcccattaaacctccagggagaagtaaagagaaagaggagataattgtccacattggataagggccacacaggttttctttattaataaaggccatggcttgtttccatccgccacgtggatttaagtgggtgagctttatcaacatcattctccttatttgaaataaaagaaagaaaccaacttataacacttcttcataaagggactgagaaaatatatgtaaagcttccagtggttaatagaggtcaggtgtagccagtgtaatttagaagctgtgcattttaaaaagtaaaatataacctacagttataaaatatatccgacaggaaaaatatcttttcccagccaaattttactgaatccagtcctgtcgaaatgactgatcctgggtttttttcttccttgttgctgtcctggttaggacatggtggcactaacttttagtgaattagccgaggatataggggaatggttggcaggggccagaagtccttcttgattatcctccaagaatatcaccccactgggagctaagaaggaaggtggaagcaccaggtgatgtaagtttagcaatcgctgagtactgtcaaagaaagcagtctgagacttcaaagtaaataaaaagtagctcccctttcttcaaaaatgttaaaactgatccactctctaaccaggaatactgttgtctcacattccctctgcagtttctctcatcccacttctgcttccagcccaaacccctcacccgtctcgttttcccaccagaaagtactccttgtctttttactaatactttgcttcttccctccccacacgatctctccaaagcctgggaactgagctagcaaagagaatgctcttctgagcttggagctgaacaaggagcccctatggaggagacaaagatgcaaaatttttagtttggttttattctcatttaagttttctatggagtatttttcttgtgatttaatctttggatgagactatcaatgtacgtttcttctaattttatttttcaaatattccattgcaaacttatttagcatttataattgaatactgataagtgaatttatttattcatttatttattcatttattttgagatgcagtctcactctgccacccaagctggagtacagtggtgtgatcttggctcactgcaacctctacttccaggttcaagggattctcctgccatggccagtattattttttaaatttttagtagtgacggggtttcaccgtgttggccaggctggtctcaaactactgacctcaagtgatctgccagcctcagtctcccaaagtgctgggattacaggcatgagccactgctcccggccagtaaactttattttattttaaaaacctgttttggagtattagcccactggtttacattgtcttccttacatacatcacacccatatggaggagtactttaaagacaaagttgcaatctggtagcatagctgcccagtggagaaaaagtgcacatgtaaagcctgagtaattcagggcatgaaaatatccctgtcagccaatcagtcaacgagttgaccaagcgtcttggctagcctcagaggtaccttggcaggcaggctcaggcattgtgcagccctgtgtaaaattttcctcatagtaactacgttgtctttacatcaacctgagaagtagatactatttttcctatttttgtttgtttgtttgtttgtttgagacaaagactcggtctgtcgcccaggctggagtgcagtggtgcgatctcggcccatggcaacctccgcctcccgggttgacgccattctcctgcctcagcctcccgagtagctgggactacaggcgcccgccaccacgcccagctaatttttttgtatttttagtagagatggggtttcactgttggctaggatggtctcgatttcctgacctcgtgatccgcccacctccgcctcccaaagtgttgggattacaggcgtgagccagcgcgcctggcctatttttcctattttattaatgagaaaactgaggctcagagatgctaaataacatatctgagttcatcactgccagtcaatctgggctcaaacattccgatccagattgctctgattctagagcctttgttctggaaatctgtcttttataatacacagggattttatttttaaccttttattttgaaatgaattcagacttacaggaaagttgcaaaaagaatgtaggtaattcctttatatttttagttcaaatttttcaaatgttaacatattatcacatttacttaatgattcctccctcccccaactattgaagagaaaattgcagactcgatgccccttttcccctcatcttcagtgtgatatttcccaaaaacaaggatgttttttctctctcatagaatcacagaacaatgatcaaatcagcaaattaacgctattaaaaattatctaatcaacacacttaatttggatttatccaattaccgcactaatgtttttttattgcaaaagaaaatattttggcccaggatctaatccaggatttaatattgcctcagatctcatgtctctttaggttcctttaatctggaaaagttcttcatctttgttctgtctttcgtgaccatgacatagttgaagattataggttggttagtttgttcggtgtctcccatgattagatccaggttaaagaaacagctggaaagaaagtacaagcaaggaacttcctatgtcaacacctaaataatctctgccacccccacccccatggctttaccccatcacatcctcacaaactcccctctacctccacattttaggtgattctctttcctcttacattttctcatagtctgccctccctttatagctctaatcacaacttgaattgtataacaaattctataatgatttttttaaaactgacttccccattagggtgtatgctccctggggactgagctcatacctggttcgtatttgcgcccgctgaatcctcaacacctagtacaattctcagtaagcagtccctaaagctaagtgattactctgtatgtgttagtgaaatgcattaagtgcccatttccccttggcgtgggaagcccacaggaacagcattttcctgccttacttctgaagtccttgaactcacgctcctactggagtgatggcaaggccactggaaagccaggtcggagaacagagacccccccagcctgctttcacagttggttccggcagttgttgcatttgtggcaagaacctcatggcagtattgtgtccttcacagtgctttgtatcaggcagcatgtagcaggcttttgtgtccttactggtgacattaacttggaccacttacagagggtggtgtctgccaggtttctcctatataaacttaatttttcctcctttgtaactaacaagggtcttggaaggagatatttccagactacacaaataccttgtttcttttcatattttcacccactgattctaggcttctttgataatttttgccctcctgccccaccaaaaaatattttaccattatggttaccaaatggcgattctctaatggcatgagtccttctacatttatttgttggcattctattttaaggaaaagctccccccaacttaagaatttatttccaattttaaaagtttcattactatggttttatgggttctttttttattctgtagggtaacaatctgttgctacccttatttattcttgtgcgccaattgtccaccgtttgtccagtgggaagcctaacatgcagtttttatattcaagtatcctagcacgtcaacttttattgcttcacttaaaatctgccaccttccaccttcatgtcctgaatcctttatctagaaaatgtgtaattttccaagaaggcctcagacctagtggtccagttactgtctgtttttgctgactaactcttgaaataagaatttttttaaaagctggtagtagggatgaagggggttaagtgacagttctcctaagaagcatactcatggccctgccagcggcttggagacataagggaggtaaactgaaatctttcctgaacacttcatgctttttggtttctctccactttttaacacactgcagtgtaattccctccactatcctgaaaacatggatttagattccaagacccatctctccttctgtgaagccatcctccctgccccacccaggcaggatgaattattctcttcttggcagctctagaagccctggtataggcttttgttctagcatcagtcatatggtgttataactatttttgacactccgttcccctcaataggctgtgagcctttcacaaatgggtttttacatatatctgtgttaagtaataataaggctgggtgtagtggctcacgcctgtaatcccagcagtttgggaggctgagtggggatgattgcttgagctcaagagttcaagacaagcctggacaacatggaaaaaccccatctctacaaaatatacaaaaattagttgggcatggtaatcccagctgctcaggaggctgaggcaggagaatcgcttgaaccctggaggcagaagttgcagtaagccaagatcgcatcactgcactccagcctgggcaacagaatgagactctctctcaaacgaaaaagaaataataaacatttttaattatttaaaaatgtgttagaatcgatatctaggtcattgtgtaaaccaaaggccagcaaactttcctgcaaagggccaggtaggctttgtaggtgatatagtttctcttataactagtaaactctgctactgtatatctaatggccctatacacgatacataaaagaatgaatgtggctgtgtttcaatagaactttattcatataaatagacgtggggctgaattttaccctagggctataatttcctgacccctgatctctcccacctcaaggtcttcctattagctgaatacctgccttaggaaatccctcattttctctggctattttctgcatattctttttttttttttttttttaagcagctttctagcttctctctggaagagtggaaagatgatggggctagcccatagtttctcaacctgggcaatattgacaatttgaactaggtaatcttttgttgtgagggagtacattatagaatgttagcagcatgcctggcctctacacactggataccactagcagcactgcagtcatgacaatcaaaatgtctccggacatcgtaaaattacccctggttgaggagaatcaggctagtccgtgcacaatatatttttaaatttttctttagttcttcaagagccttccaggtgaaggaatggactgccacagccaaaaacaagatggctagcaaactcttctctccaggaaacgtcttcctaataaggcatattttattattttgtcagaaagtccatttctacacctttcttaatcctccatttagtatttctctttttttttttattatactttaagttctggggtacgtgtgcagaacttgtaggtttcttacgtaggtatacacgtgctatggtggtttgctgcatctgtcaatccgtcatctacattaggtatttctcctaatgctatccctcccctagacccctacccatcgacagtgtggtgtttccctccctgtttccttgtgttcttatcgttcacctcccactcaggaatgagaacatgtggtatttggttttctgttcttgtgttagtttgctgagaatgttggtttccagctacatccgtgatcctgcaaaagacaggaactcatccttttttatggctgcatagtattccctggtatatatgtgccacattttctttatccagtctatcattgatgggcatttgggttggtttcaagtctttgctattgtgaacagtgcatattcttttttttttttttttttttttttttttgagacggagtctcgctctgtcgcccaggccggactgcggactgcagtggcgcaatctcggctcactgcaagctccacttcccgggttcacgccattctcctgcctcagcctcccgagtagctgggactacaggcgcccgccaccgcgcccggctaattttttgtatttttagtagagacggggtttcaccttgttagccaggatggtctcaatctcctgacctcatgatccacccgcctcggcctcccaaagtgccagtgcatattcttaagggctcagcttaaaccttacctgtttgagtgtaaggcagagctccttgatctgcataatagattaagttccagtgctgtatttaccaaagtcccctctattatttccctattagagcattcattagtattaactataatgactataatgacttgttttacctttgaaattttattaaaattattgcaagagcacttttttaccttccaatgcccagtgcttcagtacttactcagagtgcaggcacatttaaaatatttgttgaatgtacaaataaatgtttaaaaggtttcacatagactaggttgcaaaatccatagcagacactgtaggtgctccacctatatcctttccttttaccattctggggcatactggcctaatttacttgcagaagaacaaacacattctgagaacagccaggcctcaaccaaagaccagcaggagcaggtgcataaataccccaactccctcacccttcgaatgcgatgactctaaggcttatgttttaaactggcttccataactcaccagcaggattcagttctagttatccacattgacagctgatttgataacagccgttttgttggctgctttccctgccttatctcatttcctattctcactgtcactctcattcctgttctcttattctcatgtagtgctcccatcaccttccacatcaaccccgcacacttgaatccttgttgcaaggtctgttcctaggacagcaaagcataaggtttccaacaaccctgtgagatgtgtatcatcacctgtattttaaaagtaagaagtgcagggcagagagattatggccatctaccaagtgcatcgaagaataggcatctaacccagacctctggctacaaactctggacatcatccagttcaccatgttgtttctataaggtgttcaactagtgtgcgttaaatgacaagatggctgggtgtagttctgatataaactcttcccaaattcaaccttgaattcaaatggtttctttctagtcgtagtatggtaccaaatagataagtctgtttaggtaagaattaaatgtaaaaaaacacaaacatttaagttcattggattgtttccccttaactgcctgtgccccttaaatgctaccttttcctgatcctatttgaggggggaagtatcttttgaatcccagacttgcagggacggattctgcatggcctgtacccttgtttgcagcgattactctgctcagaggaggatgacctgtgtggggagcctcttcagctacttgaggcactaaccctctagcccaggaagtcccattattgctgggccctgccataagcttatttgtatttcacagcgacttgcacagatgtgccagatatgtacagatggatttttatcagaagagagtctacccaagtgaagcagtgtagggtgaggctaaatcccaaaattgaaatttggggacactgattaggcacagagcaggaccaggggttaaaaccatgtgggaaacagatcaatagaatggaggaaaacagtccctgaggaggaccctatgacagaaatctactatagagaaacggcctgggcagaccaagcataatattcagtggagagtctgggtgtgagagctgtgtttgggtgagaagcagggaatgattgaaaggtaagacaagagaaaacatttccttttgttcattccatttctgcagaggctcttgtatttctgagtcccattttgaaagtcacacagcccagcatctcatctcttctttagccgaaaaacatactgcattagctgagtctccagagcaagttgttgctagccttgggacctggggaggttatttcagctgtgagtacctcacttccctcacatgcaaagtgcagtagtaacagcacttccatcctatggtagctgggacggaaaatgcataactccatgtgaattgccaaggatagtgcctgtcacgtggtaagcatttaacacatagtagctgtttttaatattatgtgtggtagattggcaccattccatgaatccaagccatttgggtatgataactgaactggttgtcaaagcaagaatcagccttgtgtttacaaccactgagaaagagcttgtcaagctcttagctgaaatctgtacaaaatatctgctgcaggtctctacctttttaccatttaaggtccatgaaggaaaccaggtcactcaggcacaacctgattttaatgaaccctcgtaggcgtctaaagaatcaccactttatttttttaaagtgttcaaaaccattactttaatgatttgttctggagtctcgacccagaacaatgtcagtctcgttacagaatctcagaatttactgccactttttgaaatagttggagatactttctatcctctgtctcagcatttctgccactcttctggattggatttatttagaacaattaaatgctgtcttacaatctctttccccaacttggggtttctcttcccttctaccaacgttcactctgcattttcattctgatgctcatttttcttggcattttgtctggagaagtttgaagcagagcagatgctcagacggtctgcatccctcctctttgccgtccttctcctttgctcacctgcaagaatcaggctttacgattcaactttctgttccaaacatagctttaaagcctgtttgggtgtccttagaaatttttctaagtgtcagctcatatgagacacccgctccagatgtcttgttttcccactgttcactgttcaatttaacaaaacacatattaggcacctactgtgaggcaggcattgtgctgctcttgaaagatacaaaggaaaacaaggtgtagtccctactttcaaggcgctcacggtaaagctagaaatgtaaacaaaccaacacaaaacagtgtgcaagaatcctgttaaagacctgccctcactgaactgtgcccctccacctggaggctgcagcgggtcaaggatggcttcactgaagggatgatatttgaacaagacttatttttatttctttttattcttctatcccatgacatttccttttctagtctcctaggcagccatcaacaaggtgcacaaatatgtctttttgcttatacagtagtcatacaaaatgcatgttgcagttttgtactcagctgtttcattgatgtaaatgatcctgtgtcacatactcacacaccttattttttgctttccctctctaagcatttttggtttttggttttttttgaaacagagttacccactgttgtccaggctggagtgcagtggtgtgatagctcactgcaacctctgcctccccggttctagcgattctcctgcctcagcctcccaagtaatccctgggattacgggcacccactaccatgcccagccaactgttttgtttgtttgtttttgtattttcagtagagacagggtttcagcacgttggccaggctgattttgaactcctgacctcaagtgatgctcccacctcggcctcacaaagtgctaggattacaggcgtgagccaccatgcccggcctaagctttctttgtaagatgcattcatgtcagggtgcaaacatccaggctgttatttccattcactgtgtgtccttgcatcttccacatccttcacttttccattgtctccatgtagaatgcccacattgtctctggttcccaacaccctgaataactgcagcaataccctttacgattcacatgcagatgggtgtaaaaggttccttggcttatatttgcccagaaatggaatttctggatcacaggtatgacaggcagaataatgaccccaatgatatccacattctaatacctagaaactgcaaatatgtgaccttgggtggcaaaagggactttgcagatgtaattagattaaaatttttgagattgagagatcatgttggacgatgtaagtgggcccagtataatcacaagggtccttatcagaaaaaggaggaggcagaagatccagagttggagagagatttaaagatgctctattgctgtctttgaagatagaggaaggggccaggagtcaaggaaagtgggcagcatgtagaacatgtaaaagaaaaggaagcagatttgtccctagagccttcaagagtctccatgtcagacttttgacctcaaggactataaaataatacatttgtgttgctttaagccattaagttcctggggatttgttacagcggccgcaggatgcccacacataaactacgcccagactgactttgactgtaatggcgctgggtcagtctcagaatggctgtccaggcccacatttctgatagccgcacatgaagtcctcacgtctgcacaccctcggcatcacttggcccaactcgtctttctgatttctttcagtccgatgggtataaagcataaacaagtcttgaataaagagtcagaattccttccaataaagtagggtggttgaggtgagatgggggatggccttggggccctggctgctgtggttggatggtctggtctttgggagaggatgcacaaatcattaggaaagcagagataaggctcccaaggggctacatggagagtaagtggagacaaaacccgtgcgccttgtgaggacacagggctgtgtggactccatggaagagagggccccagacagtggcaggcagtgtggggtcacagtcgtagtcaggcctgggtgtcagtcacagttctgcagctgccgtgtgaccctaggcatgctcttaacctctctgatccttggcatccttctccctgtgacagggataataatactatctgctcataggactgccatgtggcttacatgagatcatgcatgcaaagcccctaatacagtgaatggtatagagttggcacccaacaaataatcatcgtaatgatactattttcattagcacaataattgtaataataattacagtttcttacattcctcaactccaagaaaattggatttttcttgtaatctgcaggatccattgctgaccttgctcttctatctggagaataatgtattgcaatcagtttccacatatttatatgcaaaggcctttatatattattttcaaggagatcttcccctccttaaccattgcccttgtctatacccccatccctgaaaaatgggggtttccttttagggcttttaacagcataatgcagttgaatacaacttattttactgacatctctcctccaagcgctctcccccagcactttccaggactaaataatgcatgaagggagagaataacagggattgcataaacgacggaaaacagcacggtaaggattctgtgttgtgaagagatgaaagcccctggtcagaaggccagtaacaaagcaaagaagaaatgcaaaggcattgacgagggagacaagaaaagtatttttcaagataagatttgtggagagttaaaaaggagatgactcaggagacagtcaaagactcttcattagacaggaactccagagtgggtacaccagggggcctgggcttttgaagggctggggctctgaagaagttaacaaacaccagctccacttcctgggcctctgaagccttctttgacgtgcccaggtgggggccgattcttcttgcttggtgtcctatgcctccctcttcctacctttattagagaatgtatctcactcaactgtaacggtggattcctatgtcctttttcttcactgtgctggagctccaggcgcttttccagttatcctcatgcttttccatcttagatgcttttccagttatcctcatcatagattaaaataataattgttggtcatttagtctgtccctgtgctaagtgctccatgtgcattagataaattatgcctcaagacagccccagatacccattttacaactgtagaaactgaggcaggaggagattgagacttgcttgcagatgtgcaaatggtggagaatgtaggtgagattggcactgaggggttcagactcccaaatagggctgttgagtttcttttactcccaaaaccaagcacagtgctgagcacgaaaatgcactaagcaagagtttgatttgtgaacacattattctgcctggaactcagctagctagccaggtggtactcggagttggcatttctgttgctcaggccgggctgcatttggtgagttgcgggaaggggatgatgacatcttctccagttgacaaaagacaatggcttgttctgaggagagggcctggaactcttggtccatcagtctggctttgtcctgtctattatacacagtctaatcacccccaacaaatggtgctaggaaaacgaaaacaaaagctatatatttcctcttatagaatttttaaaacaactaaatatacctctggaatacactttacaaatttatgctaaaggcttccacaccaatgtggctcctaagttcccaaaattgagctccattttgaattgcccttggccctgctctctctgggattgctagagagttccagcatggacccagtgtcctttgtgggctgcagagctggacaacactgggatgagtaaggcagccaaccctcagccctgggaggcacagtgagggccagggtattaaccagaagcttagtagtcattttaccatcagcattaagtcacccacatgcacactgatatggtttggctgtgtccccacccaaatctcatcttgaattgtagttcccataatccccacgtgtaatgggaggaacctagtgggaggtaatttaattatgagtgagttctcacgagatgtgatggttttatatggggcttttcccccttttgcttggcacttccccttgctgccaccatgtgaagaaggacatgtttgtttccccatccaccatgattgtaaatttcctgagaactcccagacctgcagaaccgtgagtcaattgaacctctttcctttataaattacccagtctcaggtatgtctttattagcagcataaaaatggactaatacagcaaattggttctgagggagcagggtgctgctctaaagatacccaaaaatgtggaagtgactttggaactgggtaacaggcagaggtaggaacagtttggagggctcagaagaagacaggaaaatgtgggcaattttggaacttcctagagacctggaaggctcagaagacaggaagatgtgggagtttagaacttcctagagatttgttgaatgtctttgaccaaaatgctgatagtgatatggacaatgaagtccaagttggggtggtctcaaatgaagatgaggaacttgttggaaactggagcaaaggtgactctcgttatgttttagcacagggactggtggcattttcccctgccctagagatctctggcactttgaactggagagagatgatttagggtatctggcagaataaatctccaagcagcagagccttcaagaggtggcttgggtgctgttaaaagtattcagttttatgtattcataaagacatggtttggaattggaacttatgtttaaaagggaagcagaacataaaagttcagaaaatttgtagcctgacaatgcaatagaaaagaaaaacctattttatggggagaaattcaaggctgttgcagaaatttgcatcagtaatgaggagcaaaatattaatcaccaagacaacagggaaaatgtctccagggcatgtcaggggtcttcatggcagcccctcccattgcaggcctggaggccttggaggaaaaaatggctttgtgggccaggcccaagtctcccctgctttgtgcagcatgggaacttggtgccctgtgtcccagccactacagccatagctaaaagaggccaaggtacagctcaggttgtggcttcggtgggtgcaagccccaagccttggcagcttccacatagtgttgagcctgcaggtacacagaagtcagtaattgaggtttgggaacctctgtctagatttcagaggatgtgtggaaacacgtgatgtccaggcagaagtttgctgcagggacagaacactcatggagaacctctgctagagcagtgcagaagggaaatatggggttggagcccccacacagagtccccactggggcactgcttagtggagctgtgagaagagggtcaccatcctccataccccaaaatggtagctccaccgacagcttgcaccaccatgcacctggaaaagccacagacactcaaagctagccatgaaagcagccgggaggggggttgtaccctgcaaagccacaggggtggagctgcccaagatcatgggagcccacctctagcatcatcatgccctagatgtgagacatgaagtcaaaggggattatttttgaactttaaggtttaatgactgccctattggattctagacttgcatggggcctgtagctcctttgttttggccagttactcccatttggaacagatgtatttatccaatgcctgtacccccattgtgtctgggaagtatctaactggctttggattttacaggcttgtaggcctcgtctcagatgagactatggacttggagttttcagttaatgctggactgagttatgacttttggggactgttgggagggcagaattgtcttttgaaatgtgagtacacgggattttggagagtaggggcagagtgatatgatttggctgtgtcctcatccaaatttcatcttgaattatagttcctgtaatccctacatgtggtgggagggacgtggggggagacgactggatcatgggggtggttaccctcatgctgttttcatgattgtgaattctcatgggatctgatggttttataaagggcgtttcccccttttgctcagcacttctcctggatgctgccatgtgaaaaaggatgtgtttgcttcctcttccaccatgatcatagtttcctgaggcttcccaagccgtgcagaattgtgagtcaattaaacctctttcctttataaattacccagtcttaggtatgtctctattagcaggatgagaacagacaaatgcacagaccaacaaggagtatgtggtgagctttttcctgccttgcttttttgaaagaggaaaacaataagatcagaacagattatcactaaaattggcagggggaaagtgtggcacagtcattagaaaaaactggactttggagaccattttaggaaatcttggaatactagcattgtttggggccacttccttgggtcatgtttaagtaagatttgcagcagcccatagatgactcactgaaatttaatcattaatggaatattttataaaggggcagtttataaatgcatagttgaagtacagggaaaccacaagggatggcaccacccccaggggctagtgatggcagggacagttatctgccctggtctgaagggttaagaggagaggagggagccctctctgaagtggagacagtgaggtgtgtgtgcagaaggccacctgacgtgtctgagaccttcctttgagagatacagccagccctcagtgacccagcagggaagaagcaaggataaacacctgattccttttctccctgccttccctctgtaatgagttttgtctgttggtcaaaactagagactcacagagtgctttggctgggtccgtaaagaccaatctccagggaccaaagaaaggtggtgaagggaggagctgggtaaacagaagctatccagcctggttttcatctatccagagctgtacacaagatggtggattgaagatgattaaacacaacacagtattataagttttagaggaccaaataatgtactttaaaactaatgcaaatgtgatttttttgaaggctcatttcatggtaacactgtgcggagctcttaagtcaaacatctctttcaatcctcccaacaatctaggaagataagttatggtctccgtgttctctagtagaagaaacagactttaaagattttggtgacattttcaagcaaactaccatatacagagtcagagccctcaaactgtgaactgtatccttttggggttgcctttgtccccaagaacctccttgtcttctctggtcctcatttttcaacacagtcaagaaaatatctgtttgtttcatgactgagcattcatgagagccaaaaggaaacaatgatttattaaagtgtctatgtcaggaagttcttattggctgctcccgttgttaattgagtgtcttgaaacccttctggtgctttgtaattagtgctccaggacaaaacatgctgctgcttttttctcatcccctaaattttgccatttcagcacaaagggagctcaggtgcatcaggagccccagcctcctgcgactggactgcatacatacaaatacccattctaggtggtttccaaaaggactccatttctatgggaatattttccattgagctgtttatgaactttcacttagtgattaaaaaattattcaaaaggagggcaatagtaataaacttccactttccgtttcaccagcatatctcaaaactaaattaattatcagcctgtgtgaataaagtttgtgtcctgataaatgtattccctcaagaatgctcaattcacctttccccaggtctccagctcacacactgcagtccaatttcaaattcttccgtctcaccatgaatctccagtcttgaagccctctccttgaccccctccttggagggtgatgtggtaaatcaagtcagctctctgtgaatgtctcatcattctccacctgccacagcaattttgccccctctgctctcctcctggggtaaagagtctttccttgttagggcttaaccctttaaactagtcttcccctgctggtccaggcaaggagcctgttccagcatttggttctttcttctccatcttcttcaggtgttctccttccttctttaggtcagaaaagaaattcatgaaaaacaccataaaataaaattttaaaaaatccattttctacctttcttgcaagtgcttttatgtttctatgcatctcctcacatgggatgctcacattcagcctttgctgcaacattgtgccttcctttttgaatgttctacccaattttctcccgtaagcccttcaacagctaccagtggcttcctaatgaccattcacagtgtatgcttctcaatctctgcagcttcgaacactgttgactttcttcctttcctaccccagccttgaaataggtatccatggcaaaacattcagtccctactcttaaccttgctgtctgaatgctgttgcttgccattggactattctggaacaggaagtatagcattctaacagcatggtatatgaagccatatttccctgaatcaacttctagttttagcacttattagctaataagtgtatgatcttaggcaatttattaggaaaaaaattaatctcagtttacccaactataaaatggagataataatgctttgtaggaaggtatatgaattaattcatataaaccaatttcacaagctctgtaaaataagaatttcttcttattttataaataatacttatcttataaataataagatgttatttatgccaataatatctacaagttgacattttccaatattctgcttttagaactgtattaggttcctattgttgtattaaaaaattaccccaaacttagtgacttaaaataccacaaatttattatcatacatttctggagctccgaagtcctaaaaaatctaaagtgtcggcagagccatagcggagaatctgcttttttgcctttttcctgtatcccttggcttagggactattcctccatgttcaaagctgcatttgcatggcttcaactatcagttctatgtggaagattttttctgattttcaggccagtctcatatccccagagaaatgcattcttatccccccaactatttgccattgaaagtaatggcaaaaaccaccattagttttgcaccaacctagtagttgcaggtcgtctccctgtggctgcactccacacaaatacaagtaaacgcatcacaatcctataactaattctgttccttgtcctgatgagcttccttctacaaatggccctaatattccctccatttcccagtatttattgagggatgaagagtctttctgtcaactttcagtgagaagaagtaaataaaacagctttgatggatacccccatgaaccggagtgaaagggatactcctttaaatcatagttatttcgtttgctaagcatggtggccctgagaatatgcctcccagagcctccaccacagggaacacgactgacatgtgaccccagatgctgtactctgaagcccatgacagtatttgggctgacgctatggtttttattatctttcctcaccaaagacttcagcaagggagggatactaaggcaaatctgtttctgggaatcttcaaactcattcaacagctgatcttggctccagggcttccatatggccttgcaggacctttcttagactgcagagaagtccagaacactttttacttagccttcctttcctctctccttcactcaaggtcagattttcatctcagtttgatagctctccccgctcctcccagcttcgtccccattttttctcacccggctgtttcccctaatataataattggtcttcaattttaacttgcatttgctcctcaggagatctgaacttatatgtcatagtctgagtttggagggttgaagggtcaagacctgatggtgaagcccacttcctttgagttccctggattccaggaagacagaatttacaactgccagtaagggagcaaccagacgatgcaaactccttggcaccaagaagagaatgtgggaggaaaatgagatgttttagaaacaacagaggaatctgtgagacagggctgctgtgagatgatgtcacacttgacataaattgacagttaattgcctggagatttgggaacagttcaggggtgtgtgtatgagagagattgtgcataccatgaacaatggacacaaatatatatgcctgcttctgtgttgtgtgtctctctgaattagtgttccctggtccacttcataggatatttcaccagcacctgggactgactgtaagggggaaatggatttgctcatggacctttcagcagagggaaaaatgggtagaagcttctaggaagcgggaataatttcatgtaaagagggcttttcctgaagacacctgacagagtgggtagctggaggcatatctgccatagatacaaggactttctgccgtgggtgggaagctggactgggaagcccacaagaccttccacctcagacagttgtagaaattcaaaagtcccagcagttttctaaacctggcaggtcacttgaatcacatgggaggccattaaacacaccccaaatattctaaatttggatttcaagggaagggcttgaaaggaagagcaaggaacctggataaaactctaaaaccttctttcccttgcaattgaattagccagcctaatttgaaaaccacactgctttgttgaacagaattcccggaaccaccccagacttgaagtatcattcagctatgtcttcacatgggaaatgtgttgtgctatcagaagttgaattgcttgtttcaatgtgtttaagacaatgtacctccgaatctggcaggaatgagtttaaattctgactctgctacttatcatctgagtgatcttgaataagatattcaacttctcagaacctcagatttcttcgctgtaaaataaggatggtaatgacacctttttcctaaatttactgaaattatcaagtgggataatgataacagttaacattcattttcaacttgctctgtgccagtcactatttcaactcatgtattagctcatttgtttgtagcaactgtctgaagaaggttcagctatgattcccgctttacagatggaaagattgaggcatcaagaggtcacataacttgctaaggtttgcacaactaaacgggatacagctgatatttaaacctaggcaattcagtcaaaatctacttttcaggatagtatgctttatacacacatactatgctatgtgtgtataaagcacttaacccagagcttggaacacactatgtgctccataactattagctaatgttataatcactgcttttaccctgggacttacagtgaattgtcacaactctccagcatctgcaatattcctacttagctgcttgcaaagccagaacacctgtgtcttcatgccctctcctttttgtgcccagcccctgtctcagtgatgagcaggacagcatgcatggatcattaacttactgagactgagaatgtcaaattcaagacctgttgaataaggtcagtaagtaatagtagttgctgtatttctcataagtgttgaaaaggaatccttacagaaatacattactttaatcctaatgtattttgacttcttcaggatgcacaggtgtccagggaactgtagtgtcagtatctctgagaccttaggagaacttcttttgaatctaaaggagggggagttgaaaggcatctctattatagcaaaaagaaattagagggctgattcatcctattctgtagggaaagcagaactctgctcagagatcttgaagtaagtaaaacatggtagttacttttggaggaaaataaagtaccatcgaatgtagaatctgatggtttcagtgaaggtaataaatggtgctttgatgacaactgtattcattagacatatttgtggctttcctcctcctttctcttgcagataaattctcactcaggccctacagagataggtgcgtggttttagagatcatcagatgtgggtttaagatcacttttgccacttcccatatgcgagatcttgggcaggaccctcaccctctctgaaccttggcctcttctttctgaaatgttggtaattgatatggtttggatatttgtccccatccaaatttcatgttgaattgcaatccccagcattggaggtgggacctggtgggaggtgactggagcatggggacagatttctcctaaatggtttactaccatcttggtactgttctcatgatagtgagtgagttcttatgagatctggtcgtttaaaagcacatagcacctccctctttgctctgtcttgcacctgctctggccatgtgttgtgcctgcctccctttcaccttccaccatgactggaagcttcccgaagcctccccacaagcagagcagacattggcatcatgcttcctgtaaagcctacagaaccatgagccaattacacctttcttctttttaaactaccctgtctcacgtacttctatatagtgacgtaagaatggactaatacagtaatactcttacacttattgtagagatgttgtgggacaacataagacaattgtaaacacagtctgtgcctgcaagttcagccaggcactctgtagagatcaatactgtccctaggatgctgtgaattttcatattggtacgtctgagcctgagtaacacttggcaaccagagtgagccccagaactggctcatgtggaggtcagtgacaaacctttgacatttgatacaatcaaaaccaagccgctttgtttaaaatgctcatcaaatacctaccatgcacactgtgtatataaaagtcattgtcacaaaagccctttttcagaatctctagcttgccatttctctcagatttcttattgtcctctgggtcaaaaacactgcaaaatttcattcctttaccacagcaagcttttatttctggtgtacacacccgagtgttatctggaatgtggctgctctaagctgggcctctgctggatttaactctagactattggttgagctaaggtcttcttcctgtgtctcttatttttctagggatagcagaaatgaaagaggcaagtccaaccacacaaacatatctcaagcctttgcttgaactacatccaatagtacctgctggtcaaaccaagtcacaaggataacccaactgtaagaccatggcaaggtgatgaatgtctacaaataccgcaaatgggtgaagaattgagaccatatctcattctgtcatacctggaactccaaatttcccagttcttttaaacttttatgagttaggtactttcaagttgtgtaggacagactcacctggtttgggtgagttaagtctatggaaagggaacagaaaacatgtgaggaaacacttatcccatctattccatcttatcttgatggaattagaatttagggattcacttttcagggacaaaaagcattcaggaaggtgcctcacacaaaatggctactcaggaaatgtttatggagaggacatgtgaatcagtgaggagcggctgtagcactggtcaccttgccgttttcccagaagtagcctccattgctccctcctctgtggtcttcaatattctcatgattcaacttccctgtcttctttggttcttccagttactgctgtatcccttaaactcgcccaaaaggaaggattgtgttgcattaattagctgtctttctatctactgggcagagatcttatgatatgctgcctcattggcatgaatcagccaatttttgttttgttttgttttgtttgtttgtttgtttgtttttgagactttgagatggagtcttgatctgtctcccaggctggaatacagtgtcacgatcctggctcattgcaacctcctccttctaggttcaagcaattctcctgcctcagcctcctctgtagctggtattacaggcccctaaaaccacgctcagctaatttttggattcttagtagagactgagtttcactatgttgaccaggctggtctcaaactcctgacctcaggtgatctgcccgctttggcctcccaaagtggtaggattacaggcatgagccactgtgccaggccatgaatcagccagttttaaaaggcttctttttaagttgctggtcactggttgaatcgcaaagagtgtaaggaccatgcaaggaattccctatggctgcattcttcagcaagggtctgtgggttttgctattgcttagagactcaaggattttgtgttgggttgccccatctcttgctttgtgattctgcctcttgggatttggaaaggtaacctggatctagcacagagaggtctttctccctttgaagtgttcatcatgatctgatgagtcaacagtgcctcgtctcattgtttgctacactagctggctggaacactaccctcccagcagagcactccctgccagagcatgatactgccactgccaattgaagcacggctatgtttttacatcttgtagcaataaccctccttcctcaatcattgaagactgatcagctgggccaaaaccaaagcaatataacccagggtcgtgtgtgtacatgcatatgtggtgtgtgtatgtgcacatatgcatgtagtgtatatgtatgcacatgtatgtaagagcacgcacacacgtgttctttttaatataaagaaatgcctttagagaatgaaatgcactgggggcatccaaggtgaggagacttgagggaatgttttttgttttttttcttggcaaatcagtgaaagatgggcagataagtatggtgaacccctagtgtgaagtagagaaattggaggctggagttatagaggcagatgttgaagaacgtggaagcttctagaagagctgaaaacgtccatagactgagtaatcggccaggcacagtggctcacacatgtaatcccagcagtttgggaggctgaggcgggcagatcacctgaggtcaggagttcgagacctgcctggccaacatggtgaaaccccgtctctacaaaaatacaaaaattagctgggcatgttggtgggtgcctgtaatcccagctactctggaggcccgagacaggagaattgcttgaacccggctggcggaggttgcagtgagccaagatcgcaccactgcactccagcctgggagacagagtgaaactccaactcaaaaaaaaaaaaaaaaatgcgagtaatgaagggcagattcaggaccgggactggatgctcactcagtaggttgctgtgtcccgcaaggtaggaggtgttctgtgggtgaaaggcaaagacagagaggacatcaggtcagaacattccaagtgagactctacgttccttgaagactccattgtctcatttctttttatatctccagtgccaaagacctaagtgagccctctggatattagataaataaattaacttattaaaggatgaaagagtgaactactaagttaatttgaaattgaaatatagggtaaggcctgcacttacacagagaaaatgaactttcaaaaatgtacaaagcagacaaaggggagacggagagagagaatgaagactgaatgggtatccaactgatacctggaacatggcagtgtgagtagctgaaaaaggaaaagacctcaaggaatggggctgtctgtggggcctatatttatgttgacatcactcacaagtacaagtctgcatccctgggtgtcctcagacaagcatatagtttgcatatcgtattaccttttgtgttagtaatcactgattttgaatcttagctgactgtggaggtgctgttctgcctttgacatggcagtgtgagctggagagggatggggagatgaagaagccacatgtcccaggaatatcaggatcctataaacttattctgggtaaggcagtggcaagggtgaccagcaaagtggtgcctgaaggctgggaatccagtcatgtcaattttcttgtttgtttctctctggcaccttctctaggcccagagcctagatgaggctgtgtggaccagtgatacaatggagactttaattttctcgattagtgcagaggatgaagaaatctcagcagtcatgctgtattcaaggtgcagggtattgcctgcttctgttctcaatgctggctctcgtagcttaacccacctatacagaagtgacttgttttcatccccgtcctggccagtgactctttaaccaggcaatgtgatttacgtttagatgttagtttaatccctttgtttcttaatgaagctgcccttgttaaaatccctgggacctaatcatagaaattctctctagccccacgtctccgttcaacaactgcttagcaaatttctcatcagtcccatttttttttttaccagctcccctcaatagccatttcttgtctccaaggttttttgaagcccagaggcttttcttgtcaggcaattctcttatttcagccctgcagtgaactatccatatactgtatcacatcatgattttttttttctctgcaacctctcccttccccttgaaacaacttacctttatctgtgttccaaccccaatctgttgcgtctagaagtcagagagccaactgccaatcattctagaattcagcattttcaaagttcatctttgaaatggatagcctcttgttctgcagaaaagcaaggatcctagaaaaaacatgcaaactgcatttcaaggaggatggcatcatctttttgtttctcttggaatgactcaggagtgaggaaacaggaatacattactgtggttcccactcatcttggcctaccaatctctcccatctttctaggtacagcccatcttgtgatgggctgggacctgggcccctcctggacttacgttcaggatttcaaataacttggatggcagtctagccaaggaagccaaaagcttccatctcttccttgtcgtttgtgtgggttttttggtttgggttttttttttttttttagagacagagtctcactttatcatccaggctggagtgcagtggcacaatcacggctcactgccgccttgaactcctgggctcaagtgattctcccacctcagcctcctgagtagctagaattacaggtgcatgccaccaggaccagctatttatttatttattgtagaggtggggtcttgctatgttgcctaggctgattttgaactcctggtctgaagtgatccatcttggcctccaaagtactgggattacaggtgtgagccactgtgccccacagtatatctttttaaaatgaagactttcttatcagatttcagcaccaaggctcatacatatgttgactcaagaattaaagggctttagtttcatgtgctggcactaatcaatggctctggtttgagaacaattttgaaaccatactcgtctcattggaaaagagggcagtagtggtgcctaccagagatagggcatgaggaagcagtagtagcatccctgccatgcacctgccatccttgatttgataaagtccagaagcacatctgatcacaccatcttgcacaatggccttctcccaagcaacagtgacaacttagatggcctggaaaactatttcaaactaatagcaacatgtctaccaagagtgcattattaatgacacattcaactgaaaaattgatcacacgctcttaggtattacatgggtcacatttgcaataattttggtttttactgctgaaaggcaaatttaaggtaaaaatcaaatactttaaaagtatatatcttaatatgccttcctcttaacattcatctagtaaggggggagatgtagaattttgatataaattggccagccttatgttgatttatctttaacacagatttcaactccttcacttcagttgccatgaactgcaaggcccttgttcagtctggcttttcatctctttcctgcccaagtccaatttagctcttataaaacaaccagactactgcaatccctcatctcacggcaacctccaggacataatatataaaacttacccttgacatgtgggtgggtcaaataagtgatcaaagggcaagtcatgatctgaaagcatggtaatctcaagcaaccgctgatgtgaacattgcgtgtggcacagtgaaactcaaaggactcctgattttggcaataaaaacgattgtgtctataaactgagagaattatagaagtttgagcacagctgatcttagccttgaacatagttgaggaagagggaaggagaaatttaaaactttaattctgccaatttaacaaaaccgcttcacatcattatctaggatgagagtgatataaagaaatttaccagaactttttccattaatcaaaaagaaggtagtgaatgagatggaggatcaatcatgtcaaaaatttcagaaagggatgaggaaataatttctagcaaattatataataaaagtatgtttccactgaaaggagcattgaggaagaagaagagtatttcgtagaagtgaaacggcactgattaacctcattaaggacatgacttcctcatactttaataggaagtggtaaacttcagaatgagaccagcactatgttgaagtatgtcctagtccagcctctgttgtgagctagctgggaaagcatggccttatctgtttcagtatccttatttgtgaaatgaagagcttggcctgaaatcagcagctctcaaattttcgtgggcatcagaatcaccaaggatgtttgtaaatgtttttaaaagtcaattttcaagactccattaaatggagattttgatatatacaatcagagttaaatatgtgtatatataaaaaatatctttaagctagagtctcttatcagtgagactttgggctctacgtgcagagagactggtttacaaccagtcaaggggcagggtggggatagaattcagaactttagagataatctaacattctcagagactagaattctgcagtgttctggaacaataccccaaggtcaaaaagctttaactaaatgtttgtatgatcaataaattggtctgatttaaaattagcctataaagacattttttaaaagcaaatgcttaacttcaatactacatgacaagagggtgatatacaaaaaaaagttactatgtggttcttggcatcaagcagattaaagtctactttgaaataaagaccataataagtagttgaccccataaaaattaagcaataatgggaagaagttcagaggaacagaaaatcaattcatgctgagatgataatcaaattattggtaaaaatgaagatgctggttaggcatgtccttggctagagaagggctcaggcttgcaggtttaatgacctttagctgagaccaccccacgtgtccatctgcctcaggatactctaagtctcgtggctgaagcaaagtcttccttaaacagggcttccattgggccatgccagctattttgtttgtttgtttcctcaagacttaccaggccctatcttctgattccacctttgatcttaggtaggttaattcagttaatatattactaataactgtctacactctttctgccctcgatatctgtttccttctgctaacattttatgactattctttgtgggttaatttcacattttatctcccaaaggcagcccaagttccctcctttccagatgtcttgggctctcccaccgtagagcattggtgctgcctatactgttgttcttgatttcagagaacgttctacatcatacagatgcttacgcttattaaactactgatttaagttgttgcaggttttgagttaccactggcttttgactcagttgaaaaaaaacaaagaatggtccagggtgagagaggtgtgtaaattgactccgtgaggactctaggaactgatctttgacttcctcgccagcctctttgccaagcccaaattcatcatcattgtgaagtagcattgggccatgtttaagaagttttctataagaatttattttggattaatagcaaataattgcagctgagtcagcattaaagacatgttatatcagactgtgtctgctagttcagaggatgctgcttctcggatgggacttagctgaacacgtgttacacctctggggaagtgtctacagcattgtaccaaaaaacacagaaaacaggccactgaaacaaacaccagcagacatagcattggcaggatctaacaagcaggttttcctgaaacgtcattttgacagggttatagtcaggtggaatctcttaactgcagtggtcacctggtgcttcgttctttggtgcacagagagggggctgcagaggattaacatggaagaagcaagcactccccctccgttgttacccctccctgcaagatcctgaagccctgattctttccccatcattatatcccttttcaggaacggaaatgtcttctgcagagccagcccattccctctggtgctggtctcaggggaagtacagcatctggctcccaccctccatctaattacccatctgtttgtggggagggaagggatgttctattccccttctcttcccaaacattttaatgtgctgatgcatgaagacgacagcagctgcacctcagaacccatcctttgtgcatcacactcactggcttagcttttctgttcagttcttggatgggcctctttatagctagagacccacgtctctaactcctcctcatcctgacttagtacaaccctggcccttgcattagactgctccagattccatgttgctctctgattcagcatcatcaagcctcagcggggtgcctgagaccccctacctttagggaggggcagggatttccctgctctgctcttggcctagggcttctatcagctccagcaaagagaccatggagagcgtagcctttcatcgtaatctcccaacctttactcagctaatggcccctttggttatttctctctcactctggaagccatgtttagaaagagctgatatactgaacaaattgcacttaataaatattcacttattttccctctttttaaaaattaatcaagttctttgtaaggaagaaaaacgtattagtctttgacaaatgaaactaccaatctccattgatacctacgttgatagtattcaagccccaaacaaacacttcttagctggctcagatgatctggttaaggggaactttgtcagtttagttcagctttgtgaaatactgaaggatttcagaccactattaatacctgagtaaagtggttaagagaataactttggacatagagacagatgggtttcatttggccacatactagctacatgacctcgggcaagtttctgaacttgatgcggctccatttcttcatgggtaaaattggggtaattatactattgatcctgtaggattatcctgaagatagaatgcataatgtttacaaagcacttggtacaaagaggcataaagcaagaagtgagtaaatgttaactgctgctatctttattcccgtcattttaatcatcactatcaattatcatcacaacccaagtggctcagggatggagagaccccaactaggaccctctctccattctaggggaaacatttattcaactcaactgtggccagaactcatagtgaatctcgctatagtcatcctccgttttgcaacagcagattttgctgggctcgtggtcactcagctaaagactactttctccagccaccttgcatctaggtatgaccatggaactgggtgatggccactaagacatgagtgagcgtgatgttagcacattaatccatgcctttgaaaggcaagaagtctattttcccttcctgtttttcccttcttcagctgaaacgcaaacgtggtggtgaatcatcttgaattaagctgaaaagggtaacatggaagagatggcatggcaacaggatgcatccccaataccatcaagccaccattccaattctggactgccaacctagactcttaaataagggagaaaaaaagtcctttttgctttaaactactgaatctgatatcacctattataacaccatggtgtatcgtaaaaacacaccaaacaactattttcaaaatagatgtgatacttctccccagttatacaacttctggaagcaggaagccactgcattcccccacccagcttgtcatggtttacttctgattggatataactagatgataacagggatcacgctgcatccattgaggagaaagatgattcaaccctctcgcgggctgctggggaatcgatatcgtttaattatgagaaagtaaactgtgtttacattttacacagtggcaagaggaaggtcaaatcacaatcctcataccctttatcaaaaccatgcatcgctgtttgtcaagtgagattcaaaatgggatgaacttggagagttgccatcttcctgttttctcccttgtttgttcatatggctgtgctttacaagattaaaaggcttaccgggcaaaagcatagcagaaggaagtaaaaccttcgggcagatgaaataattcttccattttaggaaaaaaaggcaattagttatttgaggttttctgggtggggcagtgagtagaaggtcattatgttcctttcctgttgtatatcgaaaatcagttgagaagtaatgaaaatggtaagaaaaagaaaaaaaaagagtaaaccctcttcctctcccagtggcctctaccccatgactcatcagcttcctgaactggaacaacactgagctttatgactacagaaatgtcagctctgagcacagtgcatacttctttgtgtgaagatcttaggcggttgtgcaaaagccagcccaggacccagcatggtcctgctttatctctctgccgggctagtctccatgttcattagaaatgtgtgatttcttgacaagcactctttggatttgctgcagagtcaggtgatacattgaaatcagcaaaaacattaatgatagcaacaacaaaaacgaccttgtttaagttttacgccttataagggggcaatgttagccttgtaataaaaatgaggtaactgcaacttggaaatattaggaaatttatttaggatatcttagaaaatcataatgagagtgatgatgatgatgatggtagtgatgatgattatggtaatgataactatagtgatggtgatgacgatggtgatggtgggggtaatggtgatggtgatggtggtgatgatgatagtgatggtgatggtggtgatagtaatgattacggtggtggtgatgatgattctagtgatggtgatgctgatggcggtgatggtgatgttgattattatggtaatgataattacgatggtgttgttgatgatggtggtggtggtggtaatgatgatggtgatggtggtgatgatgatgatagtgatggtgatggtgatgatggtgatggtggtgatgatgatgatgatgatagtgatggtgatggtggtgatggtaatgacggtggtgatgatggtgatggtagtggtggtgatgctgatggtggtgatggtggtgatgatggtgatgatggtgatgatagtgatggtgatgatggtggtgatgttgatggtagtgatgatgataatgatggtaatgggtggtaaagatgataatgccttactctaggctagatattgtgctaaatatttcactgacaagcaaatgtgtaaactcacagtgctcagtattgtgattgaccctaatacgttttcactaattgttggcttcagggctaggactagagtgaggtgaatgaggtactctctttgggtccaaatttaaagggatacgaaaaatctcagtaattaaagtaaataatatttaatgcaatattttataaaaataaaaattagtgcaaaaatccatggtaaacaaaatgtcaacattttaaataaaggttctgtacatgcacaatatattctatttaccttcccctaatcccacccagttgtctcagctaatggcaatcttattttatacttgatgaaacaagcctgagcccaggttgttcttatccctgttctataggtgaaaatactgggcacaagagatttttccacaatcacatagctaatatatggaaaagctgggatttgagctcagctatatctaacatagaagttcagcagtctatctggcttctaaggtaagtttctgtcacaacattaaatattcagtatcattttctgggctatttttaaatggtagggagtcaaagagattaactaccagttgcagctcttatcaggccaacaatatcagctaaggtgaatctgatactagtagaactctaagaatgtgcatttattaagtcactcatataaataatatatttaacctacttagaaactctgtatagaagatatcagtgttgtatttcataaatagagaaagagaatctcagagttgagcactcacagtcatggtcaattcatggcagagttggtgaccagctcaaattttctaggttgacataatcctgtcctttctatggcttcaaagccatccacgtttgtctcttgatcctggaactttttatatttcgtcatacagaccttcctaagatcctcactttgcttgtatcattttccctagaataactattttctaaaacgcattaatgcattgattttaataacatcttgtgtcttatgtaattttaaaaatcagcatatattgactgaagacattttgacaaaagagaaagaaagaacatagcaaaaaagcatttccaactttcataaataagcaagagtatcactttcgtgaagttcttttctattttgttttgtcctgtttttttatagtgacatgtaactttttctttttctggacagcctgtcctcttggtgataataaagcatgatgataaaacaaatgagatctcactactagacttttctgtccaggaaatactcttgacttcatctgtcctcacctctgcttggaccttgtttcatccaatacctcatgccactctcagctttccaatttagatccttctcttgggtcattctcctctgctatgaattagcagacattgatcttgtcctctgacaagtagttatcagcagttattcataaatggatttagtatgttccatatccttagaataacatatacatataagcaaaaattaaatataatcttaggggtttcacaggctcccctaaatctcattcatgtacgccttaagcctgacttaagaaacgctgccatgtaatttccccttgatcctttttttttttttttttgcagatactgccccttctcatttttaactttcaccaacacttttcttgttaaagaagctttcattctctgccgctgtaattttccttacgcacatgaatatttatcttaatcaagtttctcctcccaagaacatcccttcagacaccaaaacgcgtattcttccacgttccatcagcagaaactttccttcatttgatacttgaagtccatcgctctggtgaaagcatccctcttcttgtttttcattatgttacattctttggacttgtcctcttatctatgtaccttgtaacttccatttagccctcttttctctttcaacttccttattgtagatactccttaatgttactagcatttaagttgtttttttcccccctcctttgtcagtcccaaagctcctatggctcaactgttggtgcacataaccttagggaggtgatttgaagaaattttaccgaaatgttgtatgacaaactcccaataacaggatttaagagaataccacttgttcttaccccttcagttctcttaacagggaagaaatatcataaccacataacacatgtttatatatatagatatgcccttacatcaaaataaattcttgatgataccaagatacgtgttcaaggcaaccataaaacactggaaaaaaatcaatcagaggtgaattttttcttatcttatggtcaggcagagtttaagcatgacaccaaaagttaaaataagctgaaaattgatatcattggctacataaaattttaatgcttctgtacaataaaaactgtataagtattaaacaaatgacatgtttaaaaacacagtttgcactatatattccgaagggcaaggacccctctccagcagctgtcgtccagcacatatttaacgtttccatatatctctgtcctcatcaataagatgaggctaatgacgctgcctctgcggtccttctaagaagcagatgggataaaagagtgtgcaccagtagctctaaacccgggacaatttcaccccctgagggcatttggcagtgtctaatgacatttttggtggtcatgctgggggatgctgctggcatcttgtgggtagaattcagagatgctgttaaacatcttgcaatgcttaagacatccatgcagaacaacaacaacaaaaaaatatcctgcccaaaatgtcaatagtgctgtggctgaaaaaccctggtctatacagggtggaggatgttgcggagcgtttggtacctggtaagtgctcagtaaatgtcagtcatttttacatcttattgggcaattctatgtaaatgccttgtccctaggaatatccacaggtttagcttatttttttttttttttttttttttttttttttttttttttttgagacagagtttttcctcttgttgcccagactgtagtgcaaagctgcgatctcggctcgctgcaacctccacctcccaggttcaagcaattgtcttgcctcagcctcgcgagtagctgggattacaggcgcccgccaccacgcccagctaattttttgtatttgtcgtagagacacggtttcaccatgttggccaggttggtctcactactgacctcaggtgatccactcaccttgggctcccaaagtgctaggattacaggtgtgagccacctcacccgaccccaaggttgtctcttttttcttttctcttttttttttttttttgttttgttttgttttttgagagggagtctcgttctgttgcccaggctagagtgcagtggcgcaactgcaagctccgcctcctgggttcacgccattctcctgcctcagcttcccaggtagctgggattacaggtacccgccaccatgcccggctaattttttgtatttttagtagagacagggtttcaccgtgttagccaagatgatctcaatctcctgcccgcatgatccgcccgcctcggcctcccaaggttctgggattaccggcgtgagccaccgcgcctggccatttatctgttaaggacagaacatgacttgagggacagcttactcattctatgcctatttgcttttctctctttcctcagcgcttttcactctcagctaccccttccaaacctcagctgattttactaccattcagatgtatcacttgtctcctgaaaaacacatagagcttcctttgtgaattcttactgctctacttacctgcttttaatctgtttatgtgagaatgttgtcaagatcttctagtagatcgtaagtcccttgaagaaaaagatgactttatatttattccaaaaaacccctgtggtgaccacacagcatagaaatctgcacagagcaggcaagtaacttacgtttgcttcgcaattccatcttcttaagtcgttcttgcaattgagaatgcatttctagccttctattggagctgcttagcacaagtagtgttgcattggtgtgaattcctccaacccatttaaatgagtttattgtgcattcaagtgagggttattcagcatgttcaagcaaatagtgaccaataatgataatggatattttttcatctcttcctgctccaatgggccagtattcaaaatgccattgctcacatgaaaacagagctgccagaccgtgtccagggcctcagccagggagctgccactttcattttaatttaagaaaaagagaaattgactgggaggtatttatgtaaatcagtagagttctaaggagttatctggcagccatgttaatggatgtgccactctgagaagcgaatctcgcattttgcttctcttgtcagaaggggttctgtgtgaccatttacacctacggatgattggctgtgacccagaggacatttgatgtaaaggatattttgtgcatgtcaatgagtcctgtccaggtggtgggatacaggctcgagacacatgttggagaagatcacttttgactgctggggagctatgggaagcccttccaaatgggcagaatgtgcaattactatctcagtaaatttgtctcaggagagctgtacacctcaggaacatcatatcatagaaaagggaagacaaaaaaggagctcaccttaaaagttccaaccacattccagggactgtttgtatttgactcattcatttattcaacaaatgtgaactgagcacttcaacgtgccatactgtcttctaggcactgaagatacaacagtggatatgatgggttgaatgtcggccccaaaaagatatgtccacatcctaatccctagaacctgtgattgtgaccttctttggaaaaagggtctttgaagatgtagttaagaatctgataatgagaggagcctggattatctgggtgagccctaaatccattgacatgtgtgcttttaagagacacacagaggaacaacactgcaggaggaggagaaggccatatgaatacggaggcaactcttggagtgatgtggcctcaagccaagaaacacctggagccacaggaagctgaaaaaggcaaggggtggaatctcctctagaacctatggaggaagtgtggtcccatcaacatcttgattttgcagcttccagaactgctagagaaaaatttctgttgttttaagccacaaagcttatagtttgttatagcagccacaggaaattaatacaataggctaaacagacaaaaatccctgccattgtgatgtgttcattctcgcttggtgcagacaggcaataaacaaataaaatgtattcaatgttgggttgtgatcaatgtaacacagtaacgaagcagaataagcggggaagaggtttgcttgtgagtggcatgatcatcaggaaagatgctactgagaaggggcgttcagagactgggaggaggtgagggaatgtgccgtgtaggtatgtggaggaaaagctgtctagacagaagggaatgaaactgcaaaggccgtgacactggagtgtgcctagtgtattggaggagatataaggcagcaaaggctgacaagaccagattatttagggcttttacttcaatttacccattgacttaacacttatctattgagcatgtaccaaatatattgttttacgacattcttgcaaaagcctggagaggtaggtaacaaaattcccactttaaagaggaaaacactgaatactggtccagcatgactcagctcatatgtggtggtactagaataggaatcttaatttgatgccaaccccagtgtcctttccccaacactggaatgacttatgtaaatatttatctcatttgtaatttgtctgtgtgttcagtcccatatgacagtcttgataagcccagctggcctctgaggccaatgcaaatatattttgagctgagaattgctcttgggcggtgagaggactgtagtttggaaaaggtcaagggctgtggattgccatctctcatggtgtcttcagaatgtttcagtagctttgtgactccaggtagcattgcattgataatttatctatttaactggcttaagtgggtttttttttttaattttctatctcaaaaatccaggctcataaatagggacagtatggaaaatgctgtatagggagaataaataaatgtataatcaggttagtaacatattatcattgatgcagctactgagcaaggaaaagcaaacaaagaaggagctttatttcatacccaagcaagtatagctcaattgcaaacctctcagacttgaatatatcacattggtcagtgcatatcatgtcctggaatgttacagaaagcagtaatggagagacaggtggatgaactaaaacttaacttacctctctcttcacatagcattagagcacagagaagattactacgacccttgggcatctgtgactactccattcaaaggttccttagaatgtttgctggaagcagttacagaaatgtgaacagggcttaaccagtgtactccataccctaaataattctgtataaataagagcttacatatctatgatgcctctctgtcacttcttttatattctcctttagtttgttttggggaaaattctaagtggatttgctccatgtaaatactgtacttccttatcgtattaacaaaggaagaggtaggagaatcaagacaatcgaatgtgtcagactaaagtagataataaatgctctttgggaaaaaaatattctcagtcaatgacagggaattctgatttgataaggaaattttcttgggttaatgaatgcaactgtagaatactgagtccgaccagcagaaacctacagccccaggccagctgaatcccattccttataccgtgagtatctgtgttcccttgcagcgggttttgtaggagtcagggataaagatagggaagcaggaggaaagggtcatagaatgctgccaaaggctctggaggctcaaaaggaagaactttgaattcacaaaacactatgccagctcagacctgggcatccaaatcagttaggatattggctaacagctgtaataaagaatgctacaaaaacagaagcttaaaccaaatagaattatacttcttcctcataaaccactccagggcagcaaggtaactcttcttttgaatgtcatgcaaggacccctgttttgttttgttttgttttgtttttttcccaagactgagtctcattctgtcacccaggctggagtgtattggtgtgctcactgcaacgtgtgcctcccaggttcaagcgattctcgtgcctcagcttcccaagcagctaggactacaggtgcccgccaccacacccagcaaattttttgtctctttagtagagtttgtctgtgttagtcaggctggcctcaaactcctgacctcaagtgatccgcccacctcagcctcccaaagggctgggattacaggagtgagctactgtgccacccagccaaggactcatgttttgaaaaggctgtggattatcatctcacattatgtctccagcaagttacagcagctttgtgattccaagtagcatggatggagatggcacttgtcatccccagggtggtatcctcattcctacctcctgcaccatagccaggctgtaggaaacagactgggaggaacaggagaagagcatcttccttttaaaggacattgactagaagtttctcctaatgctccctttcattccctgttgagcagagctgagtcacatggctatggcccgctgcaatggaggctgggaagtgtagtttctaactaagtagccaggtacctgaataaaacccagagggtaggagatgagattctattattacaagaagacacaatttctgccagggctttaaccggtggctctacccttcacagctggacattgctggatttttggatgattatttcattgtctccactcaaagattaagtttggaaaatagggaatttttctaccaaagcataggaactccaggccccagcccctcctcactctttctccctgttcattctcatctctttccagttccttacctcctgtaacctgtgggcatactaaagtaccaaggtaggcttagctgcaggcacggtacttccatgattcagtgccccgcccccaccactgagctaggccactcccaccaacaacctcaggccttcagatgcccaatttctgtgtagagctttgagcagtgttttccagttgtgaagggcaaaggaaattctccaattatttgtgtgttcatcttctctacctcccaggtaaaaaggagttgtctcaccattatagcttgtttcagaaacagtgtcaaattctcatcacagctcatgcatgccttctcaccagaagtaccctaattggttctctgactccaacaagagagctaggctttttgtttcttttgctttgttttgttttgatttgctcctttaaaaatgtttatggtgagctcagttatttaaaacaattcctggcagaggatttaagaggcctggcagaaattatgtaagcttgtacagtcatcttcactgataatgagtaaatcagatagcagacattaaaagattaagcactggtgtttggttttttggttggttggttttgttcacttgtttttaatgttgcaaaagtccttcatatgtcattgacaatagaatttaagtatttttgaaatgtactcagttcagattcaccattacatttcatgtccttaaggttggtagcttaagatagcttgtgcttcagttgcacaatactggcgtcagctctcctttaactcaaagctttctggtaattttcatctactggcagctcagtgggggcattttcaagtctcaatcacatcactttaatacataaacaaaaaagacccaacacaatagcaaatgaccatgagcttagtgccatcttgagtgtatgcttttagaccccagtgatgatacaacctttccttaatacagagaggaaaacaattttgatccgagaggctttctcccaggtgcatctgaaaaaacgttcagatatgtctcctgaatggttttgactaacacaacttactttcccccagaatagctcctctctaaaaaatgccaaagcttgcctttcagggacaaatcaaaggctaagcctgaggatgatggggtgacttgaaaaagactagccaagcgcttgactgctcagtgcagcctcgataacaccattcttggtggtgccatttgctccttgtccacagcccatatcccaatgagggttattcacttttgtaaccactggtttccctctgatagtgtctaaagaagcaaataatgatgaagtgagctgtacctccaacagagtttgaagctagccaggagcccttactgatgtttaaaaactggttcttttcaaaattgtggcaactttattttcagaaacaggtttcatcccaataagttatttggatgttttagaatagaataacgccatttgttgaaattcactgaagtaaggaacaatgtaatttgccactaaaattttgcacatttcatttttcttcaaaacacccagttttgattttttttgtttgtttgtttgtttgtttgtttgttttttttgagacagagtttcactcttattgcccaggctggagtgcaatggcatgatctcggctcatcacaacctctgcctcccgggctcaggcgattttcctgcctcaacttcccaagtagctgggattacaggcatgcaccacgcccagctaattttttgtatttgtggtagagacggggtttctccatgttggtcaggctggtcttgaactctcgacctaaggtgatctgcccacctcggcctcccagagtgctgggattacaggcatgagccaccgcgcccagcatgatgacttaaattctaatcatagtgatgttatgttcattgacacattactctgtgctaggcaccgtgacaggtgatctatgaatgctgtctcatgtagtcttcactataatccatgaattatatatattaacatgaaacccatttcacacgtgaggaaactatggttcaaaatggcagttagcttctccaaggttatataactcttcaggttttatccagaatcaaatctgagctctgattccagagttcttgctctgaactctattgctttcatgataaatttccctaagggctaaaaaatacctcgtaagaaaaatgtcttaaggccgggctcagtggctcatgcctgtaaccccagcactttgggaggctggggcaggtggattgcttgagtccaggagtttgagaccagcctaggcagcatggcaaaaccctgtatctactaaaaatattagctgggcagggtggcttgtgcctgtagtcccagtaacttgggaggctgagatgggaggatcacttgaacccaggaggcgggggtggcagtgagctaagatcacaccactgcactctagtctgggcaacagagcaagacgactctgtcaaaaaaaaaaaaagagagaaaagaaaaatgccttaaaattattatgcatgcaactttttctttctttcttttatccatagctatacttggccaaacaacattaagtcaggttatatttgtccttttcctcaattgttcctacctacctaccgacttacttggctattttcattcatcattaagtgattgatggatcatagttgctaagagaagacacggaaatgaaggaaatcaacccattccttcattgattcattatgtttagagagctaccatgtatgaggtattttccaggactttatgataccttaagcttacattctcgtgaaagaggcagacaataaatagtataaataacaaaaacatactatgggatacgttttaataataagaagtgctaaggagaaaaaaaatagcagagaaatgtcagggtaaacatgtattgaaatgttagatgggctgtccaggaaggggcagataacaaaggtgacctttgagtagatgccagaaggaagttaggaagttatgcaggggagccttggaaatgtgggggaattgcactgtaggcagaaagtacagcagatgcaaaggccctgaggcggagaatgcctgggggattgaggaagaactaggagaccagtggggccgagtgactgagtgagggtgagagtagcacaaaatgcgtacaacaaagtatgttatggagaaggctgtaggttagaacaggaactttaactcctaattaggtggttttcagtagacgagtgacacaaacataatgttatacttggacctttgctgtgttgagaccactgggtgtgggagatgggtggatgagggattgggaaatcagtgaggagcttaccaccgtaacccaggcagaagatcatggtggcctgtgccagaacgaggccttcctctctttctccctccttcctttcatcttcacagattattctatattagtccattctgacactgctaataaagacatgcccaagactgagtaatttatggaagaaagaggtttcattgactcacagttcagcatggctggggaggtctcaggaaaggtagaattatggtggaaggggaagcaaacacgtccatcttcacttggtggcaggaggaagaatgagagctgagtgaagcgggaagccccttataaaaccatcagatctcgtgagaactcactatcatgacaacagcatgggggaaactactgccattattcaattccacccccaccgggtcctttctaccccatgtggggattatggaaagtataattcaagatgaaatatgggtgaagacacagccaaaccagatcatagtccatgtctacttcattcaagagaatgaatgactgaatgacacttaattgggtcttttgatattagcatccagtattttgtcatcttctgagaggggctacttctggagacagtgacacagaaaaccagtgctcttgatttaagcagagtggatcagtaagaggtgtctctttcatttgtttagattatgatatttattcaaagagaggagcagtgaactgtggttgagtttgttattttaatgaaattacacttgcaactattgtaggtgtctttctatgtaatggatgctttacattctctcactttttttcctccagacaattctagacagcaggcatcatgattcccattttatagatcatcaaattgaggatcagagataccctgcaaagtctcatatggctgagtagcagtactctttacatctgaacccaggaccactctgactccaaagccaatattctctctgcatatttaatagctgttctttttaaaaaattgtatctattagtgcatatttgatggtggataatgtatatttaataaacccactgagtcatgtagctgtacaagcatttaggagattatgccatctaggaaattaaatattatcaagtgttgtcacacttgagcatgaacaaatacagactgctgggctctatccccaaagattctgattagaatggctcaggccgggtgcagtggctcacgcctgtaatctcagcactttgggaggccaaggcaggtggatcacctgaggtcgggagttcttgaccagcctggccaacatggtgaaaccctgtctctactaaaaatacaaaaaattagctgggcatggcggcacacgcctgtaatcccagctactcaggaggctgaggcaggagaatcacttcaacccaggaggtggaggttgcagtgagctgagatcacaccattgcactccaggctgggcaacaagagcaaaactctgtctcaaaaaaaaaaaaaaaaaaaaaaaaaaacaagaatggctcaggtaggggccaaaaatctgcatttctaacaagctcctaaggctgctcatgctgctgatcctggcacagcactttgagaatccttggtccacgccaatcccatcatttttgcaagaacaaattggaggtcagagaggttaacactattttcaatgatcagttaatacccctcccacctgcattaactgtaagagaaagcttgaatgacagagatgcacgactgtcagaaatggaaatgtagggtttttttggcccctttgcttgttttaattcaagagtataaaccataggtaatgttgtgctctcactttctcctgatttatctccttttgagcacttaatgaagaggaaccccactcattcacacacacacattttatttctcctgccctttttctttcctttccactttgaaatttctgttgcactttgtagttgtccagaatattttcagaaatacctccttgtgggtgaatctgctgcaaacagggctgatgaagtccctaatggttgttacccagagccctactgaatcaaaagaaatacttattttttctaaaaaaggaatcagtggtgggtttgtgaacctatgattagaaacatcctgcggggacatctacttgttcatatttaatgtcatttactagtagtggagcttacgtgcagttggttgtagcaaacagctctttggttctccccattctttaaggcgaaacttaaatgtaatttcttagcattttgtggctgaagctcaaaccagatggctccttcttttctttccagagcacttagttcacacttctaatgcgtagaacatgcaacatcgtcgcctaattttaaatggcttactcactggccagagtcatgataaataaagatggtgtggaacgtttcttctgtttcatgctcatggaacacagcacaatctttggggctcagtttactgagtatgagacagcaggacaaagtagtaaggggtgtgagcttcgaagccaagcaggttgtttggagactaggtttttctacatctaccacacagcttcactgtaggctcagtttctccctctattaagtggagaaataatagtaatatcacacagagttgtaaaaagctcttaaaatgatgacgtcatgcttgcaaagtcttagcacactgttcagctcatggaaagggctgaataaatattaaatataaaccagacctcatgagcacattcaatccccagggaattagtctgaaagaaggtgagccctcaacttctacaagtagtgcaaatcgaaagcccttcctctcacatatggtaatccccaggggcttgtactgtcatgacccatgttgcttctgggtcctgtgcttgaaaggctgtctctttccccatctgagtcaaccgggcggtaaaacgtggctcctgtaccaggttgcacaagaaacatgcatacacacatatcactgagcaaggtgaatgccactgagggttcggggaccaggggacacctgtgtgatcttctaccacctttccggccctttcctttcttcccttcttcttctactcccagttaagctttcattttccaatgctcttcagcaatcgctattttactctcccaaacttctacagccaaacccagcaagtgttcagttcagcagaacaaagggtcttgctctttgctggatctacctttctttcttagaggggagttggggttgaacaactgtttcgttcattacagctattattaatattttcaaagttattattaatgaaagagtgagtaacgctgccttattctccttttatttctcacccactctttttgtgttcagatcactagattttaattttacgccctttccccagcccaggactaggtctgtgttacccaggaccatttgaaagttgaaagaggaactcattggtgatacactggcttaaaaaactttaggaattcagaaaactatccaagaataacttataaaattacagatgaaatatgtgttatagtttaaacacaatatttttctgagttctttggatttttaagtacttaaaatacacagtgactatctcttttcaattttccaaatatagcatctaaatttagagagatgttaaaacaatttgggggttgtttggtttctttcctttttttttttttttttttggcccctttgctcaaagaaatagtgctttgctttcttctaatgaagtaagccctggtccaaggaaaatataaaataaaatcgctattttcctaccacctttgggctatgtaattcccatttcattttccaagaggctaaattttcaaatggtttcacttacacagtgcagaaaaattagacatcttcgtcatttgggggaaaataatgacagactctctacaagaaaaaactatatatatatgacaaatcatattaaaagataacggatcactttaagtatgggaaacagaccttgaagacaaacagttttgcacccgaacttgatctaagcatgattcccagctaattgtttggttctaaattaaattattccttttgataccgaaattatagatacagttccatttggcacttcagggtatatttattttctctgtaagtgcttgtccatatatttaaagactacagataatggatttttaagtgtatttaaaaagttaagcctcttgagaatttattttaaatggaaaatatctcccagcagattgtaatttaaaaaattaaaggcaatacaatacacatgcatagagataacattcaggtgtttgtgaatcattttccccactctgctgattgtctttgtggttaatcatggaactgatggtgcagaatacactgtggatgagtttacttgcctgagcacttaggtggcttagagcagatctcttgcaaaatgcgagaaaaaatatgaccttggcctacagcagtgatcaacaaacttattttgaaaaggattagaaagtaaatatttaaggcttatgagcgagatattctgttgcaactatccaactctgctgttgcagttcaaaagcagccatatacatgtaggtgaatagtgtggctgtattccaataaaactttatttacaaaaacagtagtgggccggatttgacatgcaggttgtagattccagactcctggtttggaggcctgacttcacaactttgtgtcatcctataggagtatgagttcagctcctggattcagcatctcagttaggcccactctagtgagttagcagagcagccttctttacgcagctgccataaacaaaccaagcaagccatgaagcccacgcttcagtgtcataatcacatttcccttccacatgatctgtacacacctcaaaccccaatcctcacaagtgggattaagagcctcaggaagagctccaaataaatcctcttctcctgtccatctcaccacagaaaagcagatgaacagaaaatcagaaagtcagtaacttgtctattcctcagagttagatgtcagtgtgatacctgacatagagacaatctgacagatcacaaaagtctgattcatttataaaatatctggtgagtggctactgtttgtcaagctctgtgctagtgcgagagatacaagggttgctgggatggcccggtctctgcaagaatggaggttttattctagtgagagagacacaacatagggaggaatccaaaagacagaaggagggtttgccctgagtttcctgttggaaattgggactctggtaagcagctgtgtgataacagaaagaaacatcagcctcatctgtataagcacgtcttcattcaataaaacacatataacaggcctttgctaaacactcgaggtaaaatggcaaacaagacactttcttccctcaagaagttcacagtctgataaggaaaaaagcaaaaagaacaagtaatgacaagttgaactcctgaatattctgacagatcaggcaattcacacacacaaaaaaaggaaatagaattgccgatattataaaacaatctctaaccttcccattcattgaaaaattttcaaactaatactacactctcttccaaccatcagattggccaacaaaaataaacattgtattatcaaccgttagcgtgaggagacaactcttagagcccaaatcgataaaaaaaaaaaaaaaaaaaaaaaacttagcatctaactaaattttaactgacgtttcatttgaatcagcactttcagaatggctctgaactacttaaatatatgtataaaagccaggtataaaggtatttgtggccgaccatggtggcttatgcctgtaatctcagcactttgggaggccaagacggatagatcacttgaggtcaggagttgaagaccagcctggccaacatggtgaaaccctgtctctactaaaaataaaaaattagccgagtggtggcccatgcctgtaattctagctacttgggaggctgaggcaggagaattgcttgaacctgggaggcagaggttgcagtgagctgagattgcaccactgcactccagcttgggcaacagagggagactccatctaaaaaaaaaaaaaaatatatatatatatatatatatatatatatatgtatatatatatatttgtatatatatatgtatatatatttgtatatatatatttgtatatatatttgtatatatatatttgtatatatatatgtatatatatatgtttgtgtatatatatatgtatatttacatttactactacacagttggtaattaatgaaacggaaaacctcagtgttcagcaatagggaactgctttaatgagagcagatagatccatactaagagataatatgcagtcataaaaaagcaatctatataaactgatgtaaaaagtatttaatagctattaagagaaaacctacctactgaactgtttaagtgtatatatagcttgcaaatttggtagaataatttaataatcaaaatgtgtggctaatcggggaagtcagggcttgttgagatagtaacaggctgcatctcctatttcacttcagttgattccatttttaattatttttgtattttaaaatgactattaaataatatgagttaaaggatgtatacctatttaaagactatccactgagaaatctcacccttaattctaaagggcgctgcaattcagtgatcaatagaatgaccaaatctccaccctcaaagttccttggttattttgaaaaccgtactgctaaaaagagaaaaaaaaaagtgtcattcttttctgcctgatatcttcccagcatatgtaaagtagtattcctggtgatagtatctgaaaatcaacataatccaaaggtcctcactttgtaatgtttgcagtaagattccagcatcttagcatttaactgttttcagattacatccatttaaacatctgtgattcattatcgtaaatatcacagttgtggggaccatatgcttcagcttgcagcatatatgtgtgtgtgtgtgtgtatgtatatatatatatatatatatatatatatatatatatatatatataaagaaaaagcacgagcaataaatctcaggaaccttagacttgccgtgggtatgtgcaaaaagaacatttccaaacacatggggctgtctataatcacagtaatgtacttgagatcccatgtaagaattattcaattgcaaaagttgccacttgtgatggaaagctatgatttacatttggcttgtgcacttcccatgataattcaaatagggtggaaagcagcacaaaagccttctgctgcattggcttttacttcttaaggaaatatgtgagcgctattgttgtcgagtggagaaatcacagaaaaatgagatacctttaacaagtggcaaggcactcttggcaggcatccttcattcccatgagactggagctagagatgatgccatatggcctaagggatgtaataaaaatcacttggccactggaggatgaataggcatggcctacagggctgattattttcttgcttacaccagaaaacccacgtatgcacacaagaattaattgtgcttcatgtattgtaagccaaatcattgtcttttaatttcctgataaagtcttgtcaactagacagaaccaatctgtaatcacagctgatgagtatctcacacactgcaattagggaggaggtaaatgaattaattggttacaaccaaaaggagtctgctaatattttttgattgccaactctcttctagggctagcaccaagcctagccagagatatggagataaaactgtaggaagctcttgccctcaaggatcttccagattaccaaagggcaggttaggtcaggagaaaattttcaaggtgtggaagctggccttctgcagtctgctgcagtttgattggcatccctgctggttattatcaagccaccaaccttgtcaaagccttgtgcattccctttaggaaggagatccattgttgccttagatggtgttcttgagcccctaaacactaccctgccatctagaaacatttctggaccctgtcctggaatcaaggtagcacaaggccatctctgcttagaagcattctagatatccacaaggaaggaaggatggggtgtttaaaatgcttttggatctttttgtacaaaagatgctcatctacatactggctacacgtcatttatgacatttatgaaaaccaaaattgacattctgaagtccttggatcaaatttctgtgctgttcttttctcctccatggtgttttatttgatgcgatcttgggatgtgtgatgacttcgtagtggaatagcaggtgttgatccgtaggaacttcaaatctcaagagttatttgataaaagttatagacagatcaatgatagcaaatttcaaacttatgtttccccagtcattgaagaaagaacactagtaacagctcttgactacatttaggtgttcttgactatctttaatgggtgcataaggatttgcctgggccccattcattcattttccttgaccctcttcagagcttgagtgtttcctaagctttgacacacagggtcttctggcatctgctgtctggatttttgctgatggatttaattactgacttcaagattctactcaattccattttgacaccttttttagctcaagacacagactctttgactccctgttatgtcctgtgctgctaagctgtagaataacttcgaacatttactttggataccatcatttgaaggaatccactctctttcccaaggacctggaactggattctatattagttgtaaaaagcaatccagctttcctacttacagatgtgtgaccttaagaaatgttcttactctctgagcttcaggttttctcccctaccttcatgatactgttggagaattgaaagaaataatgtttatcaagtatttagtccacggactgacatatagaaaatgcttcataaatggtaggtattatatatgatagacatcaaacatgaaatactattagggctctgtactattagcactattagggttttgtagagtgacttgaatatatagggaaacaattcatgtaatccccaaggtgtgttcatatgaaccaacacgctttgatgccacagccatttataccagctggaagagtgcagaactaacataaatgatgtcctgctagcatctgcagctgggtcataaaccaaagcttaatgttttacaaagttttgatatgcagtagtcaatttatccatttttgtgaatcaagtaggttgggaaacaagcccagcaaaacacagtttggtaaattttatgtgaaaaaactctcttctttttcactcagtaatttttgcattttaaaaaaatacagtaatcaaaagaaatatgatgggccagtgaaaagcctggcctttggagtgtggtgaacctgagttcaaaccccagttctacaagtaaacctttgcactatgggtggctcagtctctcccagcttatctcattttgcctctgtaaaatggttgaaatatcggattatggggattggagtgaaatggaacactgacccttcaacatgacagccctgccaataattatggggtctaagcttctagacgctaagtatcatgaaaatagatgctattccacattcacctttagttgccgtttatcccttactgcctactgtcttgtacattgtaagtgaaaaaatgatgtttttaatgggttaatggatgagtatgttgaactttagaataacagaatttcccagttgtaagagacatcattcaatgctggaattgcttccacaatattcctgatgaagtcatataggttccacttgaaagtacccagtgacaagcacattatttcacccagaaggaactagatcttccaaatggtaacctgaattgctttaggcccctccagtatggtcatgcattgtttaaccatagggatatgctctgagaatgcaccactgggtaatttaatcattgttggaacatcacagagtagacttacacaaacctagagggtatagcctattacacacctaggtgatctcttacaacctatggctcctcggctactaacatatatagcacggtgctgtactgagtgctataggcaattgtaacacaatggcaagtggttgtgtatctaaacatatctaaacacagaaaaggtataataaaaatatagtctaaaaggtaaaattggcacacctgtatagggcacttactacgaatagaggtggtaggattggaagatgctctgggtgagtcagtgagtgagtggtgagtgaatgtgaaggcctaggacattactgtgcaggactatagactttataaacactgtacacttaggctatactaagtttataagaaaaagctttctttcttcaatcataaattaactttagcttactgtaacttttttactttataaactttaattttttaactttttggctcttgtggtaacacttagcttacaacacaaacacattgtacagctatagaaaatattttctttatatccttattttatagacctttctatttttaaatgttttctctttttctttttcacttgttgaacttctttgttaaaagctgagacatgaacacatacatttgcctaggcctacacaaggtcagaatcatgaatatcactgtattctgcctccacattttgtctcactgaaaggtctttaggggttataacacgcatggagccatctcctatgatatcaatgccttcttctggatacctcctgaaggacttgcctgaggctgttttacagttaacattttcttttttttttttttttttgagacagggtctcgctctgtcacccaggctagagtaccgtggcccgatctcagctcactacagcctctgcctcctgggttcaagtgatcctcctgcccaagcatcccggttagttgggaccacaggcaccagccaccccacccagctaatttttgcatgttttgtagatatggagtcttgccatgttgcccagtatggtctcaaactcctgggctcaagcgatctgcctacctgggcctcccaaagtgctgggattacaagcgtgagccaccatgcccggccagtaaaccttttcttaatgggtagaaggaggagtacactctaaaaaaaaaaaaaaaaaacaataaaaacgatagtatattaaatatataaaccagtagcatagttgtttattatcattaccaaatattacatatggcacataattttatgtgcttgacttttatgactgaaagtgctataggtttgtttacaccagcatcaccacaaacacatgagtaatgcattgcactctgacgttatgacagctacctcactaggcaataggactttttcagctccgttatcatcttacgggattgctatcatatatgtgttcctctgtagatcagaacatcgctatgtggcacatgaccgaatttggacaaatgtgacgtcatgcaaatatgaatatttgcattgttctggcttgtagccccacacctgcatagctgtaggacctcaatgtattctccttcctggccttttattctggttatttctggaagacctcagggcatctgtcacatgaattcacaaattcttcttccatgtcctctcattctggcctctttaattattaacattcctgggaaactcttggaggaagggcctccccactgccctctgtgggaaaagtccatctccaggatccccaaagccatgtacccctcaaggtgccaacagaccctatgactgctctagtgttctctctaccagaacaaagccaagctgtactccactcaaaaatggggccaccctgctgctcagcataacagtttgctattaggaaacaaaataacagtgcttgaaaatacctaagttgtctgtggtttgtgaatctttgagttgtgtatgtagctttcttttctctgaactatggatccatggggctggcctaggaaaccaatattgtgttcctctctctctttctcctggttctgcctccctctctaggtgctcatgcagaagtagtcctcctcagaggcccccttcctccccaggtatatctgctcttgcaatagagaggtaactgggaaatcacgagactgtcaaggcatcaaaacacaatcagggtctgaatcccaatttaggcttagccaggacactttgtcacatgtccctagacaaccccaactgcaaggccaaacaccctgaaagttgcagtggagtaaagctctcttcacattaatttacccttgagatgcacattcagaaggagacttttacacataattgctataaagtttaaaaactaagggccttgtcagagacgtgtgccagtcatgaaaataccaagaagggatctctgtaaatccgagatttggtgattctcaaacttgctgaatccatgatttttctttcgcttaatgggtgactttcaaatccacttactcaaatcttcacttgagttgatgccatcattctcagttgtgtttggggagtttcaaatctgcttagctgccaagttgcagttctgctatttattcattcaacaaacagggttgagtatgtactgtgtcaagcactgtgctatatataaagtaattccaatttgaaacacaaattcgtagtgattataaccaccatgggatagatgatgcatagcattctatcaggaaacaacctgccatgttttaaggaatccacggcaagaggagaacgtaagactgacacacatacaaaacaaagattcaaagctaacggctcagtttttaatggtaggtggagaaaatcccctgaaagcagatgtggcctctgtctttttccaagaggaagcccttaagggttacatggcaaaaataggtttctgctgaagattgttggactgtatcattcattatgatatcttctgctgacatgatagaattgaaactctattttatcaaagttggaactgaagcatggaatggaattaagactgttttatgtttgttctgcacttaccaaattctataaagcctttggaagtgaaattcactcctgggtcaaccagtcatggctagaatactcccagaaccttatagaagctctgcaatgtcagtgctgactctaggccaaacatggaacacggaagcccaatacgcatgttcaggaagcagaagagtagaaataatcaagtctgtagggtgtgcttcttgattcactcatggatctgacccaatgtgggtggaattgaacgtatgttaatgaaggcttgagtgactagaatgctggtgaaatgagagtattcaggaaagtcaaaagaaatgcttcctgtttcttccatttggaccagtctaaagagactctggactaagccctgtgagtgctttaaaaggaaggtggtgcctctggatgccagtggcatactgagggatatgaaaagcaattaagtgatggcctgtatcctggaaagagtctgtctgatatttctgaattaaatgctactttagttgtcagaaagacattgtcatgccccagcaaaggctttgcagattaaccaatatgcaggaccttcatgctgaggaagaattgaattctgtttttccaagtaggcaaggaataccaggatagctgggtctctccatctcaggcaaaacagacaatctacattcttatgctctggggcagttcctatctgtgtcatgtccttgagacagctagtataggtacttctgagagctggtaaaaattttagaaaagttgcaagccaactgaaggcacattggtaccttgaaataaacaacgtgtagagcatttaaaccacagaaatcggcagatgctacaactcgagactttttccaagactagcacatcactgcaagtccttctcttctgtgtgtgcgtatgaagatcctggaggtggatctgtgcatatctgtctgggggagggctacaacttccagggtgactgattcagagcctgtaattctgattcatatgcatccttgcacacatgtacaagtggaatctgaccatccactctgaaagggccccacaacttatgtgcagacacatttgcaaagcctctacaaatacatgcaaactctaggacaatttacccatataagatgtgagtgtataaatcacagattggcccaagcacgcttataagaatagcacaaaattcatatattagttcatacctagctctgcaagcaggactgttctatatttggcagataagtttaaatccatctgcatttcattttttctgggatcataacagagcttaattttctcccttatccatttttagatggtaggaaatctatgccttttggattttcatccccaagaaccaccttcaaaagaaagaaatggaaaagcataaaatcaaggtcgggaagattaagccccttaattcacatgtcaaacttgccatttcaattgtggttttgtctcccagctgaagtttgtctttttgtgacatttgcattaagcccaggggacattttgagtggaaaagcgctgaaagcataattgaaactctgagtgttgccttttgtctaatttgcaatttcccccaggtggggtgttttcactaccccccgactccaccccgccctcccagggtgttctaagattatctcaaagaatgatgttatgcaatttattccaataaatctccatgtacagtatcttatatgtgtatattttttgccttccagaagttatttcaaatccgtgagaaactatgtagggaagtcattcataggttcagaagagtacagatagttcatttcccctttcagatagaggttttgagtatttgttcacaagtttaattgtttagtcacatctttcagttatccacatggtgtcattctgagccacccaggaagttgtctctatagaaacaagcattttttaaatggacataaactgttcagttttgtccttaaatatgtctttgaactctgtgctcaattcacatatggtcttgatatctacttaaaagtttgagaatcactgacactttggtggcatcaacaaagtcaataacatgaaacacaatgcagggctgatgtcatcacatgcaccctttaataggaaatttaggatatgattataattggtgagaatgtagagtctgttttctccaggagaaagaagaaaacgtaaaagaaaatgttgtggcttgtttttcttttgagtcaatgtcttcctgtttatcagagctgtcctttagatattgccaaagctatggcaacaggagcaatttagattttgccctttctagaatttctgtttttatcaagacttcattatttatattaaataaattatttcttatctgatatttggatatcatagccttcctggattatatacctgagtagagtggatgcaggcatgaatttgtctaactgagggttggatggcaaggaatgtagtaccagccagcatttccagagggtacaacaaacgtcactgtggaggttttagtggatacaaggacaaacttttttagtggatacaaggacacacttacttcttttgaatttggctctttagatttattttaatatttatttgaaaaaatacctggcatattcaacaggtattataaatactacattcaaataattttataatttaaagggtcagtcagttaaaaaatattaagtaaataatcgatgtggtatgagaggtggcaatgaaattgtgagtctggaagctgaatgactaaaggaaagaacacattcatctagaaagactggcatagccctcaggagtgtgggctctagaaccagaaaccacactcccgagtttggatttgacctcggttcatataatgacttcgtggcctcggataactcatgcaacctcactaagtctcagtttccacagaacaccaaaagttcctacctcaaattgatgatgtgaagaagacgacatgaagatttattgcaatcattagtgtaaagctcacagtgtaatgtaatgtcattactttaggaaaactcttgccttacatttgtacgaagttgtcttcaccaacaatccgtttggagaatatcgaacaaaactttgttgattctattttgagcagggctctgtaatttcactcctttaatatcgtttttccttcacaactgttcacatgaagtacgtagggcttcaccaaaacaagtgaagggattcaacaatgggcaagcctgaatcagaatcatcagccccacccctttaaccctagcagtgatgcctgtagtaaccatttccatggcaacagcctgagactagcaaggtacctgactagaaggaatgacagaggaggaggtagaaaaatcagctggaagaaggaagctgtgtaggaaaaggaaaaggtagcttccttagtgcccagaattatggcaataatggtgatcattctcattcatggagcaacaagctctgtcctaagtgctttctgtgtgtaggcatgcattatcttgtttacacatgccataaggattatagtacctttcaggaggatgcccactctatggataaagatgtcgaggattaaagaatataggtggtatattagtccattctcatgctactaataaagacatacctgggacagggtaatttataaagaaaagaggtgtaattgactcacagttcagcatggctggggaggcctcaggaaacttacaatcttggcagaagggaaagcaaacacatccttcttcacatggcagcagcaaggagaaatgcagagagaaggggaagaatgcccatcagatctcgccagaactcactgtcacaagaatagcatggaggtaaccactcctgtgattaaattacctcccatcggcttcctcccatgacacacgggagttataggaactacaattcaagatgagattttggtggggacacagccaaaccatatcaggtggtttgcccaacgtcacagggctcctacacacaagccaggattagaaaagggcttagaaacctacccttaaaacttccctttcttggggcacggaaataacagttgctggcatgccagtccccaacctctactcttttccaggaatggctgggaaatgtggagacctggcaccttgacaaagagtttataatgtaaggtcctggttcctggctctgtctgcattagattaatcagggggagcttttaagagatactagtgcacacagaccgcaactcagcacagttgtatcataatcttgggagagagtgggggcaggtattgctattctttttaatgctccttcagcatttcttagatggccagccttgagaaagaaccatggcctaaagcacctactcctgagttggtaagtggtatcaaaaatatacaaagacccaattatgcaactgttagctatttgatttagaaagtattgagtgccggtgatgtgccaggtcctgaaactgcagttgttctcagtgtgacctcacttggtacctctgatgatcccaaaggggtttgtgagatgcccaagggggccatgttggggcaactgtcctttctccacttgcccatctattcctaggaagcagatgtgcccagagcttgggctgtagaggcagaatgaacagatcagagaaggttctcgctctaggcctttctggatatgggaccacgagctagtcagtcaatctctctgagactcagtctcttctcctgtaaaatataatatgatgcttatatatttatagactgtgcattctcattggggctatatttcccccacaggggtgaaataggttcgagggtggggggacaaaaattgcacttacaaatgtaaagtatagatatacttgtagtacctaaacagatataagtatatctgtgatattaaaattttacaggaatagtggcaattagaaaaaaatacttaaaagagcccttaggggagtagataatgaaaaaaacaaaagttaagcaaccctgctatagaattgctatgaggctgaaaggaggtatggacttgtacagtcctttgcatagagcgtagcactcagggaccactcaataaatagtagtgccatgactgttgtctgtccaagcatcacttcattcaaaatgcacacactgattccaaccattctttggggctatgcaagttttactggcatctttgggacagataaggcaccacctctgacttcaccaatgagctaggtcagagctaagcagagcggctgagtgccattctaaatggatacacacggggtccaggggccaaggggagagcatagctgagttcttcatttccttgtactccctgctgctgggttcaatgaaatcaagaggtcactacgggcctcttatcccaattcacagccttgtcggcagcctcttgctcacagcacagaagggagaccccccccccccaccgccccgcctccaatcctctaccattactaaatcatcattttgctctggagagtaactgagcaaagtggaattattactgatggcctcccatgtggaaaaacatgctgttcattgctgaagatgtaaagatgaatgaaagaacaagactcaatttctgctcttggttctggtgcaaaaaacaaatacataatatggacagattgatataatataaaaggttctatgggaaggaaattctggaacacaaagagaatgcttgaagaagttgcttgagttgaatcttgaagagtaagcaagagttaacagggtgaagaaggtgagaaatgccttctgcagagagggagcactatacacaaagggtgggacagtagagtagggagatgcaagagtgggtgaggtgtgagctatgcagtgaagacaaaggcagaggggaggctgatggacagcctagtcatggaggaccttgagtgctaagtattgttttgcaatgaagatccataattatatgagactcaggtggagaaaagctggtcttatagttgcaacaggagaatccaaggcttcctccagggagcagagctgtgtggcccccagtaccccacattgcctgggcttagcttatctccattctaacttccttcaattctcccttgctgtctgtgccaatctaactgcttacatccagttcggtagatgccgcaggactttgcatatgttatggttttctctgcctaagtaataggtccccaattatttataagagtagtaaattgatgtctgtcttccacattagacttcaaactagggactgtgcctgtctttgttcaacattataacctcagcatctagcataatgtaggttctcagtaaatatttatggtaggaagaaagggtgggaagaagaaacttagctgggaatccagaacccccacaaactttcatatgccttttcctctaccccattcactccccagctgagactgtcttctgtgatcctgttcgagggttaagtctggaacctcatgctggcgattgaagcagtcatttcctgtgaggccttgtcatttgagtaatttgcctccagtggatgaatactaattgatgataacagtgaaagcaaccttggtgtcacttcttcatagttcacttccaaaaactgaaactaagcatgttcaattcatctgggctaccaacatggttagagaaagtgagcaagtgtctgagaaccgcagggtcctgagagtccacttgtgtgtccatgcaaagatggctctaaagctgacttaaccacggaaagccttagaacctttgcagagcgatcaaaaggcaccgcagcgtgcagtgctcttcaggactgggcaggaacatgaaaacaggactgagcagggcaatcacagctctctacagtagtccctgcttgtcctcaggggatgtgtcacaagacctacgtagatacctcagtccgtggatactacccaaccctatatatgctaatttgtcctatacatacatagctatgttaaagtttaatttacaaattgggcacagtaaaatattaacaacaataactaatgataaaatagaacaattataacaataatgaaaatggcacacaatttgaaacttatgaattgtttatttctggaatttcccatttaatattttcagacctgtgttgaccatgggtatctggaattgaagaaagccaagccatggagatgggggaactactgtattcaggttttgataggatttcagaagggttgtattctccatggggtattgtctttattgaaaatgtgcagtggtgacaggcaaatggtccagggttcaaatcctggctcatcatttacaacctgtgtgtactgggcaccaactttgcactccatgagcctcagtttccttatctagaaactgtaggagaaggggatcaaaatagtactttatttgttgtcattgtaaagattaactaaggtgatgtgtgcaaagtgtgtagcacctacccttgaatgtggaaagtgctcaatctgcattatccactattattatcagttaatatgattattatcaccctaagtatcatcttcccagagtagaaatatcagtttagattttcagatatttatatggctttcacagtgtgctaggacctatgtagatgagcttagattctcagatatttatttggctttaacagtgtgctaggatctatgtagctgttgttaccaaaagatgtacacaagaaagttcctagcaacaatatttggagccccaaagtggaaatagtccagataccagtcgagagtaggatagataaagagactcaatacagccacataatggaatactctatgatgattaagataaagataaatatagtaacctggatactatacagtgatcagtgattattgttatagtgattagaataaactaccacaactcacagccacatgatgaatctcgtggcatgtaatgtcgaatgaagaagccaaataggagagagtgcatactgtatgaccacattagatgccatgcaaatgcaggtaaaaccaatctgtggtattagaggctagaataatgtagcctctggggaagaggttaggaattttactcaggaagggaggggactggtaatgtgtcatgttatggcctggttgctggacagttggttgtgcttactttgtaaaaattcattgggttgtatgttctgatttatgtgcttatatgtgtctacattatgcttcaattaaaggtttactaaacaaataagcctgttcagcagagaccaaaaagcacgtagtacaattctatgcttacccacaaggggcctcaaagtttacaggaggaggcagacaggcaaatgcatgcacagataatgagttgtgatacccataataatagaattgtgtaccacatgcagaatcaccattgaggggagcatgatcagccgtcacagcctctgcttgtgtcaatgccctgtgctccatttgttcatgcagggggcccatcttccctattccttcccacacatgaataaggtattccatggcaggaactttgctcacatctgtccactctccatatcagcaccactgccttcattttgtacagccatctttgatgcaacactgaactcgttggaactgggtctcttggcctctcttcctgcccttctttaaatcacttgctataacccagatctgccaaattataatcattgtattgggtcctctggattcttaaaaagtaccctgtgggccgggtacagtggctcacgcctgtaatcccagttctttgggaggcctgaggtcgggagttcgagaccagtctggccaacatggtgaaacccccatctctactaaaaatacaaaaattagccaggcatgatggcatgcatctgtaatcccagctacccaggaggctgagacaggagaatcactggaacccgggaggcagaggctgcagtcagccaagatcgcgccactgcactccagtctggatgacagagcaagactctgttaaaaaaaaaaaaaaaaaaaaaaagcaccctgtgtgattctgatgcaccccaatccttgagaagcactcctcttcactggaagcagagcacacacctgatcttgactctctccacacaacaaatcgtccagggctaccagaaagcaccataacttactggcttttcccaacttgtttcccagagacattttcagcctcatttccacccttcccttctagatccccaccattctagattcccaccatccctgccccgttttaagtttgcctctattcacctaaaaacatatggactattccatatggactgagcatgaaagaaatatagttcctcaaagtaaattaaggagctgttttcagaggaaaggaaatggatggtggataggcaagaaaatgtggcccactagaattctatatggtgctgcatattgtgctgtatacatatatggtgcatgcgtatgtgtacatatgtgtacatgtatacattacatgcacatataccatatgtgtgtatatggtgctgtaggtatatacatgcgcatgtatacaccatatacatgcgcatgtatacaccatatacatgcgcatgtatacaccatatacatgcgcatgtatacaccatatacatgcgcatgtatacaccatatacatgcgcatgtatccatgcgcatgcataggcatgtatatatatgtatatgtatacacgtatatggtatatacatgtacatgtatatgtatacacgtatatgtatatacatatacatgtatatgtatacacgtatatggtatatacatgtacatgtatatgcatacacgtatatggtatatacatgtacatgtatatgcacatcgttaattctcattccctgaatctgttttgctatttagccctcatccctgtgcctttgaatagcctataatgtcttccacattcttaagggccttctcatctcctacttatcttcaatacccagctcaaatattgactctgtgcagctctcctcaatggtcctgagcaccctgtggttctgctcagtcacccacacatgccaggattagatcacttccctcaaatgtcactctgccagatctgactcttcactccactgagaaggcactcaagtgtgcacactcagagcttagcacctgcctggaacatgcgagttcgtcaaggacatgtcttgattgagtgaagtccatcagcacaaagtcacttgggcacaggcatcttgctgtgggataaaacgtaacatttgtgaactctgggttgggaaactatgtggtaattcacacttaataggtcagagatatctcagagataagctgcccaacctactcatgctccttctgttgtttcgtttgtttcccagtgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggtaacacatctgtttgagataacttgggttcaaggaggacattaggttctgtctgtcttatgtggaaaatgggtctttaatttattatgttggctaagattccttttgttattgttgttgcaaatgacagaaatccaactctaaaaatgtagatgaggggcagcgggaattaattgattcatgtaactaattgaggcatagttcgtggattaattcatggaactattttagggatacttctgccttcaggcgtggctgaagctgtccaaatcagctttaatccctgtgcatctcgtggctccattttccttttattagatgtattgagacagtcacatctctccctgcctcccaaggtggaggtctcagcaactaccctctttctgctggtctgaagtcgcctgagaaagcatctcttcaagacgatgctagcaaaaccttggaattcagtctcgtaggttagatcatgtgtccacccctgaactaaacatggtgtccattgggttgtgatgttctggttggccacgtctcggtcacatttcttttcctgaagccagggcagagtcagccctattcacctgaaaactcatggactgagagtgaaagaaatgtagttcctcaaagtaaattaaggagctgttttcagaggaaaggaaatggatggtggatagaccagaaaaggtgacccactagaattgtatatggtgctgcatattgtgctgtatacatatacggtgtatgtgtatgtgtacatatgtgtacatgtatatattacatgcacatataccacatgtatgtatatggtgctgtatgtgtatatgttgtacatgtatgtgtataccatatacaggcatatgtaccatatacttatgtgtatatgtacacatacatatggtatatgtgcatgtaatgtatacacatatgtatacatccacatttaatatatcaaagatatctcaaagctaacctgcccaacctactcatgctcctcctgttgttttgttttgtttcccattgaccttcagtgacttcagtatatctatgtgtgtatatgtatatatgtatatgtaattgtttacggttctgtatatatatacggtgtatatgtatgtctatatgtatacatttgcatttaacaggtcataggtatctcagagataagctgcccaacctactcatggtccttctgttgttttgttttgtttcccaatgacttttggtgacttcagtatatatatgtgtgtatatgtgtatacgtatgtacaggcatacacatactatatatgcgcatatactgtgtatatgtatgtgtgtatatacatacacatggtatatctgtattatatgtgtgtgtaattgcatatcgtgcttctcgtttgccaggcagcagtgcttgttcccttccacaggcacatgcatgcagatccctgcactcccacacatatgcatacactttataagtgtcacaaactgccattcaggcttcccgattgtgccattcggagactttttgctactactgactcctgccttcttcaccaggagctcagggactccaccttcgtgagaaaaggagggcaagacacacagcaggattccagccaaacaatgacttaatgatggcatgcccctgcttggcatgcctagccttctctcctacctgcgagcttggtcttcctcgatttttcacagcccctaattcacatcccttttctccacctgccatattagccacatccctgcttgatctactcattttgttcagtggtggagcgagtgtgggtcacacagctgggagcagagacagtacaactggcaatgtgagagttaccttcccgccagtgctgtctgtgtgatcttgagagcatcatatagcttctttatctgcagaatagcgaggttaaacagcctgcagtggcaaataagtggctcatgtgccaccctactgtcaccgtgctcgtggcagatattgctaataacccctggcttagcctgagtatccttctcactgcaatgcttctggaacctactatcaattgatcatttagtggtgtttctgagggtggaacctatctgccattcctgggctggatgaacttcacaattccccttcagcatctgtgaagctgtgagttaaggatagatggcaacctaaaaacgaatgtacggcacgtcagtcatgtttcagaggaaactggatattggtgaattcataccagtgtggaaatccattgacaccacaaaggcaagcttttctcttacttagccatgaccaatggtcacagcatctcactaatctgtgatataaattatgtggcaaatatctaaagcaacaaagttgccaggatatacagcaaaaacaatgttccatagaaacatggaaatggtatggtgagggggtttgcccatgggcttgaatgcatttagatggcgattgttcttcgtgaatggtggctcatctttctatctggaaaagatactgtcatcgtattttgcttcaaagagagcagaagatcttctgggcaggttctcgggaccaaccccaccttgagggcctgggagagctgggttcattatgaaaactcagccacgcattgtttgtacctcaagtttctgtgagatgccatccagagacaaagctcccctgagtcctggctgtttctcgcttgctgctgtctgtacgcattttcgacaaaacttgcctgtgattgtttttgcttcttataaagggggcggaggctgccgtgtccttcagtttgccagacttcagcagaatggggcattcatctcccacgtccagtaattttatgagatttgaaaaaaggctttgtgaagatgtgtagctgtgtccttcataaaaacgcctcaaaaaaggaaaaaaaaataaaaagaaaatgaaggaaaacaaaatagatagcaaaagaatccctctgaagagagcacatacctcaatggatatgcacgtggtatgtttgcaggtcctactgtgtgcagccaagtgggccagctgctagagaagaaaatcagtgagtgcctgagtcagctcagctcctgttggggagggaatacgaatgtgtgcattgatgcttgggtaccaggcggggagctaacagtgatggatgatctctgcatttggagaggggagaggtcaaggggagctgggctggtcctcaaagcaccaaccatgtgccaggtgttgctccatgggctacaaatgctgactcacgtaacctccttagcaactggaggcagatgctactgtgttctgcctcatagtgagtttttactgattttactgatggaggaactgaggcacaaagagccaagtgacatttccaaggtctaaaaatgaataacaagctggatggaagtgagacttgagcctgggcagcctggcccctgagtccgtgcctccaacccctgcatgagctggactttgaaggacgggtcattgtgcatagttgggagggtctacgagggaaatgttggcctgtcttcatggtgtttctcttctaagctgtgttaccttcagtcaattgctttacctcctgagcctctatgtagttttgattttttcgtctgtaacatagggataatagacttgtttggatcttcctgtggattcaatgagacgatacatgtagcagtaatgtatagcactcagctgatgctacagcaatgaccaacactgatgcttacgtaatacttactatgtgctaaaccctgggtttattcaagtctttcatcctcacaacagtatgctaagggaagctgttactgttactggtgctgttatcatttgcatctactgggtgaggagactgagacacaatggggctgtttcttgctctggacacttagctagtaggtggcggaagagggcctcagaccttagcagcatggctctggctctggagctctcctctttttttttttttttttttttttgagatagggtctcagtcctgtctcacaggctggagtgcaatggtacaatctcagctcactgcaacctccacctcctgggttcaagtgattctcctgcctcagccttctgagtggctgagattacaggcacccaccaccacacctggctactttttgtatctttagtagagatgggatttcaccgtgttggccaggctggtgttgaattcctgaccttaagtgatcctcctgcctcagcctcccaaagtgctgggattataggtgtgagccgcagtgcccaacctggagctctctgctttaacagtaggttctattggctcaccatctggaacagagtaaacctgcacaatgttcactcccacaaatgcagttacaacagaggcaagcaaggcctgcaacccagaatgccagattgtcaggaccagctcagtgcccttcccactttccctcttcccgtggctgaacctgatagaacactcctgtggctgcctgtaaattctgacccttgatatctggctcccactctgcatccctctcccttgcaccctgtgttctgcttcttcccagccctttggttggtgatcttgtcgtgcagcctagatgcaattcatcttctcattctcaggcaggaaatctgcagttcccggagatgatttggctccacctcaaggattagcctgcacacccatacaccccacacaagccagggtccagcatcccagggtccacttttcttggccagaggaagctggaacagaaagggaatgctaaataaaagcatgggaacatgtgggcagacaggatggagacagcatctgaagaccaggaggagggattctagattgatatgacaggagctatggagccactgtaggttcttaagcagagaaacaggcaggataaaaatagtccttggtggtgttcatccaggagccttgactggagtagggagagactagagctactagttgaaataatagctactactattttttgagaattgatttcatggagctttcttacggtcatgcatcttagtctatgtttagcctatgttatttctaattctcacaacctccctgtggggttaccgagattaccccttcctgcagatatgggaaccttgccaagagactctaacttgaaactgacaaaaatgagattgaaattctggcctctgcctaaatacccattctccttcctgccactttgctgctagaaggctgtgccactggggaggctgctgccattgcccatgggtctaggagatgagagcatcagttagagcaacatgggagcaatggagggaaaccagaagcaagatttgccagaaaggaagaaagagccaggatcccgtatctggatgattccagattgtctagcctggaggatggagatgaattggaccagtcaggaaagaaatgttagggaaagacgtctagtcaggcttgagtgtgttgatttatatgctcctagggacatctttatagagatgtccaggagtcaatggacaatgtgggactggctgctagagtacaaatttgaaggaagaacagcatagtggtgggagttttggcttatgttggacatgagtgggttcaaatttctgctatgccacttactcattgtgtgacttgggcaagtgactcaattatctgaatcccaatatcctcatctatcaaatagggataagaacagtctgtgtcacagagttgttctcctgggcatagcaccagacatcaagggacagttcccatcaatggtataattttggaacctcaggaggaaggataaggaactgagggctaagtgtattcactgaggccctgagacagaagccagagatggggaacaggaagagaaagtaaagccaatgaaaagaaagggaaggcatgctcagagaggtaggtgggaccgccagcctaaccaaaacaggggcgatttcacacttgctcatttcatgtcactgtgttttggaaggaaagattctctaaggcaaatataatcacagttaagcctattttagctgtggtaactggagcctggctcttctttaataaaaggagcctggcctctcttatttttacctgctacttatgaccctgtctcacctgcaaaacatataccccaaatctgtgaggtctgattgttaatgacttaattatagactcacaagctatttctgcatttttaatgggcttcccagaatctagtacctgcctggcttatgtaagatcaccttagatctgagtaggcagaagagcagtttaattccaagtcttttgacaggctctgacaaattgttatggaagatagtgaggttaaccttccgtgcacaaaagggctctcctgtctgtggaaggtcatgatgaacttgacacaccaagttatgtctggacagaatcatgacttttccccaccaaatctgctgtttctcatggcccaacaaggatgaaacgaaaaacagtggatgaggggtctgcgtgtgtgtgtttgtgtgcacacatgcgtgttcgccttgtatgtagtttcaaaagtttacacagaaaagctccatgcttcgttcctcacgcagaaatgtctttatctgccatataaatgggattcaacaacttcattttctggcctggccaacgaaaacactcacaaagtaaaaacaccatacttactctttctttctgagttaagaacttgtagcttgcctgattatagatcatggcaagtaattctgacatcagttaacgaacttgatgaagtcaggttgggaagtgacatcaaggggcttagaggaatttattctgacattgggtttgggaactaaagatactgtacctccaggcttcgtcttgaaacatggaagcccacacactaaacagtggtagaatttagatgcctacggccaggcagctggtccttatgaacaaagcaaaagtctcccatggcccaggttcccacggagagttatgagggccacaggctatatacgcttggatccagcttcactgctcccagtctggagttattcctcaaatgcacctgatcacttcgctcctctgcttaataggctctcacttcctgatcagctcacctggccttggggataaattctaaagacagcatatgtctgaaaaggtcctttgtggtttagcctgactgatctctgcagccttctttcaagtctcattcctgctcatctctaagtggcttgacctgcggaattgtcaccttctccaagagccttcccttcctgtcaccctcgcctcttgtccccatcccaagaaaggatctcccctactggtctcactcttggcatcagtgcttttccttcctaggcttcttctcaatttgtaattatgtatttactttcttgttcaggtgtttaatgtccgccttggatgaatataggaacagtctcttccctgcctccctcccttccttgtttctttcccttcttccttcctgtgtgttcaccactctatcctcagcaccctgcccagtgcctggcgcagagtattcagtggatgccttttgaatacatggatgagtggagcgagttacccctctcacaccctacattgaactctccctccttcaataccaaatcacttgtggtttcttgaattggccaagctttcccatcccttcacactggctactcctctgtctggacattgttccttccactgaggttccacctaccctatggtcagcaccattgatgcttcagaaccagccaagattttccttctttgggaacagctctctgaatatcccccagctggctaggtgttctttctccaggctcctgtagacacctgcctggctctctctactcatagtactaaacaaaacagtctgctttcttctgcttgtgcctgtcttaatgctgagctcctgagctgaaggccctcgctcccatgcagcacactaagatcactctggggccagaccaccttggcatgaatcccagtgctgcatttactacctctgctccaggttcctcagctggaaaaggggttcataattgtgtgaacctcatggggatgctgtgaggattcaatgaatcaacacgtgtgtattagtcaaggttctttaaagacacagaactaatgtgatagatgaatatatgaaggggagtttattaggagaattgactcacatcatcacaaggtaaagtcccatcgtaggccatctgcaggctgagaagccaggaagtcagtctgagtcacaaaacctcaaaagtagggaaggtgatggtgcagccttcagtctgtggccgaaggccccagagcttctggcaaatctctggtgtaagtccaacagtccaaaagctgaagaacttggagtgtgatgttcgaggccaggaagcatccaacatgggagaaagatggaggccagagactcagccagtctgctctttccatgcctggttttatgctggcagctgattagttgatgcccacccagactgagggtgggtctgcctctcccagtctactgactcacatgttaatatcctttggcaacaccctcacagaaacaccggggaacaatattttgcatccttcaatccaatcgagttgacaatcaatattagccatcacagcatccaaagtacttgggacagtcagtgtctcacaacaaactggagttattcatagtgattgcattgttaaatccagacctatgataaatgttcagctaatgaacgaggcaaactgaggtgacccagtcctccatccatgcccaacatgaccaaattctatgatttctgtaacctgtatatattcaggattatgggcgaacttacaccatcaccactcttattcctcaggtgctcactgtataggaagcactgactaaacttcctagagaagaaattatttctacaggtccacttaacaaactccaaaagacctggcagtatttaaaagttcattatgaacaatttacccttcttaactggaagtcaatacaagttgcctcaataaagggaaactggtctcttaatcaagttgcttcaattaaatgcaaaaaaatatttttcccttttttgtcattacaagaatttcttaaaaataaaacaaagaagaaaagttatgacagaagctgaaaaggctaaatttaaggctcgtttatcatgcttgttcatcatcgttgcaaacatgcaatttaaaagacgtaattttggctcctaatccagtttcaagaatcaggatggaaatggttccaaaaaaaaaataaaaggagcaatcagtagaaggagccacttgggagaaacagttgtttttgtttttaatttttttaataaaaatataaaatatatcgtcaattgcccaaaagccaacgaccctgctaatacgtctcttactgcattgggtggttacaacttttaaatccactacctatcagaatctcaggaattatttggtaagtaccttgaggaaaacctggagctaattgccccctgtttctacacacatacattcatggggatatttagcgaaaatttttgtggatgatactaagaggtacctgaaatgaccaaaaatcagaaacgaatcacacatttttcagccacatgatactgaaaagttacgtaacttctctgaggttcagttttctcatctgtacaatggacataatactctggccttgtgtggatgccatcatgagacacatttaataaaacaaatgtcatgcttcattcagtgccttgctaatggatgattcttaatcactgatcaattattcttaagtgaagtagccagtaagttgctatcacttctatacatttttcccctctttcctgatctcacacgttctagacaaaaatacttttgcacatttgttactgatgtaaactgcaatttttttctactctgagccaactgtttgaatcctctgtttgttttggccatgatgccatctaaccttcaagacacccgacacgctgcagacatgtgactttactttatttctttaaaacaagagtgtcccccacccacctgtctgagtaccagtccgtggcctgttagaaaccgggctgcactgcaagaagtgagtggcaggtgagcaagcaaagcttcatctgtatttatagccactccccattccccacattactgcctgagcactgcctgctgtcagatcagtagcagcatcagattctcataggagtgtgaaccctattgtaaattgcacatgcaagagatctaggttgcaccctccttatgagaatctaatgcctgatgatctgtcactgtctcccatcaccccgagacaggaccatgtagtcgcaggaaaacaagctgagggctcccatggattctacattatggtgcgttgtatacttatctcattgtatattacaattaactaataatagaaataaagtgcatgataaatgtaatgcacttgaatcatcccaaaaccgccaccatgaacaccctcagtccatggaaaaattgtcttccatgaaacgggtctgtggtgccgaaaaaggctggggactgctgctctaaataattcctgaaaatgagagcaacaagctcgtggtaaattaattaccttgtctctaaaccgtctcacattgactgggagtgacatggaatctgttgacttgggtgattatatcgatcctgcttacatgaaatatgttttacaacaatcccagtggagaatgaatctgcacatttgctgtgaccataaagaaatgatgagttaaagatgtggacacttaatatgccctgatttaacaagtgtgataacttcaaaaaacctgtgaagtaccatgctccatggcaaaagcctccccaggtactgttaaggaaagttagtatccatttaactgtcacctaaagtggagaaaatatatagcttgaaaattattgtacggatccaagaattgggcctagaattcaataataggctgttacatcttgacacatgcctaaattgttatgtttatgtggctcttagctccaggatactattcatatatagataaaaagacatccttcaattcattaatttaaatagataacagattactttaaggatcagaatctaagaaaactatattctggagattaattttaattgaaattcttgggggaaaaactgatcccatagaaagtatagataactaaaaatggcttctttttggcttttgaaaattctaaattttattttatacaggagcatggtccaatagaaatgtaatgaaagccacgtatgtcatttaaagttttcttatagtcatgttaaaaaacgaaaccagtgaaattaactttaataatttatataataactgtatatatgagtgtgtgtgtgtgtgtgtgtgtgtgtgtgtgtgtgtgtatgtataacagatatatctaacatattatcatttcaacaagtaatcaaggccaggcacaatggctcacacctgtaatcccagcactttaagaggccaaggcaggcggatcacttgaggcccggagtttgagaccagcctggccaggatggtgaaaccacatctctactaaaaatacaaaaattagctgggcatggtggtgcatgcctgtaatcccagctactcaggaggctgaggcaggggaactgctaggtcatgccattgcactctagtctgggcaacggagcaagtgtgactctatctcaaaaaaaaaaaaaaatcaatatgaacattattcataagatacctttttacattcttcttttcatattaagtcattgaaatgtagtatatattttatgcttaaggcacatctcaatttagagtatttaatttttaagtacttaataagcacaagcagtgaatagctaaggattagataggatgctctacagttctacaggaatattgcattttttgaaaggatggaaaggatcattcactgagttcctaccacatgttagaacattgcctttggccttagagcccctcacacatccatctgtttttctcctatagctagcctgttcctatattccagatgcagaagtagctcaggctcagaaaagttaagtaacttaaccagtgccatcatccatcagtaagtggcaggactggaagttgagctgggccttctgattttgtggagtcattgctattttgctaatactgacatttatggcagaactattgtgcttttctatttttcagtaaatttcctgaaatagcataggaaattaaaaagttgttagtaataaaaaataaatccagagctgagcaaaactcctaaagaaattttaggaaggtgggcaagccctgtattgtcatgacacattttaaaaacttttcctgtgaatagaacctttacaaaaagaaccttgtggaaacagcacgaggtgtctaaatgtaaatttctcccaggccagggacctgatctcattcatcttcatagtcccataggctagagaaaacgtcttgcgtttatatttttaaaactataatttacaactttgtttatatatgcattacccgatttaagctcacaacaatgcctggatgcagatggtgtgtttttcgttttctgagtgaggacagtgagactcagaggtgggtcttaggtcgcggtcgtggagttggttgagtggcagccagtgcggccatccacaggctttcccaagtgcatcgctgcagccatagttagctccccagcagctgctcggggctttcacatagatggaatatagtgttgtcagaggtaaatttccagctagtatataggatagaacaagataatgtaataaaatgtacattttctaggctctctgatatgcttctaccctcctatctcttgttattaccataaatcaaatactagtcaattctaaatgtaaatatagggatgataacctctttttacaattcctctcttatctgcaactcccagagagattcacatggagatacttggtcactgccggctttgcggtcggcatgactcctattagagattaaatgacatagagtaatctcaaagtagttagcaataaaaattaatacaaaactatgcaaaactcccagagaaattttaggcaagtagacaagtcctgtgtcatcatgacccattaataaaactttcctcgtgaacagaacctttggaagtagaatctcatggaaatagcatgagatttccaaatgtaaatgtctgccaagtctctctgtaagagatgggttggctgggggcgatggctcaaacctgtaatcctagcactttgggagactgaggcaggtggatcacgatatcaggagttcaagaccagcctggccaagatggtgaaaccctatctctactaaaaatacaaaaattatccaggcgtggtggcaggtgcctgtaatcccagctacttgggaggctgaggcaggagaatcgctcgaactcaggaggcagaggtcacagtgatccaagatcacgccactgcagtgtagtctgggcgacagatcaagattcctttaaaaaaaaaaaaaaaaaaaaaaaaagatgggtctgcatttctcaagggaaaaaaacatctccaatgatgagaaaatacagtgtttgataaagaccatggattttctctatttgattctctgttctcaacacccaaaacttaggcagtaaagaaacaggggaagaggtaccatttattcagtctttttccacccagcacatgggatgatcaaattacatggtctcatccaaagttttcaggcagaagcctgaatgtttgtagaaaaattagcctatttggccctagccaaatacatcctccagtctacccatgttgggcagatgcctgtggacttttggaccctttggcctgggagtgatgtgtgatagttgccagggtggcatctgctgttgggccagactgttggtgctgtttgattctcagcccaattgcttgtttaagcaaagccaagtctagtctcaaggcctaatctcatcatagttgatgttgtctttttttgatggcttctaataaataaatagaaacctcttttcctctggtccataccccttagaagtgccacatttaaaaaataagaggaaagccttcatctcactggggcccatagcagtggcagatattgttatttgctgaattgcttctatctttcttaattaggtaggaagtagcaaccatcaaaaaacaaatattgtatgtaggcggccatcaaaacataagacaactgtttttcttccagcagaaaaccaatttggcaaacacttatttttctttctctatcacacaaagaaagtcaattctctaagaaaaaggatagaaaaagaaaagaaaagaaaacttttaaataatatcccatatatgttttgagaattttatacatcaatacattaaaacataggcaggaaaatttcaaatgcaaacaaaaatcacatcttatagctcttagcaattccttgtcttcaaagactggaggaaatagcccactgggaaggcctttaacagagcaggtgcttccctaggggaaggagtaactacagatatttgagggctactcagaggcaaaagggctcaaaaaacttcagactgtcttccaagcaacagccccagaatgcctcctagatagtgaggctgccttcagttggcctgagattgttgctctgaccctggtgccacccttcctctccaaccttgttacaaacaattcagaagggaggattgtgaaatccttcctgctgctctttctgtcttctgccaatcagagaagactggacatgagatccaagagagggctttccctttccccgatggctacactgtgtctcctgcctcccagctgtttatggaaatcagatggtttcctcaactgtctatctttctgcagcaaatcctttgacagagaatgtgcactgtcaaccaaccccttcatcgagtcaggcaaattaggattcctttgacagcaactttttacaacttccttcctttgaagatataaagctttaaacagtagtagttctccgtgagacccaaggaaaggtctgcagactataagcagactttatctgaagaccacctcctgcccctcactcttactccagaggcctgtgtatttatttatttatttatttttttggtaaaggcctctgctgtgaatttaagtcatctaatcaaaatgcattatttctgtccttgcattgtccattctcgtaaaccgtggttaacacagataattgagacttgagtgcttttttattccaagtcccttattcgatttggcccttgttaacaaagcctagtctgtaagagcgtgaccaccagtcttatttaccttgttatctgtaatttcctctttccctcaggcctttgcgtaatattttctctgcatggaaggggaggataagaaagaagacctaaaaactgaatttttaaaatacaaacagaaaaaaagctccctgtattttcccaaattctgcataaataaaataatatgctccataatggcagagatttgactgacttgttcgttgctataaatctagcacttacaatatctggctgtgaataaataatttcttaatgacttagcaaatgctggagacagaatgaatattgatattaataatgcagatcgtagtcaatttatttagctcaaacgttgtgcggggcaccactttaagtgcatttcttacattaagtcatataatctttataataactctataatataggtcctattttatcttcattttacaggtgaataaaggaagacggggagactatgtgtgaccagcacagggtcatacatctagaatattttggagacatatttttgcactcagactcctcaaaaaaacatttaacaaaatatgttatcttttttgtcacaatagaaaaatatgaactgaatattattacagtaaagtagattcaggttggttgaatagctgtatccaaaagggttaaaatataatctgtgtcgtcctggagaatgatttccgcatgcagaaatctaattgaatttaattgctttcatctcagtgatggagaccaagatatgaacacaagttggttactttgaaactttcataactcaggtattcccattgtacaatagccttgagttttgaaaagaactcaagcatgtataaggattgactgaaattaataaattgatactcagcaggtataaatatgaagcccaatagatgggcaaaagaatttctgaaacacaggatgggggtgatacgaaaatgacttggttgatgaggtattcacgctcctggacctgtgccaactccctctctgcaggttcctgcccttattgctaccctgtaattattcatctttaatttattgctcttcaccttgagcaccactctaaggcttttccatttacctaaagcagtaagttgtactctagtgcctacagttttctgtagctggccttgcgggttcctctgctgagaaaagttcataccatccatttcagttcccttttccatctctgagtacccctaactcctttcctccctctcagagaaagaccgattcttcctccttttcatgacatatcccttcacttgtacccttgaactcactcttttctgcctctttcttcatttcgcatttcccctcacactcttacatcttaaattttccctcctctgtgaatcctcccccagcctccaaacgtggtcaaatcttcccaggcgaaaccaaattatttctccttcaaatcgctgcctcccttccccagtcttgttgaaagccatcttcactcaacatctctatttccttgcaagttcataccttaatactccgaaatggagctcctgtcctcaacattttggtgaaaattctctcttttgaaggtcgtggaaactgaacagctgatttccctcaactgtttcttagtcctgaggctgcttgaagtctctgaagcaattaatttttaattttaattttattgaggtaaaatttacataacataaaattaagcaagcgatacttaattactttctaatgttgtgcaaccactacctttatctagttccaaaatggttctgttaacccaaaaggaaactgtatacctgttaagcatgttctcccttccccagctcctggctttatgtatcacctatttttatatataatataaatgaaatcatacaatacttgggcatttatgactggcctctttttttttttttttttttttgagacagagtctcactctgtcgcccaggttggggttggagtgcagtggtgcgatctctattcactgcaagctccacctcctgggttcaggccattctcctgcctcatcctcccgagtagctgggactacaggtgcccaccaccacacccagctaattttttgtattttttagtagagaccgggtttcaccgtgttagccaggatggtgtcaatctcctgacctcgtgatccgcctgcctcagcctcccagagtgctgggattacaggcgtgaatgactggcctcttttactttgcataatgttgcaaggttcatccacattatagcatgtatcactacttcattcctttttagggataagcaatattcctttatgtggatggaccacaaattgtttacccattcatctgttgatggccatttgggcttttttgactgttatgaacaacactgctaccaacctgtgtgcaaatgtatttgagtactaattttttatttgtaaatacagtgacaataatgccacaaaaacattgcatacttacaagatttatgagttacataatttacaatgattgagtgtgggcagctctattatctggatttcattaagatgatgctacaaaaatagtaattgttagtaataataatgctacaaaaacgttgtatacttgcaagatttacaaattacataatttatgatgattgaatgggggtggctctcttatctggatttcattaagatactcaggattctttacaaacatgctaggtttccacttagagcaagatctcttaaaaaaaaccctgcttattgaccacagcagccagacccgggcctccttctgcctactgtcgccataactctagttataacttgcttttgggtttatacctaggagtggaattgctggctcaaatgataattctatgttcaactctttgagaaaccacccaactgtcccctaggagtggaattgctggctcatatgataattctatattcaactctttgagaagtcacccaactgtcttctacagcagctgaaccactttaattcccagcagagcattggcagtccttgaaatgctcttccgtttgctgtttaagacaccatactgtccttgttctcccactctttctgtatagaaacccatatattttcttcctctagttcttcttcttattcctcctgccattggaagtgcctgtccatttcctgtcttgattttcctttgctgttttctaccatcctcaacaattttatccaacctagcagctttaaagatctcttcttcagcatgtctccaaatttatagcttcatttctgacctcaggtccatcgtgtctacagcgcatctccacccgtacatttcacttgcctctcggggttaactgtgtgtttctgaacgctcatactggggttaactgtgtgagtctgaacacctgtacctcattacctcattacttccttacctcatcttcctaagtgcacggtttcttgcagtgccatcctcgtcttcccatgcacctgaacccaccaccttgtatttgtctttagttcctcaccacctgggaggtcagtggtacttcttatcctttctctctctcccatgtggtttctacctgcaaactcttcattacagtggtcacaactggtttgaacatcatttcctcttatccagccaagacagggccactttcttttaagtttatctttctcccttttcctgtgatccaatctgcgtgcctgttactatctaattgacttcccaaagaataactgtgatcatatcatgccctcttcaaaggctgtcagtcttcccatgcttactgagccacaacgaaatgagtcccaacctgctttgtcactttcagccctcacaattccctgtcattcatgtgattctcctaccaaagtaagctgcttatcttctatgttcactgaaaatggtatgtttccttccacatctatctctaagggatggcataagtgggttgcaataggtttacaggaatgaggatcagattaagagctgtggcatcagtaaaaccaataactcttgatttattatgtaacaatgtatatttttagccaaacaaatgctagataccaataggtaaacctggtactaggaatttcttttcatttttgctttctttgagatctgtaattaatcatggtgaaaataatgctacagaaacatcatatacttacaagatttgcaaattccataatttacaatgattgcatgtgggtggctctgttatctggatttcattaagacactccggattcttcacaaacatgccaagttcccacttagagcaagatctcttaagtaaacctctgcttatggaccacagcagccagatctgaacctcctgctaccatccctgtaactctagttatgacttgtattatccatcacattatttgttgtcttatgaaggatgaagtgttcaaatccctgtaggaaacagaccgaaaactttgagtctgttacccctaagagacacagccctcttttctgaggcgtctttctttccttgatttatttggactatggtttctttggccaaccatttaattttttttttgttgttaactttgtccttgttaacattaattctctcatgtcatgtggaaatgagaataattcagatattgtaagagaaggaaaatggttagataaattagaagcatgaataattgatagagaaataattcaagcagctaactatatcatgcattctctgcttacttcatgaatgatccgtatgccatgtccatacgacttaatatttatttttagaaacctttaccaaaatgagcaagaagtagtaaatgcctcattatcctttcagagcacctaatgatacattattttctgttataaaacttcaaggtttttgaatgcattgttataaatccagactgtcaacatttctttggcaagaagcagcacaccatcctatagaaataagatgtaagattaacaattcaggttcatatattttcatctgtccctgaattccaccatacatggcagaaaaccacaatcatgttttcatagcaaatatgttatgacaaactatacaacatttaagaacatttagaaaagccaaaatggaactttcagaaataaaaccttggctgttgtggtggctcacgcctgtaatcccaacagtttgggaggccaaggcgggcagatcacctggggtcacgagttgaagaccagccaggccaacatggcgaaaccctgtctctactaaaaatacaaaaattagccaggcatggtggtgcgcgcctttaatcccagctactcgggaggctgaggcagaattgcttgaacccagaagacagagactgcagtgagccaagatcgcaccattgcactccagcctgggtgacagggcgagactttatctcaaaaaaaaaaaaaaaaaaaaaaaaaaaagaaagaaattaaaccttaaatagcaaaatagaaaagacagatcatcagcaatgattaataaaaaagctattttataaagcggtgattgggaaagtaaaataggttgtacagattgggccaaagcctaaagatattctggtgattctttccacgatagaagaccgtgaaagaggcaatgcagtgagaccataagccttgtggtttgggacacattcttttcgaaggcctaactttttctgttggtgaaatgggaataaaaatagtacgaatttccaggagttaaattagagttgaatgagataattcatgtgaggctcttagaaagatgcctggaacatagtaagaattaaataatatcatctaataaagtgagaatgaccacagaatatgtctttatatggtattcattgttaaaatgcctagggatggagagttctggctttagctgtaacttaatataggagttaaaaaggtatcataaccttaatattaggtctcgggaggtgtcactaggactctgttatcctttcttcccttctttcttttttggctttctatatgtcttcattttcagacaacctctctcctggggtatcagaagacacactcacattaggataatgcagataagatcaattcacagtaagaagatttatcaaggtaaagtgaagtataggagaagcacatgagaacccaggagcataaattgataaacacaccaattgaaaacagattggctgaattttaaagcaatagatatatgtttcttaaattagatagaccttgaatggaagggtacagaaaaatagaaaatgaaaaaaagtaagaaaatatatcctgtaaatattaaccaagagaaagttgatagagctatgctattatcagaggaaatagactttaaggagagaagtatcgctacagataaagaacgctatatcatatttatagaactatacagcaggcagatataataattccaaattaggatgcatccagtaacatatacagcagccccccttatctatgggaaacacatttcgagaccccgaccgggtacctgaaacctctgatagtagcaaagtctgtgtatgtatatagtcacgtgtgacataacaacgttttggtcaatgacggaccacatatgtgatggtgatctcataaaattataataccatatttttactgtactttttgtgtttagatatgtttaaatacacaaataccattgtgttacaactgcatacagtattcagcacagtaacatactgtacgggtttatagcctaggaacaataggctataccgtatttcctaggtgtgtagtaagctataccatctaggtttatataagtgcactgtgtattgtttgcacaatgccagaatcaactaacaatgcatttctcagaacatatccttgttaagtaacgcatgactatagtatgcttttcctatacatatgcaaatatgacaaagtttaatttataaattggacacaatcagagattaaaaacaataacgaatagtaaaatagaacaattacagtaatatgccagcatcactaatcttgaactttggggccattaagtaaaataaagcttacttgcatacaagcactgatatctcagcagttgacataactacacagctactgagtaactaatgggatagtatgtacagtgtggatacaccggacaaagccatgattcatgtccagaacaggacagcaggatatttagtcacactactcagaatggctcagaatttaaaacttacaaattatttctttctgaagttttccatgtaatattttcagactgcaattgactataggtaactaaaactacagaaagcaaaactacagataagagggtgactggtgtataaaataaaactaatatatataatagaagtagtcaaaatagaaaaacccatcatcatagctgaaaactttaacacatttctacatagctgatataacaagtagtctaaatataaaaaagagtaataaaaatttcactaaaatctgtaatatagattttactaaacaaaatttggttctaacaaaatttacaaaaactaagggtatgcattctgcagtgttcacgtggaatacttatcaatatattgtaggctggtcatagagtacatccaaacaagtttcaaaagatagaaatcatacagattgtatattctgaccattttaaatttaaaacagaaattaataacaaaaaaactaaaggatccccacatatttagaaactatgcaatatatgttgaaatattccatgggtaaaataagaaataatagtaagaagtagaaaatagtttgaatggaatataatggaaatacaacataacaaaacttgagaatccagataaagtagaggaaagatttacaaccttgaatgcatatataaatcagagaacaccaaatttaactctaataaaatggagggaaggaaataacaaaaatacaatttataacatagaaagtagacatgcaagaggataagtcaataaagtttgttctttgaaagttctgtaacttgatatcaatagtccctagtaagggtaattaagaaaaaaaaaagaaaagacactatggctaattaaacaaatggagacagcactagagatctttcaagaataagaaaaaagaagaaggcattgttaatacatttataaaaattaatttgaaaattaaaactggcaaattctgtaaaataaataaaaaatcagtgtaccaaagcataccaaaaaaaaagaaatataaaatctggtaagttctacatttattaaatgaaaactctgtagcctaagataattccaagtccagatggcttcatggtaaattccaccaaacttttaaagaagaaaatacactaatcttatgcaaactcttctgtaaaatagaaaaaaaatgaaacgctttccagcttctttctgaaggccaacataatcttctttgcaataactgacataaacattgaaagaaggaaaaattataagccagtctctctaatgaatgtatatgagaaggtagataaatttgacttcaataaaagtaaaaacctgtgctcatcaaaatacatcattgagaaagtgaaaaggcaggctatacagtggaaaaaaaatctttgtaatatatgggtctattacaggacatttatctaggacatgttaacaactcctacaaaaatataacaaaagggcagagaacccaactaacaatggaggaaatatttaacaggcttttaacaaaagaggatatctacatgaccactaaacatattaaaaggtttttagcatcactagtcatcaaggaaatgcaaaggaaaactacacggaaattattcagatactattatacacacatgtgaaaattaattagaatttaaaaagtaagtataataacaatagcaaggacgtgtggcaatcagaattctcacacactgtaaagctgaacattcttgacctagaaatcctacttccagatctataactaaaacaaatgtatacacatgtacactaaaggctcttacaagaaagtccagaataacactttgtaatagctaaaaactggaaacaactcaaaagtccatcaagggacaaatggataaattttggcacatatatcatatgtatataccaaatacatagcaaaaaaaaaagcaactgttattatgctcaaaaatatggataaacttaataggcataacattgcatgaaagaagccagatagggaagggaatatcctatggaaatgaagttcaacagcaggcagaactaactaatctctgttgagctatagatggtgatgtgaactaatctatattgagccaggatggtggtgatatggtttggccgtgtcaccatccaagtctcatcttgaagtgcagctcccataatccccacatgtcacgggagggatccagtggcaggtaattgaatcacgggggtgggtttttcccatgctgttctcgtgatagtgaataagtctcacgagatttgatggttttatagaagagagttccctacacacgctctcttgcctgctgccgtgtaggatgtgcctttgctcatccttcaccttctgccatgattgtgagtcctccccggctatgtggaactgtgagtccattaaaccttttttactcttttttgtttgtttgtttgttttttgagatggagtctcactctgtcgccagtctggagtgcagtggtgcattctcagctcactgcaacctctgactccctggttcaagtgattctcctgcctcagcctcctaagtagctgggattacaggcacgtgccaccacacccagctaatttttatatttttaggagaaatggggtttcaccatgttggccaggatggtcttgatctcctgacctcgtgatccacctgcctgggcctcccaaagtactggcattacaggtgtaagccactgcaccccagtctcaggtatgtctttattagcaacctgagaacagactaatacttgtggttacctttgaaaaggtgatgactggaaggggcctgagggaggtttctgagatcatgacagagttgtatgtcttcatctttatggtggtgacataggtgtgttcactcaaaaaaaattcaccaaactgtacacttacacttttgcagtttaatatatgaatgatacatgttatgctttaattagaaagttaaaagtaagtttttttcaaaagtagtaattggatgactcccgcttttattgagttagcaagtatcttttactgccactttctattgttaaaaaaaaaaaaaggctcaccactgaggctgtaaggctaaatccttagcatgacacacaaaaccatctataaaccagtttctagcctttcttcctggccattccctttgacctgagctgtcttgaatattcttaagacttgacaatactaattttaaaccgtctaagataagatcacctcccactccagaaaaggggtgagggtagatgttaagaccagagtgtgcttccagcacacttgtattttttatggtactaagaaagaaaaatgctgacgcttaaacctgcacacagtaattccttaacatcaatggtaaggttcctccctaattttgaaggcattaaaatggggtcggggaaatgtcttacaaatgatattttttaaaaaaataaaataaaacaaagataatcatgtcttggattatcatgactcacagcaactttactttcaaaagtaagaatatttacttctaaaactatgaaatcttcactatattcttaaaaatataaatcgttaaatgtcattctttagctctaaatacaaagttagtttgttgaacttcatgagttacgtcttttatcgggcttggggtgtgaccttagcccctctcctttgtgaggggagatggcagaactctcagaagctttttctattctcatctttgttggttactggggaaaaactggatttcgctgcactcatcaaataaagaggcccaggtagcagcgcctccacgttttgttcaagtggggttttctgcgtgtgccgctggccaattcttcaagaaaagtgtttgttcttctctggcggtttggtgttcctatgtttcaacatgggggtaccaaataattcatttccccttttcccaacagatgcattcttgtgacctcactgatgacaggggcgtcgtttattctaacaaatgctcttgtccaaattccaaccatgttgccaagagatggcatagctggtgagggctggactttaggggccaatctccactcctgagctcccctgaccacacaggaagaaaacattaatgatgttcccatactgatgttgtggtgtaagtgtctcctgtgtaaatagaactaaatatttaggaaagaaaacagaagagtcttatgtagtgcattacaaactagaaagcttttgaagtcagcatctgggatggtcttaaaaacaaacgtgcagtctgagagaaagaattactgctgacacacgctgacctcacagaaactatctggtgatgagattatctctcttccaggactctaacaaggctttgcaaggatattttcttgctttgctttgctttttttaatcttcttaactggtggaacctcttgttatgtgcaaatctaatccattctcattcaaagatggatgtcccggttttactgtatctgccttagttggagattcccgggaagaaaagcccaggacaagtggtcaggtgcaggaacttgatctgagaggtggtcccaggaagcagaagtgagttcatggggacattgagaagaggaaggaggccaatcaaaaaagagcatttctgaggttgcttctgtacacaggggcttcatttcttcaattctcccagatcctctgggaaccctatgaaatgcttttcagaattctcagagtcatccacctgaaaaatagagggactggagccttttttcctagtctccctactgtccatggattgagagttgcctgggagcagggagagcgggtgttaactgccttctgtttagaacaagttcctgtatgtgtcagagatctggggcaggatgatttgcagtcatgtaagcttaggttgaactctgggagagccaggtgagtgtgtgctcaaaaagaactgtccagtgcagctgctgctgaaatcagaggtgactgcaaggatgtaacactggcgctcgggtgtctgccatggcctaggtttcttatgagagattgaactcttcggagattccatcattcagagcaggcacaagacggtttggccaccaatctgggtagagccaggctgttgcatgacaagtcagtcaggagaaaactgaggctagcaggctgactttctggttccatgacacacatcacatctgcaatagagcttaaagacagggtgcttatccctcaaacctccctgtatcactaactttcttaatccagacttttgcctttgtttttttttttgtttgttttttttttttttttttttagaaggagtctcgctctgtcacccaggctggagtgcagtggcaggatcttggctcactgcaaactccacctcctggttctcgccattctcctgcctcagcctcccgagtagctgggactacaggtgcccgccagcacacccagctaatatttttgtatttagagtagagacggggtttcaccgtgttagccagggtggtcttgatctcctgaccttgtgatccgcaagcctcggcctcccaaattgctgggattacaaacgtgagccaccgcacccggcctacttttacgtctcataacccaaaagctctatggcttcaaaaattcccaactcctcaaaaagctgattttctgttttatcagtgcccctttgattgataaacaatatattaatataagatggatataaagcagatgtattttgttgccacaacttctttggttcaaattaaagaatataggtcatttgtcccagagagtcagtccagctgaaaaattgtggatgttgataaatgcgtaggtctccattcttaaaaatccagcatttttgtataggaacaaaactttacttggattataaattgcaggccttctttgaaaagacaaagtgtgaaagggaagagaactgtagagtcttcctgatgtttactgagcccttactccaaaccaggacttaggcttgttgcatcccctccattaactcatgtcatattgcctaattcataaagaggcccagagaggcagtcgaggtgtagaaaggttaagtaacattcccactgcctcataacttgtaagtaatgaaactctccggaaaagttgagctcagatctgaatccagagcctgcatgcctaaccgcagtgcaatgctatcctcacctcactgtgcaaatacatctcagatctctgcattaggatgcacaggtttacattttttaaaagcaggtaataactgtcttattctgtacctattgtctgttttcacagtctgctgtgaacccttgctttcagctgggacactgttgccttccactgccttccacagcctctttacttccccttaaacaacctattccaactggtactacttgataatagtcattttctctcacctgaaagcatgcctctgtcaaccaggctcttcccctcaatggctaatgactctcactcctacactcctgcagagggcctggcacatagtgggtgcttaatacaagttccttggcacaaagaatataggaataaatacggggactaaggtattgcgctctccattttacaaaggagaaatctagccttggtctctctgataccacagtctttcccaaagttgcacagcacagtggaggagagttggacctagggcccaggtttccaggatcctggtctagtgtaatgtcagtttctaattatgtggtccacacacatgaatatttaaatcagcatctcctggagataactcaagaggtgactctaatggtagacaattgaggctgtacatcagggttgcaaaggggctttgtccggatgagtggattttttgtgtcccttacaccatgtgaattcccagcatcatggtttatgctaatcctctttccaaaatagtttcctggtgaccttctccctgtgccaaccccggaatacaatgggatgagtaactggcaggtccagatacagaaaatgagtgagcaatgcctttcccagctaaaaattcttccagctcacccatggtgtgctagggaagatgttctcctatgtcctgaatgaccagcagcagaggattcagggcacccaatgcaaaattgtcaccaaatgactgtgacactgaagtggctcatgctgctctttgcactgcattaagtgaaaccagacgcctccagttaaactccagtgagctaaaaagtatagtgataaatatatgaaatgagtagaaagaacaaaaataaagaagcctcaccccagatacggcacttatgaagaatctgtgtctcagtctcccagcaaaattgaaacgtaattcaacttcagatggtcaatgcctgccttaatgccccatgctaatgtcagccctgagatgtcacaatagtccaggagatgcttacctgaaggagaggccctctagagaggctgtgagaactgtgatttggagctcgaaactgagatagtgagctgggcagggtgacaatttatggagaatgggaaaaggaagagggaagtattttagcaaaacggatgctatcaggatggctgaggctttagaaccagatggagtgctgtggcctctcttggatggatgctgtttctgagctttgcatctggaaagacagagcctgctctaggaataatgatgtcaaagatctttctcattttactgtctggttaaatatcacctcttcagagaagccttcccttatcaacttacttaaattgagtaccccctgtcagttttctatcacagtacctcacttgtgtgtgttttccattcatagcatttgttacactttcacatttttaaaagcgttgtttctttttttgttttttgtccatctccagttcctatcagtgccctaccatgtccttaacatttagcttagtgcctgacacgtagtgcttcagtaagaagtatcaatgtggtaagtgaatttctaatcgaatagcagttacatcataaatagtcaatgattcttgtgatgtctcatggtcccagggatcatgagatacagagtgacagaggatggaagttcagttttcttctctatgtaacaggaagcaaggaagtgatcgtcagaataactgcaagatgaccctgctggctgctgtgtgacaggggattagaacagtcataaaagcaggtagagaggtgtttcagttagctatggctgtgtaacaaactactccaaacttagagacttgaaataatcattctatgtggtcatgtttctgtgggtcaagaattccagcaggattcagctggttgtcaactgggtctttcacatagcttttttcacctggtaacttagctaggctggaaaatccaagaaagcttcactcatacacctggcaccttggtgattctttgcatgcaccttggtgattctatgtgctgttttgtctccctcatagctaatcagatgtcttatgtggtggttggcattttttttttttttttttgagtcagagtattgctctattacccaggctggagttcagggtgcgatctcggctcactgcaacctctgacttccaggttcaagtgagtctcctgcatcagcctccctaatagctgagactacaggcacgtgccagcacgtctggctaatttttgtatttttagtagagacagggtttcaccatgttggccaggctggccttgaactcttgaactcaggtgatccacccacctcagcctcccaaagtgctggaattacaggtgtgagctatcacgcccagcctggtggttggcttttaaagggagcaggtcaaccatatgaaaacagaagctatggctctcttgaggcccagccccagaagttacacaccatcagttcccctgtgttctgttcgtcaaagcagcccaagattatctcaaaatcaagaggaagggaaatagattcagctcttcatgaagattggcaaggaatgtgcagccattttcaaaccaccccgcagagagaatggttaggacattgttatgataaacccagcctaaggttatagcaatagagatggacagagatgatttagctgaagatatagctgtagttagcatgaccagacttgccaatggttgtaatagggtgtctggattagggagatgttgtttatctctactagtttcctgttaattactctatgaacaaattagcacaaactttgtggcttaaaacaacacaaatttattctgttttagttttggaggccaaaagttcaaaatgagtttcacaaggccaaaatcaaggtgtcagcagaactggttccttctggaggctccaaggagcatttgttccttgtctcttcagtctctggaggcagtcgtgaccccttcttacaacttcaaaggcaattgtgtaacatttttgcagggagagtcctgggaacagtgagacaagttggggagaggcaagtggaagggacagaatcaagattgaagcaggctaagtatgaaaaatttgtaagatgtccaagcggagatgccagaaaaagtcagatgagtgtatgagtctcacatttcagagctaaaaatatacactctggatttatcaatataaagttagatgagggccaggtgcggtggctcatgcctgtaatcccagcactttgggaggccgaggtgggcagaccatgaggtcaggagctcaagaacagtctggcccacatgatgaaaccccatctgtatcaaaaatacaaaaattagctgggtgtggtggcatgcacctgtgatcccagctattcaagaggctgagataggaaaatcgcttgaacccgggaggtggaggtcgcagtgagctgagatggtgccattgcactccagcctgggtgacaaagtgagactgtctcaaaaaaaagaaagttatatgagtattgttgaagtcatttaggaacagattttttagcaacatcatccagtagaaatgtaatgtgagccagaaatgtaaatgtaaatgttctgctagccatatttaaaaagtaaaaagaaaaaggaaaattaatattagcaatatcttctttaacctgattattatataatgatcattccatcatttaagcaacataaaaagcaatgagatattttagataactttttccatactaagttttagaaatccagtatgttagctcactttccaattcagactagccaatttctttttgatggagaaaatgtatttaattaaaagaattattcttactattatttttgattggcaagtcataattgtatgcatttatgaggtacaatattatgttttgatacatgtataaaatggtataattaaatcaagctaattaacatgtccatcacctcagttacctatcctttttttgctgagacatttgaaattgactctcttagttattttgaaatatataatacattattattgactgtagtcatcatgctgtgcaatagtctcaaaacctctttctcttgtctatctgaaactttgcactcttagctaaaaaaaatctccccagtccctcccctgcacccccagccccaggtaatcaccatcctactgcttctaggagtttagctttatttgatttcccatacaagtgagatcatgtggtatttgtcttctgtgccttagccatatttgtattatccactggccacctttgtctcctggtgatatactggacagcacagctttagaaagaagagattctagaagttatccctgaggaatcccagcatttaatggtcggatatagaaaaagcttgaaggtagaagaaaaaccaggacagtgtagtattgcacaggtaggaaaagccttaagaagtgagttgatcagctatgttgaatgctggtacaaagatgggtaagatgggatggagaagtttctacaaaactgctgctaattcaaagaaacagatatagaccacttccaggctgggcgtggtggctcgtgcctgtaatcccaacactttggaaggccaaggtggacagatcacttgagatcaggagttcaaaaccagcctggccaacatgctgaaaccccgtctctactaaaaatatgaaaattagccaggtgtggtggtgcacgcctgtaattccagctagtcgggaggctaaggcaagagaatcagttaagcccagggggcagaggttgcagtgagccaagatcgtgccactgcattctagcctgggtgacagaacgagatttgtctcaaaaaaaaacaaaaaaacaaaaaaacaaaaaaaaaaaaacaagactacttttaggttctcgctctttggatgtgttgctgtttcctgcactctcttcctactgtctttgggtggtagatggaagggtgccacaggacacacagctggggaaacttcctcttgcaaagcctctactaaaccatgccacaccactgtataataactggaaaatggctttgggacttaaaagcaacttcatccaagaagaattgcagtttggatgcagtccaggtataaaacaaccaccttcactcctgtgtgttactgtaaagcttgccttctgtaaaatgtcttaagcataagagctgtaaaggaaaatactcatggattatattgtgatttgaaatcaggatgtaatacgatagtgacagcttaaagattcttctaaaactagatatgaaatttgaatgtggcacctgtctataatttgtaaagcactttggctttttctcagctacatggtgatgatgagttcttctcaacaagtgactaagctctaggggaatcagtttctcaatttgcatgagatacgggagcttcctaagacatgagactttcagttttaaaaccaggatagtcttgagagagctgcccttgtttttcggagacatgcaggcttcccaagatgtgagactttcagtgctaatcccaggaaaagtcctaaacaaaaggcaacgagttggttgcccaaccaagctgggaggccttctgaccgaggacctcctgaagtcatcaacccaaagagaagaactgcctcttagggctgactgatgcttacaaaagggattataaagcctgaataccaatttcttaatttgcaaagagaaatgatgtgacaaggaccaggaaactcaaagtccatatggtcagcattttctgtctctgtataaagccaatctattaatttaaagaacagaatgattatcacatgcattgaaatacacaaagtccaaacgatcagcaaattctcgcccggtgtgaagtcagtcttttaatttacaaagaaaaattactgtcacagagactggaatgctcaaagtccacatggtcagcacattttctgcttctactctacccttcatggaagaccaattcataatcagaaggctgcttagtgagcatgaagtgttggttagagtgagtgcttaaaggcactggactaagaaagcctaactttaccaaggggttcagactgtctttgtcaccaaatgctgaagtctttgcttcagcaatttttcctgcctctaggatgagtactgcaaagttgcctccaggaggcatcttattttccaagctgccatggatgactgaccgttttaagcgtccttcattcttcagatgtgctaataccatcaattaggtagtagagtttcacttccctaggagccattttgtctttgctacatttatctttgctcttattccaaagagcagccttcattctcttcctatcaaatctttcagcagcagaaggcaactgactgtatctctgagtaatgttgataagtattgtgttgtggaggctctgcatagtacagtggttaacggcacgggctgagaactgaggaatacctactgtctacttgtctactaccatgcagaactatagtaagtcactatatccctttgagccatagtttccagttctataaaatgggaaccatccatagttggttgtatcaaggactcaatgacagcaaacaagtaaaagaacccatatagtgtttgagacatgattgtgctcaagaaatgataggaaacaaacgtacaaacgacaagcattttttgctgcagtttggaagtattaatgttttacaacctccacaaactaaggttcatgatcgaagaacctcactgaatatttaactttagggataaaatgcacaacctataataattttagtgcaattgatttattatagtcaagggaaacatgactgaataacaaaagtaggttaggaaaatactgaaacagaataggatgaagaaaagcattttaatgaaaaaggaaaagcagagagcagagtagtaatctctcttggttcctctccttccgtcagcctgctgttcctgcccctctcttcttctctctggcctctagataccggaatgtctcaggcctcccatcccctctatcctccatttcgccacctgctctggccaaaaagtttgaaggaggacctatgaaaaatatccctggcctgggcttaagaagccttcaccctcattctcaactctgaggctaccagagcatgatcagttcatcatctcagtcaatcctcccagctcctctattagatccatatgactgccactttgtgaaagatacaaggaggacttggcaaaacaagggccccacctgaaatggatagctgagagcattaccacagtcggatctgctgggttgaattgtacacagcagatgccaacttccaatgaaattagaatcatatttctatacattttcttaagtgccagacatcattctaatcattttataggcattatctcacttagtgtctaaaaaaccctaaggttttgccatataactttcatccccactttattatctatctagaataactgaggcttatggaggaaaactgactgactcattgctgcttggctattaagtggaacttcccaagactctgtaactttggagactagtcacatatgaaatatgctaccctctcacttgtgtgatgacgttcagggtttggcgaatgttgagcaagccaataaggtaaggctgtatgcggtacaattctcacactcgttgctctttttgttgtaaccagcctctttaaacactatggcctgaccctctgaaccagccacctgaccattcttctgacttcccaataagcctttgccatcaccaaacatactggcctccatggtcttcatctttaatgccattaattaaaaaaatatgccccacagctctgcaagaagaattcagcaggcagttggcataaaaaggttgggaatggtttacatctttgagcttcagtattttaagtctgcaagttcatggagtgcaagggctgtggacaccctgcttgccaatttttctgccttaaccgttccctgcccccttgttgttcaatttctggccaatgtctaaattttccaaaaggaagtatggtcttttgcattatgacacatgattgccacccactggttaagaatgttttcactatgaaggtttagaaggtttgctgttgaggcaaaagttacccatttcccatgcccccagttcagttgtctggatatcccagaacaagaagcattaactgcttcaatttaagtcagattctcaaaatcccaaaggcatgtctttcacttatcccataaaacatctaattaaattatttcatttaattgtacatcttgaattatttgtttgcatcttgaattatttttgtcaatgcgcattttccaataaaggagtaatcagtggtctcaatgtcattcagatgaggccacccttatttatcagagttctaacaccaatcagtattcatccacagggctctttagtggaactgtggcactctttagtggaaatgtgagtttcagatttctgattaataaaaataatttgtaaatatgatcacataatttttgcaataccgttttcttttctaagaatcacctatagaaacacctactacgtgccaggcattgttttatgtgaacatttcatgtatgtaacagccccccctaaggtagaaattgttattgtcattcttattttgaagatgaaaagctgaggcatgaagagggtaagtcaccatccaaagtcacctatctaaaaaatgcaaagccaagattcaaactcaggaaatgtgttactagaatcttatctactatgccatgctgcctctcagaaagactatcactgcttcctccagcctcatcctcttgtcttttcctgggctggggccatcctcaccctgattggctctccccaaaggctcactctgacacccattccagtgctaaccctgttcagagtggacaggaactggtccatgcatctccttagatttaacacgataggctctgtctctcacaagggcaggcagcaagcaattgtcttttagaggaaaacaaaccatttgaactaaatgttgattcttgctctctctagaaatgcagacagaaatcggcaatcagtgtagttgatggataccagaaaaagaaataaaagtaaggaaatgaagaaaaattgggccaatggcactttaaaaatttcccaaaattttgaggacaacttccctttttttcaaggcacttgatgcttctctagatagaaaaattgttttcacctaaaatatcacactagctgttctgaaatcctcttgcttcttggcatgcttattaagaaattctgctcttgcagcaacaaatctcagctttctttgcttctagagaactttaaaatcattaactatcctttaaaaactcactcttggaaatacatgtggtctctttccctataactaaatatttgatacaagccactatcaacttgatactgacagtttaagggtgttgggtacgatgacctttgaggtgccttctggccataagtaccaaggaattcataaagttggattaaatgataacaaaaattggaactttccctttatcttcttttcttcttaaagaataagttaagatacattgatttcatttcacaacttgcacggaaatgagtgttttactgttgatgtttttatgatctgtagtttccattctttttaatagccttggtgcagtattaaaaaaactatcttggtgataaaagttattttagaagtaaaagttgctttagaaaagcaaacatgactaatataatccaagttttctcaggaaggaaagcgctagtgtgactggacaatgctgagacgcccaagaagatgattgaccttcaattacattgaagggaatgactgaactatttatctgtgagggattgtaaatcaggagccaagggaaagccttggaaattcaaatgtaaaaacctagttcagcaaaggagttgtcttaagcaatagtatataaatcaggcagggttaggttatactacagtaataaacagcccccccccccccaaatatcaatgacctaaacaacaggagtttatttattgctcatgatatacaaccaatttaagttaggaggggagttatgcttcacgcagtcatgccacatgaggtcatgatagcaccgtcttaacatgatgcacctgagttctcctggcaaaggaaaagaacattccagattctgcattcacaactgaaggctctcctaggcatgagacaccatgcctcttactgtgatttattgatcataataatgtatagcctcatttaattgcaaagggatcaggaaagtgtcattctgaacattctcagaaaagcagagacctgattatacatgagtgttagaagcctctacaacacagcaattgtggactgaatgcttcattcaggcaataagcaaaagcctccttcagcagcgtattatttaatcctcacataaccctgcaaggtgtgggctttcatgatccccctttctcggataaggagactgggaatcaaggaggttaaatagtctgcccagagatgctccccttcctattaagagcccagttgtaaacctgtgctcctgactaccatgtagctcttccctgagagctcctccaagccttggttaaagggccagaccctttgctctctgagcaggaggagagcaacgtctgccctcactgacccattaatagacacctgtcagtgaggaagggaggcttgttcacttcagggagctgtggtcgcttcccctgtgccactggaaaactaataattcatgaagttggctttcaggtacgagcaagctggactgaatagttgtttcaagtcataaacatagaaaagtaagttgataggagaagactatgtggagaaaatttaaccatgttaaatatttgaataaacatttaaaaatacatagcatatataggtgcatatataataaatttgagacagtaggcatgacagagttctgaaatagtttataagtatgtgagttgtaaatatcccatttatattatgcatagattataagtaaaatacacagaattgattctatgctccatcatctatgtggtcatctaatcatccatctctctaaactaacgtcaaagagacatataatttaaagcacatatgcaattctaaattttcttggataagcttttaaaaactaaaaataaatatataaaattaatttaatagtatattttatttaacccagtgcatgcaaatatgattatttcaacatttagtcaagtcgaaaattgttccatctttttggtacttagtttctgaaattgtgcatgtattttacccttaaagctaatctcaatttgggtgctaaaccttcagtggaaatccttgctctgtattcagtttataaaagatgcggttaaagaaaccaaactcacttgtccaaggtgttccaaagatacttcaaagtttgcaatcgtttagttaatctgttgacaatggttagattgctgttgtgtttatatataatgctagaaataatgcatatgttgggcatgtacattacaatatgatcctgtcttccagaccataaacacaattagtttttcctggaggattctaactcaccattgggtacctcttatatggaaaatcattagaaatgcctgtcctctctgcaaccagctgggaagaattttctgtcaaaagctagagatgtttgtgtgtttttgtcaatgggatcacaaacttgaagtcagaacagttggattctggatatgagtcttcttttaccagctgtgtgatcttaggtgttctgggtcccatttgggaaatgaggggtttaattgcctccaagcttgatctgtgcatggagcaatgtcgttatgagaattccccacattttgctcccttttggacctccctaaaattcccctaagaacacccctcactagtagaaatgtagaatcccagaccttaccccagatctactgaatcagagtctgtatttttaacaagatcccctacattggaggaaagttgtagaaagactgccctggaggatttctaacatttctgtgggctctcatattccttttaaatatacattagaatgaaatgcagatattttaagatgatgtggcctttcagagagtagttgcatttactaggatgtgaaagaaacacttttcaaatggtaacgatgtgaaggtgtcctaagtgcttgtgttgagtccagcactgtgctggtagctcacgaactcctcgtgacaacctggaaccccatgaaccccattttacaggtaaggaagcacaacctgagagacatgaaattatccaggcaggcttgcgtggctagtgattgtgaagcttggatttgagtacaggtcgtctggttccagagcttgcacgaaatcactgtgctagtaagaaacagagttcgaggttgaacccgggtgactcagcatcaaggaatgggctctctctttggggtgtgtgtctgtgtgtgtgtgtgtgtgtgtgtgtgtgtgtgtgagagagagagagagagagagagctttcttaattaccacaccatactacctccattttatattaaacagaatattggaatcttgacctttttctgtatttaattagatgctgctgtttaataacctatcacaaaagttaggcaggcattcacacacatggcgatgagaattccccacattttgttccctgtgagccctccctaaaactctcctgagaatacaacagctgcatttaaagaagctgaatcccctattgcagattttattcctgtaaaaatatattgaacttgacgaaacagagaaaatgtggcctgcttagtcagttaccctgacactatagctcttcacaaaagttttaagatatgatcatatatttaatataatatacttagtataacatgatatatgtgctatactatagcatagtatgtatatgtaatatatataatatacagtacagcatagcaattgtctaccagtgacagatttatttttaagttttttattgacacataatatttttacatatttttaggatatatgtggtattttgttacatgtacagaatgtgtaatggtcaagtcagggaatttagaatatccatcatcacaatcatttatcatttctatgtgttgagaacatttctagtcctcccctctagctattttgagatgtacaatacattggtgtgagctgtagtcaccgtactttactattaacattaaaacttcttccttctgtctactgcctgtttgtacttaactaatttctcttcacttaccctcccagaccgacaaacatctgcatccttcccagcctctggtaaccaccattgcgctctttttctccatattttaggtcccatctgtgagtgagcatgtgcgatatttctctttctgtgtctggcatatttcatttgacataactatctccagttccattaaggttgcagcaaataatatgatttcgttcttttttatagccaaatagtatttcattgtgtaaatataccacaattttttaatccgttatccatttatccactgatgggcacaaggtccgttccatatctttgctatcgtagatagtgctacaataaacattagggtgcatgtatccctttgatagactgattttctttccttggtataaataccaagtagtgggattgctggatcatacggtagttctatttttagtgattttttaagaaatatccatactgttttccataatggctatactaatttacttttacaccaacagtgtatgagtttccttttctccacatccttgctagcatctgttattttttgcaatgactgatttctatgaacaggagtctttggagccttccttcatagccatcgtctcacacagtcctcactggtgctattaccagctccatttgcagaaaaggaagctaaagccaaagcttaagtgagttcctgataaatagtccatattttacctcaggtcttctgattccagacatcacgtggactgtctgaaagacgcaaaattagacaaacagcaaaaaagagaccctgttggtgtccaacacttataatgaggctcacttctgaggacacgtgcagcctaagcaaggcagccactgcctctcaccttacagcttgctgggctgataatggccataggggatcctcagccaatgaggggtaagatctgtagataaacatccttgggtccagcatccttgacccttaatggacaattctgggggatgtttctcactgtctcttagagagtccccagtaggattgagctccagttgcccacagtggaagtctttccatgaatgcaccctttattggcttgtgtccacaccctgtcttacttcccaactccctcacttgtgattcctggcataacctcccaaataaaagagtttcaccccagttcttgtctcaggggaccacaaagagagtgactatgtggccccgtgaagatgaacttgtgacaatggcatgaccaaggtttaccacctgagctctccctgttagcgctagttacatgtagcatgtgagctgggttcttctttcccagtcattttcctgtcttaaccttggggtgaaggacaatgttcttgacctagaatggcctaggcagagtctgataagattgttgtggatgcaaagggaacagggttgtggttgctgagcattgcatccagtgcgtaccttgttcccttgctgcactctcatcatgtttggattcagatgaactttgatgttctgtgtgaggtggacgttagcactgtatctgtactgagttaggcgaggcggtcccggcaaagtaattacaaggaaatgctgtattttagattgtttgagttttccaatagagacatatcaatcttgcttgggaatactttgacttgtgctttgtgatcagatttccctgtgcttctggtgaagcttatggattcatgagttagctctgcaaatggagagtttgtgttagaagtcaaatcagttaaagctctttgatactgcacatattcatgggcagaattgctgcaaaaatcctctaaacacatacgaggagctacattatacctttaagtggcaggatcagcttcgtgacaaaaaccaaaccaggaatgagaggggaaaataatctaaatgtgttaagggaagtatgcaaaatggctgaaagctgacaaatggcagagccagaacgtgagttctgctgattccagacatcctgcctgatgaacataaaattggaaggaaaaaaaagtaaatgagctatgatgagaccaagtggcccatatgggtatcaaactcaacaggatggcatgaccaggcttttttactcaggcacaaagagcttttgagcattgtttgataatattccaaaaagaaaatgatagagccaaatttcccaaatgttccatgtaaaactaggaaatgactgaagcattcaccctcatttctaagtattgtaagtgtctggatcagaatccattgccatggcttattcattcagagcttgttgctggggattgggatgcttagactggcaggactggtgtctccttggctagacaaagatccttgcatggcattaagggagcctgtcctgacatttcataaaatcatttctgaaccgtgacgtttccagtattttattgtgaacattttcaaacataaagttgaaagaattttacactaaaccaccatgtgcccataacctcgattctacagtttacatttgacatttccatatacttgctttatatatataaatatacacatcacacacacacacacacagtccctgcctctatacatccaccttactttttatgcatttcaaagtaagcaacagatatgtaacactccaccccctaaatagatctgcatgcatattgttaattagaattcaatatttgcttttggttattttcttcttcagaggaaaatttacatactatgaaacccacaaagcttatgcgtcatgtttacattttgacaaacatatattactttggtgcaaaagtaattgctgtttttgacattaaaagtaatggcaaaaaccgcaattacttttgtgccaactgaatacaactgtgcaacccaaacccccatcaagatagaaaccatcattatgacctcagaaagtttcttcatgaccttcctagaggccaccaatattctgatttttcccatcatagacttgtttcaagtttcattggttctagaattttatatgaatgaaatcgtatggtatatatatttttgtttgatttctttcactcagcataagattttctttttctttcttttcttttcttttttttcttttcttttttttttttttttttttttttgagacagagtctcactctgtcacctaggctggagaacagtgatgcagtcttggctcactggacctctgcttcctgagttcgagcgattcttgtgtctcagccttctgagtagttggaattacaggtgcacaccaccatgcctggctaatttattgtatttttactagatctatggttttgccatgttggccaggctggtctcgaactcctgacctcaagtgatctgcccactttggcctcccaaagtgctgggattacaggtgtgagccatcacacctggccagcataagattttttagattcattcatgctcatacatcagcattcatttctctttgttgctaggtaatattctgtcacctggtcacttgtatagaccatatttattatctactctcctattgatggatgtctgagttggttccagcttttgattacaatgaataaaattgctataaaaacgttcatgcacaattctgtgtatagacctgtttttctttcgcttgggtagactcctagcagtaaaagggtatgtcatggggtagactcatattgagtgttatcagaagtgttcacttatttttctgaattggtcgatcctcttccggataacgcgtgagagcagtgacggctttgcatcctcacaaacatttgctgttactgatctttttaattttagcgattctggtgagtgtgtagtggcatcccattgtggatttaatttgcgttaccctaactacccatatgtatgcttattgaccattctgttctgttctgttccttaaaggaacattttgttcgtttattggctttgtttgtttttggcttggctaaagtcaaacttgcatcctccatctgacctgagatgagagtcagctcaaatagggatacctggagactgctcacgcgtgcatggttcgggggtcaacatcggcagagttttgggcagaattcatacacagaagttggggcttcctgtcactgagtctcttctatctggattttcctcccttaatttccaacagctactgttgtcatgaactctgttctctgttctgtaaacaagcagtccccaaccttttggcaccagggactggtttcatggaaggcaatttttccacatattggggacggggatgatggtttgggggtgaaagtgttccagctcacataatcaggcgtttgttagattctcataaggaacgtgcgacctagatccctcgcatgtgaggatcacaattgggtttgtaggtttgtactttgtactcctataagagtctaatgccactgctgatctcacaagaggtggagctcaggcagtaatgctcacttgtcagaggcacatctcctgctgtccggccaggttcctaacaggccacagaccagtaccggtccatggccgaggagttggggacccctgctataagccaccaagactatgggttttcagtcagaatgtagtttcccatctggcactggttggtcctcttatcaggctgaaagccagaaaaatgggaaatttacccagtgtcaaattcttccaagtgtttagcctccagttttttgtttgtttgtttgttttggttttttggttttttttgagacagagtcttgctgttgtcagcccgggctggagtgcaatggcgagatcttggctcactgcaacctccgcctcccaggttccagcaattctcctgcctcagcctcccaagtagctgggattacacgtgtgcaccaccacagcaagctaatttttgtatatttagtagagacggggtttcaccatgttggccaggctggtcttgaactcctgacctcaggtgatctgcctacctcagcctacgaaagtgctgggattacaggtgtgagccattgtgcccggcccaggtttttcatgcattgaagttcacactccacattccccaggtagttgtttattatatgtggccaaaagtttatagcagttttctacaggagaattggtcaaacaggggctactcagctataccagaagtagtgtcttctgcactataaatttgaatggctttagaatattccattgtatgaacgaacacaccttcttttattaaccttgccttctatggatggttattcatattcttcttattgttctctgttatgataactttgcctctgacacaaaatcaacctcactgtgatgcatactggatgtggaactgaagcaagggacaatttatctgagctcaagcttgctcatctgtaaaatgggataattataataacagaaaatatgtgctttaatgagacttaaatggaaataatatttccaccaaatgcaagtagtaatttagtgaaacaatgtgtgcaaagtacctagcactctctggcatgtaattaactcaaattaggtgctacttggttctctttgtagttgtcattgttaccattatccttgctgcctacactcataaatgtataaataaaagattggagaacaaatggcatgtacgcaaatgtgtttcttcctttttataaataaacataccatgaggattttttatgtcagtcaagttgtttttgagaacatgattttaatgactgcataatatttatttggatgatccatggtgttggaaaataataagttacatatctaccttatataaatttctctggggaaacaagtcattaaaaacaagcttatttctaatttcagcctaatgctgatagacaatgtcaactggataaagttgagtcgcacatttcagtagctagaatgctttttaaaagtactttcacgtttggactaataaaaatgacatatctgtctcatcccttttcaaggaagctgaagtgcctcatcaaatttattttattaggatcccgacagcaatcttgtggcctgggtgaaggtcaaggaggttttgccttttgcagaagggagtaacaagtgatgtgatgataaagtgttctttctctctcggttcatccatggtgggaaagagcccttcagctcattcttcagttggaggtggttcagggccccatgttgctcaaattggtgatgacagccagctgtttggtcccaattcgctgagactaggaattcaaacccaggaaaattgagacacctgtgtatgaaaagcataaagagaaaatttggttgccctcatgctcactcttatgccaagtatttattcaagaattaaatgaataagaatagggatttcaactacgttctatcctcctcctcctcctgcatctgcctgaccttcttgggagccagatgttccactgaacactttgcatgcactgtgactatctaatgcaatccttgggacagatctgtgaaatagagtctgttattagtcccgttttaaagatgaggacactaagattcagatggtttaagtaacctgtccagtgtccacagctcctgtattagctgagagtcttgtgccattatatcagaaaagtctgcttgtgtcttacagtcttgatcagaaacaagtatatccctcagaacatagaggcggcaatggggggtgactttgttctaacccacaaggaagattattacatgaatagtatgggaatcttggcagaaaattagtgggttattttttagtccttattagtaaggactccaggcaagatagagttttgttttgtttttgtgtttttttttttttttttttttttttttgagacagagttttgctgttgttgcccaggcgggagtgcaatggtgcaatcttggctcaccgcaacctctgcctcccaggttcaaacgattcccctgcctcagcctcccgagtaactgggactacaggcatgcgccaccaggcccggctaattttttatttttagtacagacggggtttctccatgttggtcaggctggtctcgaactcccgacgtcaggtgatctgcccacctcagcctcccaaaatgctgggattataagcatgagccaccgcacctggcaagatagagtcttttaactttgaaaagttaggattcaaatcagtctagccattgaatcgtatttattgagcacctgctgtgtatcaacctcagtagaagacccaagagatatactggtgaatgggatagacatggtctatatttcagaggcctactagtatacagttgaagacgggcattgaacacaggatcacagctatgctaataggggtgttactgcagggccatccaacctagaacaaggatcatattaccagcgtttagagaatagggtatacacatgcttttaaatgcacagagtgtaccacttcagagaatactgatttctccttagtttgggctgctataacaataccagtgactgggtagtatagaaaacaaacatttatttctcccagttctggagaccagaagttacagatcaggtaccagcagggtagggtttttggggagacctgtcctcttggttcacagacagctgccttttcattgtaaactcacacagtaaagagagagagagagagagaaagagagagagagaaagagctcgcaaggatcatctccttagaatggtactaattccatcatcgggttccaccctcatgacctcatctaaacctaattacctttttttttttgagacagagtttggctcttgttgtccaggctggagtacagtggtgtgatctcggctcaccataacctccgcctcccaggttcaagcaatcctcctgcctcaggctcccaaattgctgggattacaggcatgcgccaccacgcccagctaattttctatttttagtagagacggggtttcttcatgttggtcaggctggtctcgaactcccaacctcaggtgatctgcccgcctcggcctcccaaagtgctgggattacaggcctgagccactgtgcccggccacctaattacttcttaatggcccaatctccaaatgttatcacattggggtttagggcttcaacatagtaatttggaggaggacacagaagttcagctcgtaacattccactctgccctctccccacacatttatgtctttctcacatgcaaaatgtattcattgcatctcaacagcccaaaaagtcttaactcgttccagcatcaattgtcaaacaagctagtacaggagttgaacattttccagattcagaaagatctccctgcccttaatcccagcattttggaaggctgaggcaggtggatcacttgaggtcaggagtttgagaccagcctggccaacatggtgaaaccctgtatctactaaaaataaaaataaaaaaaaaatagccaggtgtggtggtgggtacctgtaatccaaactatttggaaggctgaggcaggagaataggaggattgactgaacccgggaggcagaggttgcagtgagccaagaccatcgtgccactgcattccagcctgggcaacaagacaagactgtctcaacaacaacagaaaagaaataaaaacaccagaaagatctcactaaactggagcaatggactaaagcctcaaagaggaaatttcatttataaggttaggctgtagaagtaagtacagaatcaagagatttggcataagaaaaacctacgtggaaaagatcagaaaaagtccctcaagcacagagtcaatattaattagcaaagcattcggtgctgctgttttaacagcaacagtgaattcgcacgtttgtttttcaggccatgcaaagggaaaaatgatttatgtctattcccagacagtgtgttttaaacggtgtcttccctttcaagagacttttctagtaagaattttttttaatagggaaataagtaataactttgagagcaatttaacttgatcatgaatcagaatgattcagaaccacaaaagaagctgatattctttcatgttctctaaatatcttcactaaatgtaaagtaattggacatttataagaattcagactctcccataacaaaagtaataccaatcatgggttggtataggatgcacagttttaaatacagcatcttacttgattctcaaaatactcttgggagaagagcccaactggtgtttttatgtgtagtcactgtgtgtccacctgtttcagtaaagcattaggacaatttacataactctataccgtacagtataaacaaggctgtgatgaaatttgaaaggaagacaataaggataggagagctataaagaaggcaaaacaagtgaacacaattccaatctgtgtagtcctgcacatttgctggaggtggaacaaaatccttgcccccatgttatgcatatggaaattgagatttggagagattactgacatgcccagtatcacagagctagtgagtaacagagcccaaaacacatcagccccaccgaaattctgttgttttctctagtactctatgctgccttccaataacatgaaatatggaatttgtattggaaaagatgccaactcgcagagaaactcgatagaactatagttggaagtgtcttttcaatatgagcctctagctataaatggatgaaatttccactccctcaaagcttagaactttcttactcttagcagctcactagttgtttaacatacctaatattaaccatctggtcagggagctaaatacaatgaagggcatccagctattatcccacccatttgcctatcccaagttatgttttattaggttgagttgtcaattttaaataatcaagaaagatagctccaggtaagtctcactatctcgttaataaccctttaccaattgcagctgtttcgagaccagacctttgcaatgagtttagaaagctgctgtggacctatcataatttttactacactttgtggccacatgaactggcagaagaggctgtcctaaaatcctaatgtggcaaaaaccaattttcagaagtcaatttggatgttataggtagcgctcttcacacccaataaattgcttatctttggctttgaactgatgggcacgtacacaaaagattggagccaactgattgcattattagctgaggaaaaagtgtgtgactgtggcgaatttagcaaggggtagtctggagaaggatctgtgacctgggaaaagtttgttttgacgtggaaggtcaggagtttttgtttgtctcttgtgtccctttttacgttcatgtctgtccagaagtattcatcttctctttgtggtttaaatgccctgggcagctgaattactgtgtgacctcctattgtcagagcatctttgtggaggagaacccatcacctgtctctcgaaaacagttgtcctttgaactttcaagattatggggaaaaaatgtacttattttctcaatcatggagagcatgtcctttagagatacctttggctgcagatatgtgacacagctgatttaaaatagcttaagtacccaggtgcagtggctcatgcctgtaatcccaacacatccggaggctgaggtgggtggatcacctgaggttaggagtttgagaccggcctggccaacatggtgaaaccccgcctctactaaaaatataaaaattagccaggtgtggtggcagcacctgtaatcccagctactcaggaggctgaggcaggagaatcccttgaacccaggaggcagaggttgcagtgagccgagatcgcaccattgcactccagcctgggcaataagcacaaaacttcatctcaaaaaataaaataggttgagtaagtagaggtgtttttcttgcctaacgagaagtctcagtgtaggtgatgctgggtttggttcaactattcaacagtgctatgagaaattcaggctattcctctacttcatctcagcatccttaattgtctggctttaatcttcatagttttccccttatattggtctgttttcatgctgttgatagagacatagctgagactgggaagaaaaagaggtttaattggacttacagttccacatggctggggaggccctagaatcatgacagggggcaaaaggcacttctttcttggtggcggcaagggaacatgagaaagaagcaaaagcagaaacccctgataaacccatcagatgtcttgagatttattcactatcatgagaatagcacaggaaagaccagcccccaggattcaattacctcccctaggtccctcccacaacacgtgggaattctgggagatacagttcaagttgagatttgggtggggacacagtcaaaccatatcactcctcatggtgtgcaagatggctgatacatgtctagctatcatgtcagcaagactgggagaatgtggaaagggtgagccagccagccatgcttgtcctctttggaataagaaagtcttatcaaaaaccactagaagtctactgtttgtctctcataggccaggactgtgttatgacacagctatgcttagctgcaaaggaggctgacacagcaagcatttggctgttttatttgtgccttaaacaaaatacaagctctacagcaagaagaaggagagaaataaatgttagggagatgagcaaccatgtcactatgggttgtatagtcaaatacatatatttgggaaacgttattttcttgctgacagaacttctcagaggtctcaatatgctaagacacattgaagctcttgatggggaatagtcattatatttggcattttgccagagtaaacaaagaacccttaatttattctttagaatacctattaattcagaagtgttctgaatggcgtcatgaaatactatgttagtgccagctcacatcctttgctgagagagttaaacgtatttgtctcaaatcagcacagccttctacagctaaggcaggtgtactggctgctccaattgagaacaaacaaggcaccagggcctttgcatgtaccccatgatgaaaagatggtggcctaagtgcaaaatggttaatgaaataccaaactcagataccaggccactggtgtcttccagttcactacatgtttaaggcaaaaataagagagcggttttctcagacagagtcttgagactacaaaacagtcaagacatttccccaagcaaactcagaaaaatattaagcctagacaatgtagagcgttagtagttagggaatgcagtatttcaattccagatctaccatttataagctgtgtgtttttgggtaaggtactctgagacttagtgttctaatctgtaaaaggggataattccttccactggagttctaattaagactcattagggtgacgatggttgtaaagtgcttattgcagtacagtggagctgtttctgtcccagatcctttatcaaggattgagccaagcggaatccttgtctttgttagtccaaattggattccccattcctcaaggtcttgtatagcttaacttataactttcaaagcaagatatcctgacattgctgttttgaccttgacatttaaaccatgctttgaaattaagttttgtgtctttaccttgccagtagtatttgctccaagaagtaagtgcacaccaccagtctcaaattcagttcataatattgctgctaagaatgatgcacacaaaataaaacaagcaatggcaaaaactgggcacagtaaaatttgctggagataggaaattggctaaaagatcaaatattgctggcatcatgaaaaaccacaaaaaaatcctatgaagaattagacttggcagaaagaacgagagcaaaataaaattataatggccaaaactacatagaagaggttttattattgactagaaatcaatgcaaatataaaaaaagacttcctgtcaaaaatacacaaccgcaaaactggctttggcggactaaggctaccaaagaaaatccacaagtcagcagttgccattggtaaaatttaacttggcaaaaaacaatcaatgaaccaaatagttgacataaaatgtacacacagcacaattaatcctgatgaaaataattccagcaaagtaaaattgatttttttaattcagttgtttatgccatgtaggaaactgatcaatgacttaatttgacgtgataaagtttgctttgagaaacattggatgaacaatgttggaaaaagtctgactcattttattgctttgaaatatatataaaaagctagcaaggtccaaatgataggattaaaatatcctatactcattttaaatatacaatgcttagcaccagctggacacggtggctcacgcctgtaatcccagcactttgagaggccgaggcgggcagatcacgaggtcaggagttcgagaccagcctacccaacatgtcgaaaccctgtgtctactaaaaatacagagattagccaggtgcggtggcatgtgcctatagtcccagctactcaggaggctgatgcagcagactcacttgaacgcgggagccggaggtcacagcgagccaaaaccgtgtcattgcactccagcccgggcgacgaagcaagactccctccgtctcaaaaaaaaaaaaaaaaaaaaaaaaaagcctagcaccaaagtattagcaagttcctgttatttattaatgttctcatactttcattgaatttttaaacctaatgatgtttattttcaaacacttcagtccatttattattgaatataaaatgggtgctaattacaaatgggtcttatgtatgcccttgggttgtctagcaagatggtttcataggtagtaataagagcagcaagagaagaaaatagtgtggcctttacctttactgaacactcactttggaataggcctcatgcttgggactgcctccgtcagtgtgcagccttcagcggctacatttggaaatggtacaagtattaggttggcgcaaaaagtagttgcggttttgccactgaaagtaatggcaaatacttagaaatatttagaatatttagaaagtacctgctgttctgactatcttaattcagatgtgcactcaccttttggctcacgacaacaaaagccttcgaaattcctgcctgtttagtttgtgttgacacattgcagattcaactctgacatgttatttccttatgctgagggtgtcttgttgagtttcatgggttttgtgcttccctggtgccttattaggcttataactcacagagctatgagtttaaatgtcagggttgtcaccaaaacaatggagcaaaaagcaagttgttgacattctttggacgcaatttgcaatcccctttattttcctgtaacgtttttgtgtttccaggtgacagttgcccaccgaaccacagaaccacaaagcccagagttttagttacatactgctgctctaggatcagtagcccttaggtccaaaagccgtttctgatacagccttgggcaagctggttccttctctgagcctgggcccctgtcctataaagtaaaggtgttattacccttcataggattgttgtgagaacaaagtatttacattcttcatataatcagaacttttccaaaaacatgggatcttttacatggctcaacatgtttaaagctgtttatgttcatctgatattttaacattttgtagagtagaaaatgcttcaagcaaataaatgagctttatggtaattttttttgccagcatttagaagctggtggttaataaatactaatatgtatttagaagtttagaacagagatttttcagcaacaaccacaggctagatatagcccactacctgtttttgtcaataaagctttaatggaacataagcatggccattcattaatatatgatcaatagattttttttggtacaagggcagaattgagtagttgcaatacaaacagtgtggattacaatgcctaaaatatttactacctggttctttatagacaaaatttacagactcctgaggcagggttttatcaattcctttccatgtctatggatttagatataagcgtatattttgttaaatattacagcagactttgaggtggctatcatctccattttacagatgtagaggatcaggctcacaggtagtgaatggcagaaccaaggatgaattccagcccactaacgtcacatctctatttgatcattagcgtatagacttttggtccttcataaattttactttataaagatattttacgttgtataattgatgtcatggccatattgtttaatcatcactcaccatgcacctattgtgtggcaggcactattctatccattagggcacaatagtgaacgaaaaacttgctgccatcagagaacttgtgttctgggctttcatgcacctgccttgcaggcgtcaggaatctgaatcacactcattccctccatcacttggctcaccagtgggaccagacaggagtcctgcagtttcagcaatgaaccccagggcttggtgcctgctctggaggtggggaatggggttcacagtttagtggaagattgcctttagggagcactcttggtttctagaacctgatatagatgagggatgtaatgaattcgagtctgaatgtttatttgccatggacttctatctcacgactttgctataagggctacacgtcggaaatgggatctaagtaaacgtagagtccacaagtttcaggacttatatagatgagtgaatctcagattttcacgtgcatacagattacctgaggatcttgtaaaaaatgtagtttctgatttcaagtctctgggatagggcctaggactcagcatttataacgacatcctaagagatgctctgaggaccatactttgcatagcaagaaatgagaacagtccaggagcctctaagatccctcacatttgaggctagaagcatgtaacatgaatgggttctcaaacctaaaagtcagggcttgggcataaactaaaactgtgatcacctcgcgtagatttgaggctttgactggtcgtcaaccccacccacaaaagcctacagcttcctcctaccccaggtcccagcttctccacttctctccaactacctcccacttttcctcaatttcaggctctttcgtgcctccagcccagtctacagcatgttccctggttcagaccatcccaatcagacccctatagagatgccaagccattcgtttgtgggccgggcacggtggctcatgcctgtaatcccagcactttgggaggccgaggcgggcagatcatgaggtcaggagttggagaccagcccgaccaatatggtgagaccctgtctctactaaaaatacaaaaatgagttgggcatggtggtgcacccctgtaatcccagccacttgggaggctgaggcgggagaatcgcttgaacccaggaggcagaggttgcagtgagtcgagatcgcgtcattgcactccagactgggcgacaaagcgaaactgcatctcaaaaaaaaaaaaaaaaataagtgcttgtctctgctcaaagagaagtcagaaatggcagcaacattcctagcccaggctctgcactctcggtaatccctctgactgactctcaagtcttccccgtctgtctgctccgactgcacgagttggtgattaaactttaaaacaacaattagacccttgattttcaaagcaaacttggtttatagaccagacttcagcattcattacaatacagactaataaaaacaaatccggaaacatacgctttttaagctgtggtggtgtgaaatctgtaacagcattaaaaccattttgaaaaaaaaaaagtcatttgggaacccccagcaaaatactgtgtggatattcttttctattcctcattcaagtatattgcatatatataaacataatatatatgtttgttactgtaatttttctacttattatataacattttctatgttgctacatgatctttgtaaatattatttttaaagactgtacaatatttcatgtagttgacaagccacaatatttgtaaacataaaacatttctcccctgggaaatattttagtgatctccttcttcctttctctctcttcttctttcttccttctttccttcctttcttttctccttctcctcctctttgcttttccccctactccctttttctccatcttctgctatcagaaaaaaaaaaattccatgagcacttggtaaccatctactttatgttgaattatttcctagggtaaattctcagtcagtagtaggaggcatatttttcccattcaatgtagtttgagaagcccaatgaccaaatcatgagatgttgccattctctatgaaaatcacaaaggatgactccctaaatacattttatgtctacagagaaactgtataattctgacattaatttcagttccttacaactgccttcattccttggggagggtactgaaatgagctccagctggagactaagtcagctcaagccactaagtcatgggctggtcttgcacaaattattttctgtttctctgtttctgtaagcttacaatttatatattgtatattttataaacatacctcatcagataaggttatagtgaaaaatatatctgctagggtattcacttcataagggaaggcttttttgtctgttttgttcactacatactatatccccagcatctatagcagtgcctggcacatggtgggtgtataataactgtttgtttcatgattcattttttaaaagatctagaaaaagaaatctttactccaaagggtttgaagcagtgattcataagtattttaagaataaatgtatctttcacacctgtgtgcctataaatataatttcacaaataattctagtaagttcagagaatctagaaatttttttctgtgcataccaggcaatgctggcattaaaaatttattttgaaaatcctctaagttctaattcacttgacattatcctaccaagttaaagaaccatgaaataataagtaattcatatcactgcattcatttctcattatggactgtcaaaattgacattcttgttcccgttttatagaagcaaatcttagactcagaaaatttcaaagaacttatccaaagtgacacaattcttcaatagagagcagggactacaacctaaattttctaattcaagtccagtagggtctgccttaaatgcctcccactgtcaccgtgttgatttgtataacctttgtcttcctagcatttgattgacggctactgttagtacagatcatctgggctccttgtagtgatggacacattttcatgaggcaaggtcttagatgattaaaacaaggcagatgctaatgccatcctcaccttcatctggaactgtctaactagagttcgttaacttgtcagccctagttccttttgagcaccaggctgatataataaaatattgcaaatcaatagaagctttaaagaagcttcatctgtctttctttgttacttttttcctttcttcttcttttattactacttctttctttgccgctttaaagggaaaactgctatccctcttattggctgtacaattctgttttctctgtttattttgagttgttggaaattcaggtacatccaggttttcccaaatacacctattattaccccaaagagtaggaagccgatcttatctagattcactcaccaaatctagaatctcccaagagactccaaatttagtacattaatttttcttaagtataacattgctcagtaactatgtgggtgaagatctgaaagttctgcagcactgtttcatttataaaaataaaggtaacggtacttttgcgcaagatttgtgtggaatctaaaaacttccccaagttagtaaggaaggcactgtgatagtatctactaatgaaaatgtgagcacagagatggttataaaataccttatttttctcttcttcattattattgctcatttcatttgattagcaatttctagactcactcaacctccatctataaaagaaaccattagtctttgcctatgtctgctaaagcgaacttcttgttctgtctcatcttcattccctactcagtttctgtcttctccagcccttcttacattattgaaataattgactctatcaggtggatttctccagttgaacacatttggatttgtcctgtggaaacaccataagtacttttttttttttttttttttttttttttttttttttttgaggtggagtcttcgtcttttgccccggctggagtgccgtgagtggcacagtctaggctgactgcaacctccacctcccgggttcaagcgattctcctgcctcagcctactgagtagctgggattataggcacccaccaccatgcctggctaattttttgtatttttagtagagatgggatttcaccgtgttggccagcctggtctcgaactcctgacctcaggtgatccacctacctcggcctcccaaagtgctgggattacaggcatgaaccactgctcccagcccaccataagtactttaatatgctaatttatttcaaacaatatgggaatcagttcaaagcacatagtctcttccatgcacatcttcatgccggaatttgctaggcgcttgtacctccactcccttcttctcagtcctttgtccaaggaattcttccctcaaagagttctcagtcggaaagcatgtataagacaagaaaataaatggataccaaaatcaacaagtgaagtaaattcccagaaagcacttgcaatagtatatgataagaagtgggaactccgtaaaagaggcagaaaggaaatacctgaaaaggttaagcaagcgagtaatagcctggagagaagagttacagaaatgtttcatagaaaaggtgatctttgaggtgagcttttatgaataggcaaaatttgggtaaagaggtagacccatttttaagagcagggtgacatgaaaatctcaggatatattactcagcaattaatcctcattgttgtaacaaatagttacaaaattctcgttgcatggctctggcttaactgcaaagcaaagtagaaaatggagaagctcccaggcaaggccaacaacgcctggtctgtgctgcacgtgaagatatctgagcacttgtgacccctgctttgccctctttgtcattgcaatggggttactgggaaagcctctcccatggtggttgacaagagggaaactttgggaaatgttctcaggagtaacccacattattttcacgcctgaaagatgcaaggttggatagagagagaagttgggctgtggtacgcttacaacagagatctcaactgaccctgcagagagctttaagatgaggagaacccttctgtgttgtccttactcaggacaaggagctgaggtcttatgcctccacattgactagtcattgaatgtaggctcatttcaggaagggagtataatcttgggagaggtgctgtcttcagcagaaggcaaggcctcttagtttatagctgtcagcctccaacttcccagtggctgaaagaatgaatgcttcagttccaaataaagggatctgagcagcaaatcccatcgtcctgtattttcattgaagtagcatttcataaccagtaacaactgtcttcccctgaaagtgtggtttaaatttaaagttggtgacttccttctgacttgtcaaggcgtgggcatacgcaattttttcctctatggttatagcttccaaactgttagctatatagatacctactttttaagataagtgagacctcaatcacaattaactctgtaagttattgaaaaccggtttgatgatgatcatcatcatcctgtgtacaccttgtgtgagcttgaggtcctattgtaggattaatcatcagagcagtatctgcagtctgcagtgcatttcttcttctttatttgtttagaaaaatcccactcttcctcccaaaattaactttattgtcaacttgataagaagatttctgaacagaaataaaataaccctgatttgtggtgtttgccaattactgtggtataaatactcacactgtggctgatgccaagctacaaacatgacatcatggaattggaagaaatagtaaaaatcatttataccttctccaaaacactcactgttcccaaaactttcacctcaataattctgtccactggtatatcaacatggtactggtgtagtaatgatccattccaggtacggacaaaaaaagataaataaaacaacaaaaaacttactaaatgccatatggttttatcatcttgtgctggcaatttgtaaacatcatcagtgataaagtacttctcccaaatgggatgaatcatacctatcctcaccctgcttttggacactggtatatcctctcaaaggcattaataactatgttataatgcaaatatcacgttatctttctatgatttttctaacccaatagactgtgagttcttcaagcttatgtatttgggtacagaacacctcgccaaaatccttggcatatggtagatgctcaacacaggtgcactaacttgttagttgaagtgaccggtacaacctagttaactgaatcagaaccatgaattcagaggatagtagtaaaaaatcaagttcatgaagtttttaatgagcagtatgttttgcctaagactctatgattctcactgtggaatgaaccacatagactccagaatgtgtcttttcttaaaggcaatagaggcatgcagtgaataaaatgcactgagagaagcccataaaacaatattcgtaagtacagagaaaggcaatattaatgccaatttcaggggatctgttcaagttcaccggaaggcagagtttttagcaattttttaaaggttgaacatgtctttaggaggtagcaacaagacaaaggtccaggaagagggtgtgatgcagtggggaagcatgcagtcaccttgtgccgaacttaacaggtcaagaactccgtatgtgaataatggtggaaatatgtggagttacaggtacaactctgtaagggcattagcctgtaccagctatcattgcgtaccaggctatgtgtggactttgtccttgtgaatctggtaaaagttaatcatcaggtctcaggagttcagcaaccgaccatcatgagctatatagtattagtctgcagctctacctgagagcagcccagaaaccaaataggaatatatcagacattatcccagagagaaggctcagtcaaggatctgcagctgggacctgcatatcttaattcccctgttcctgggaaagttatccaatagctactgaaatacaagatggaaggtatcctctctgtaccatagctaaaggattgctcacaaaaatgaaagtgcaattacagaaaaattatccttgggctatgaccacatctcctgagtattttattgccaccacgactcatgatttcaattctcaggactgagtatctctgctgaacgcaaatttaaattcttaatatgagaagctgcgctttccagtcgtgtgtcaatgcaaagtgagcggatttgggtttaactcccttggactgagtgcaattatatgttgggaggggactaacaaggtagcccatgtaacaatactgtcgtaattatgtgcaatattttcatttttacttctgatcaaccgcaagagtagattgaatgctattgttcagtttgcacttaaaaatgatgatttttttatacctggagtttaacatctgagtttttgtttaaaggaaaaattgtccttgcctttgaaagttagggtcatgttaaaatatttactaattctcataaaatattttttttctgagcacggttgaaaataaaaatatcttggtcctgtcctttgaataatgtcaagattgagtgtacctctggagaaatattgatagagactcaaagcaataccactctcccttgtcacttttctctgtgtactgtggacaagttgctcaacctcattcaaactcagtttttctcaacaaaatttgatatcaccataaaggaggagactcggttgcctttgtttttattattaaaaggaagcattgagtctaactgatatgaaacatttctgtatatgcctaagaacttatgaagctcataggataagaattcttggcaatccaaataatctcacattgtctctaatctgttataatgctgctcttgcctcataacttttgttctttgtattccttaaaaagacctaagagagctcaagattatggggtgctgccaaatataacactagtcttctatttttatttttaaataaaactttgtaattggtaaagtcacagaatcagtgtgcatatgatcaaagtctataaaataatgaaccatgcataattgcagcagagttaccaaggaaggctgtaaggatgatctcactggtgcagccaataccccagtaatcaatatggatgcctgggtgacaactccttccttcctaactttcacagcttgcctgactgggatagccaaggaaggcatctgtgaagaggcagcatctttagagtttatgtgggaagtgcactctaggtaagacagatgctatatacaaaagcaggaaaatgtaaaatttgttcgtaaagagcaactagttgcatttgatctaaagtagatgattccagtacaaaaaggaaattacagaagttttctcagctccaattttagagagcctttaatatcatgctaagagggtagagtagaccacattccacaaagaagaaacagtattttatttgttcattccttcttacaaaaaatatccacctagtacctactctgtactagcttaaaggtaacttttgaaaaaaaaaattttataatgcctagtcaagaagcatatctggatggaatgaaggagaatgagacttcagggcaggaaagaaggcaagttaggatactattgggatggtccagataagagagagcaccgtctgaagggtctggcttataacaaagaggaaataatctttgagaccaaacagaaaagtgtagcctcaagaaatattctttgtcatcctagtggttgctttagaatttgtagtatacatctttaacttatcacagttcgtgttaaataatattatagcatttcatatatggtataagaaccttacagtaaaacactttcattttctcctttcccagcctttgcactactgctcctctggtttttagttgctcataggttgtaaactctacattacattgctattattttttactttaaacaatcaattttccttctaaacatagaaaaaggcatatttttccacatatacaccactttctgtgctcttcattcctttgtgtagattcatatatccatccaacattatttttggtttggatgaaggactattgaacatttcttacaatgaggttctgctggtgatgaattccttcgccttttgtatgtgcatctgaaaaagtcttacttttgctttcaataatgggagatatcttcactggatacagaattctgagttgacaaattttatttttctttgagcatttcaacggttcactccattatcttctgacttgcattgttgctaacaagacatctgctgtcattcttctctttttcctctgtgtgccatgtgtcttcttccctctagctgctctcaagaatttatttttattagtggttttgagcaatttgattatgataagaaacatttttgagtggagaatcaagggaaggttgaaacagataagacgtcaatgctgggaaaaaaggttaattgtgagactggttgttccttatttgagcctgataataacaatctcttcaggtacaggacaaatgtcatgacagaatgcactttaaaagaaaaataatagctaacacttgaagattgctatatatacctatgtgtgtgggtgtgtatgtatacatacacatatacatatatatgcacatacacacccacacacacatacataaagatagtgttcatacatataagatctaacttctaagatatataagatcctattctaacatatttaatatgttgcatatattagaatatatatttgaacagtatctcatacaaagtatgtttacacaaagtaggtgctctttaaatgttaactattacataaatgtacacacacacattttacactaaaaacaattctatgatgtaggtagtatgataatcttcattttacacattttttttaagatggagtttcactcttgtcacccaggctggagtgcaacggtgcaatctcagctcattgcagcctccgcctcctgggttcaagtgattctcctgcctcagcctccagagtagctgggattacaggcacctggcaccatgcctggctaatttttgcatttttagtagagacagggttttgccatgttggccaggctggtctcgaagtcctaacctcatgtgatctacctaactcagcctcccaaagtgctgggattataggtgtgagccaccgtgccgggcctctacatattacttctaatccttaacataacagcccatgattccactctttcaatctcgtttcttttaactttgaaccattctttgccaattactttacctacctgtgtctcagtttcttcatttgcatcatgaagctaataataaaaccaaaaggctgttttgagtattaaatgagataattcatttgaaaagtgctcagcatagcgccagacgcgggagagcactcagtaagagtgaggaggtggtactgttatcgctgctgttttatgctttcttctgcctgcgagttcccacttggttcattcaaagcacccacactgtcctacaaagccaagttagcatgcagcctactgccctgatcatgcagtcacaatctctgtttctgctaacagtcagtaaacacaatttagcatctcgatgggtttcattgctccacataggctcatttagacttttcaactagattaactcatcactcattcaattcgtgtgctgtctgaggacacaccaggtgccaaggactgttctggtttactagggttagaaaggtaaataagaaagataaaaattaaatccctgcctcatggatcttatgtatgggggtgggggagacaaacaaaaataatataaataagtaaaatatgtggtatgatagatgaaaacaagggacatagatacaaataaagcacagaagggaaataggaagtgttggggataccatatattttggataccgaggtcaaatttcactgtgtgggcaggattatctcacccatttcagaagagaggaaactgatgctcagagaagggtggtgaattttttcatttcatgcagcattggtttagagacaagatagaaatcaagattctccaacttacagtccaagacatatttctgtagcgggcagaagctgaactctatttgtgctcctaggtggaaaacaatggtcctgtagtcctcatcaccatttcccatgtctgaaactgtctttgtctacctcttttcagttcttctcaacttcataacctattcttgctgtatctaaaaagcattaatgatccactggcataagaattttgggttagctcaagccaggtaggatagacttgaccatatgttcgtgcaagttacaaacagccatccccttagggtatacacttgcagcacccatgggtgtgtggttgcagaacacagggtaaatttcagccctcagccacttcctgcagggacttttgtacagcgtacaacctttaccaccataaatggaggctttttgtatttcacacatcatttaactagtgaaagttgcataatagatactcagtgaatcatggatgattgaattctttctcatttttcatttcctatatgattcagatcctttatatttcagttcatggtaaaggacaaaaattatttgtcaaatattgattgagcacctactatatgccagacactggtctaggcacaggggtacagctgtggaaaactgacaaaaatccctgcatttatggggcttacatttataatatatatttatatatcatttgtctcttcttaatagaaaagtatatagaggtatgtatatatacatacatgcacatatactatatactataagtatatatacttatgtatacatatacatatacagatatatactttatgtgtattatatatagtgtattgtatacatgtttatatactatatatgtgtagtatatatagaacaccatatatatgcttatatactctatgtctattatatatagtaatgtatatatttagtatgttagattgtgatattgccaaaaaaaaaaagagtaaaataaagcacaggaggggaaatgaagtttgaaggatgttttagaaatactgggtagaggctgggcgtggtggctaatgcctctaagcccagcactttgggagaccgaggtgggtggaatcacatgaggtcaggagttcgagaccagcctggctaacatggccaaaccccatctctactaaaaatacaaaaattagctgggtgtcgttttgcatgcatgtcatcccagctactgaggaggctgaggaaggataatcaattgaacctgggaggcagaggttgcagtaagccgagatcgtgcccctgcactccagcctgggagagagagtgagatttcatctcaataaggaaatagtgggtagagtggccaggacagggctcatggagtaggtgacttgtgaggaaaggtctgaggaaagtgaaagaactgctgtggaagacagaaccaaggccccaggattgttcacattctactccttggaacctgtgaatgtgttaccttatatggccaaatagactttgcaaatgtgattcaagttaaggattttggattatgttgatgggtccaatgttatcaccagggtccttatgagagggaggtaatgtgtcagagccagaaagggatttgaagatgctacgctcctggctttgaagatgaaggaagggtccatgagccaaggaatgcaggcagcctttaacagttggagaaggcaaggataccttctggtgtacatcttccagaaggaacacagttctgatgacaccttgattttagcacaggaaggtctgtttgggacattcgaccccagaaatgtaagataataaatgtgtgttgttttaagtcgctgagtttgttatgacttgttatagcagccattggaaactaatacagcaattctgtggctatctggcggaagagatacccaggcagggagaccagcaaatctgcaggctctgaagtgggggtgggtctggtgtgctccaggatgccagtgtgcctggactgagctggagtgagtcaggggagcttgcagtaacaggggcagagtgcagatgacatgagattacatgacacactgtaacccggaacaaggacactggcttcactccaggtgctaggagatcgcactggaagctacgaagcagaggagggacatcacccagttcacgtttcaacaggaccgctctggccaccctgggggagggtggtgaggaagaggatgtagaggtatagtcaggagatgtggagcagttaggaggattgtgttttgatccaggaaaagatgattttggcttggagcaaggtggtgggaattggataagggtaagagggtaagaaatagttatattgtgaatgtattttgaagatggaggtcattaaccagaaaagggtaaatgtgatacatgtaggctgaactggaagagacagtgaataaaattcctttgctaattaaactttcttttttttttttctttttctttttttttttctttttcttttttttttttttttttttttgaggtggagtcctgctctgtcacccaggttggagtgcagtggcacaatctcagctcactgcagcctctgcctccctggttcaaacaattttcctgcctcagcttccgaagtagctgggattacaggagtgtgccaccacgcccagctaatttttgtatctttagtagagatggggttccaccatgttggctaggctggtctcaaactcctgatctcaagtgatccacccacctcaacctcccaaagtactgagattacaggcgttaactgaactttttttttttttttttttttgagacagtctggctctgttgcccgggatgaagtgctgtggcgtgaactcagctctcactgcaaccagtgcctccaggttcaagcaattctcctgcctcagcctactgagtagctgggactacaggcacgtgccaccacgcccggctgatttttatatttttagtagagatggggtttcaccatgttggccaggctggtgtcgaactcctgacctcaagtgatccacccacctcggcctcccaaagtactgagattacaggcatgagccaccgtgcccggctaattaaacttttaatgtggaaagacagcacatgcaggagataagaggtagagtgggtgatggtccaggctctgagcggaatggcctgtgttcaaatgctggcttctctaacttaccagaattacgtatgtccttgagcagagtgtttaaccttcctgtgcctcactttcctcatctgtagtatgggatacatcacagaaattgtgtatcaaagggggaaaatgtttgcaagacttagtgcctaattcacagtaagtgctcaaaaaatgcacacagtaagtgctctgtcattttctagaacacattgatgtttaaaaaaattttcctacttgtaaaacagtcaaagagttcagtgtgaagtatttgcaaaaaatttgaaataaaaaattactcctttcctgtggggcaagttcacagaatagctggtatgctgacaattttctcttggtcccataatagtttttcagagtttcattataaaatagttgctgtatttgccaatgcagactttgaagaaggagactgatccttctggcttttaaagaagaatgagtattacacgaccattgaatatttataacactctcttctctttttaaagctgttgttgttttaccatcctaacatcaaaaccactgggcccagggaaacctcagatgtgggagaatatcaaatgtggaacttttccttgtttttcctggtggatctgacacaccttggaaccttcaaagaacacagtaatcaatgacgtggggagacgtgagacatcgcatacattattgtgaagaatttattaatgtaaactgcatggtgtggaatagaggttggggctgaatgaaaatgtgaggctctgtaatgcgacaaaaaacacagagcagagagaagagagaggccaatgaaagacactttgctgatttgggacttcactaaagagagccacataaaagagaaattattgtttaagtaggttaaggcaaccctagtgttttaattaaaatgtctttagcaaaaaaggaagaagaatagtacttgaggtttggggaaggcttcagtgaaagaagaaatgtaccaggcggtggcgggggtgggcgggggaaatagtgtaatttaggttaaatattgtgaataactccccaagccgaataatgttgaatttcagtcgtaggagatatttaagaattggttgaacaaagggggcaattgactttggtggttagtgtgggagacagctttctaattttagagtttgcagccataacattatgaagctaacgaacaaaaacaagccatgtagataaaaccaggagaaataaggatctgaaaaatggaccaaatcgatcgagttctggcaatgagtgcttccttttcgtaaatacaagggcagtgctctgcatcttctccctctctcattttctctgagaaaggaacgtgccattcttttttctctctctcttttggcattcctttttttaacttttaagttccggggtacacgcacaggatgtgcaggtttgttacataggtaaacgtgtgccatggcggtttgctgcacccgtcaacccatcacctagatatgaagcccagcatgcattagctattttaagaggaggatcgatttcaccctttttggaaaactcaatctggggcctgctttccccaggatcaccgtaagattctacctgaggagctgagttttcctaagaatgaaaaagcaaagagacccctggttttgtatttgatacaaagtcaaacgctgtttttctctgagtctgtcctggaataatccagtgacatccaccatcatctgcatctcccatggaaccaccacatgtgaagtcgaggctgagcgcagggtggctgcaccatccacatcaacagccagcactgccttctgccagtttatgaggcaattcggctgccagggagaggagaacagtgtcccttccaatccgatgagtaaatgcctcaggtgttaggtaaaaccccaaggtttttctcttctctggggccaccctcaggaaaggaaaactccaaaaacttctttgggaaaaagaaaaaagaggttgccatgtgatattagatggcatgaattaaatagatactacttattaaagttaaaaaaaaaataaagcctgcatttgcatggtaatgggacctggcagatgaaaccagaaattgatagaaaccacccccaaatcatcatctaacctgtactgaagaatgacgcacataatgtacaacaggcagccattgtcatgtgtgtgtatgtctgtgtgtatctgtgttatcaggcaggtagtgaagaccaggagggagaaagtagtgagtcagcgaagatggtatcccagttagagaaacgacacaatgaaggcatgaagtcatgagacagtgtggcatgtttgggcaacacagatgtggttgggaccacaaaagttgtgatcaaggaaatgtgttggaacaatgtccgccttcacaagattaaatttgtttccagtgatgattttattccactggtgggttatttgtcaatatgttacaggacttttaaaatgttcataacctttgatccagtaacacctcttttgctaatctattctaaggaattctcattacagaaaaacaagcaaaagcaaatgaaactctacctacaacgtcactttatttgcctttcatttatagtaagaaacaattggaagcacttaacatacaagcaggccaggcaccatggctcatgcctgtaatcccagcactttgggaggccaaggcaagtggatcatgaggtcaggagttcgagacgagcctggccaacgttgtgaaaccctgtctctactaaagatacaaaaaaaattagctgggcatggtggcatgtgcctgtaatcccagctacctgggaggctgaggcaggagaataactagaatccaggaagcagaggttgcggtgggccgagatcacgccattgcactccagcctgggcgacaaggcgagactccacctcaaacaaaacaaaacaaaacaatacaaaacaaaaaaacaagcatatcaagggaatgatttaatacatgttgatacatccacaagatgtattgtgccgcaactaaaattatgtttacagaatctttgacgtgggaggaaagaaaacttgggaagtatcattaggttcaaaaaccaaaatacaaaactgctcacacccttccacttcaacttaaacaaaaagtatattacaacctggaaggaagtccactaaaatgctattctgtttgtctgatacaggatggtaaataaatttacttttcttctgtgttttaatatattttttggagtttctctgatgaacctattctatgtggatgattttttttttaaaaaagtataatctggtgtggcagtatgagcccaacatatagtgcatccctcctaccgaatgctaagctaaaactctgggcagacacacactcaagtgcatgcacaccccacacacagacagacagacacacacacacatttgaaaaatgtgaagagcaaaccaaagcagttgggtaggtggattgaagagagtcaaaacttggagaggtgatttcactgagaagagtttcctacattaggttatttttttcttcttaggctttgccttgggactgggttctagtcatactgcagggggttggccaggcaggtagctaagagtcccgttgaatttccaaccttctggccagagaaaccaggaaaagggacccctatggggaaattttgaaaaagagttcgttggggttggtggtggttgtggtggtggtggtggtggtgattctctcctcagctagtataaatagtttggtacataataggtgctcaataaatacttgttgactaaatgaattaaatttttgagaaaaaaatccaccttggagattgacacactatcttccaggtagaccaatgcagccttctttccagtacaggacaagttctgtttctccactggacaccagaggaagtagtttgcatttaggagggtttcatctgaaaaatagggaaactcctatgtttacacactagagtcctcttcagtgcaatgagcattcacagtatgagaggctgaggaactgaaaacaggtgaagagacagctgaattctctttctctctgtgtattgattctggagcatttgcgtagtgagtggaattttaggtgggttttttttttttttttacaatcacataattcattcctctgactctttgtccctcctcttttcttttcttttttcttttcttttccttttgcttttcttttcttgagacggcatctcgctctgttgcccaggctggagtgcattggtgtgatctcggctcactgcaacatccgcctgctggattcaagcaattccctgcctcagcctcccgattagcaggaattacaggtgcctgccaccacagccacccagctaatttttgtatttttagtagagacggggtttcaccatcttggacaggctggtcttgactccctgacctcgtgatccacccaccttggcctcccaaagtgctgggattacagacatgagccaccgcgcccagcccctctttttctttttatctctttctcttccttcattccccgggtatgtagttaaggccatggttgtgaagtatccgcatgatgcatctccactatacaccgtgcttgtggcaatggaggaggcaaaggaccacagaggaaggacccttaggtggaaaagccaactctgtccatgccccacctgtaaatgtttgtgttgcagaactttccccttagttcagctaaaactgagttcttgtcaaacaaccaggaaagactgggctcacagccacataaaagggtgagaaacagaagttattggacaaaaaggaataataactctcagcaaagcgagaaagggtcctgcttgcaggtctcccgcctcatagattgaatcccaggttaccacagaaacaagagaggccaggctcctccccactgcaaagggcacaaacttccttaggctccaccccatcctcccagtgcacaggtgggcattatatagaaagagttggtcgggaaagggtgggcttcatccaggaccagcagtccagtttttcagccttcaggctattttaggctcgaaggcagggttttgctggggacccttggctgtctcttgtctgtatcacttaggctttgcagttagaacacatcaggccagtctctgcatttatttgccttatcacaagcctagagaatgtgtacccatccctaggagagtcctcagtaaatgactgatgggagctgggatataaatcccccagctcccttgcccttccgagtcacaggttctgccctgcctcctggaattctccagtgggaatgtacttgttaatgcttccctcatcagctcccttcccctccctgcctcacttcctcattctcctgcccacatttcctgggatgacccaccaataaagtacttgctgttaaatcctcaatcttagggtctgctcctggggagcacagactaagagtattgaggtcctggttgtcctgattctactatccagtgggctcatgtacaaaaaggaaaccagaagtcacgaggatccctcaggtggcctacagtaaagcagggaaaagatgaggatcatagcagggaatgtggtcataaagagggaagggatggattcctgggaaattttcccaggtggaatctgtaggacttggcaaccgctcgtgagtgcagtatggtgggaaccaaagaagcctttcatacgatgtgagtgtctaacccctcaactgctgagaaaagggatgcaggaaaccccatggctttggaaggagtaagtgggaagggccggattttcagttaagtttaggatatgttgagttttaggtgcctgtggatagtcatgtatcatttatggtgacagtgccacagggaaggtatgtgtcaaacccctaataaatacccactgaattgaaaataattctttttccaagtgcgggttttctaacaggggccagccagacatttatgagctcaggcagatgaggaaagcatgatacctggatcacgtgtgctcacatctggaatacatgcgcaaattaacacagctgtggaggcaggagtacatatgtgtattagaaaaacaagccccacctgtagagcgctgcaagatgcctccagctggtcacaagtagctattgaacatgaatattttatcagtgccagagcagatagagggaaactgtatccattatattctcatcaccatcacatgtggttgaacgggcttccgactaaagaatctaaacatgtttaaaacatttttcacctccagtaaaactagcaagtcttgatttgtgttgttattgctcctgctagattcgtgaaatatttcagaggcaattgcatcttggaagtgtggtttggcaaattttcatccaaagcgtatgtttttgttttattttttaactagcggttcaaacgtggggaagttgacattttagagcaaatggtagaatatgtggggttattttctgttgctgtttcatttttaggttcaacttttcaaatatagagctggattaagtctcactagtagcagaaaacaaagtctgtttaagtaaatgtgttttcaggatggcccaactgtacagaaacttgcagatctcacgttctgatcactccatcaactgctgcttctttaaaatactcaagagtcacttacgatgtttaattggcatgtctgtctttcaaaatgaaaagctacagggtagcttgtgttaaccacacaacagctggttttggtcacttggtaggtgacaatccagtgaccacaaccaaggaggatttaacaagggattttatgccttgcaatgcggaagagcactggggaaagttcccgaaggggtgcctcccagaacacaaatgaaaacagggcttttactgggctggcgagctgagtcactgtatgtagaggtgtagtgaaggcagcacatgctcagtcaccgatcatgctgctacatacttgtacatacttactgtctatacattactcactcatgtataggcagtggtgaataagctcctccctgggcctggttagtagtatggtaatacagatagataaccgaagtacatttccaactcagacatctctggatccaaccagcttttgttttgccagggtcgggcttctttctgaaatttttgaaacaaaaaaaaccaaggtgtgacagttacaaggggctacttcttcacagtgcataccccaaaaccttgggaccctggagcatacccccaaaaccctgggaccttgggttagacttggacttttcctgttttcttgttactcagcaaccaccacaatgcctggtccgtggaaaatggtcaataaatatctgttggctggataaattaatccctaaatgtatgtattaggttgttgcaaaaaaaaaaaaaaaaaaaattagccgggcgtggtgtcgggtgcctgtagtcccagctactcgggaggctgaggcaggagaatggcgtgaacccgggaggcggagcttgcagtgagccgagatgacgccactgcactccagcctgggcgacagagcgggactccgtctcaaaaaaaaaagaaaaaaatagaaatggcaaggaataaaatttgccttcaatgtgcttatggtcttgggaggagtagagtaaaaaaaatccctaatttctattgatataatatcattggatagtgccatgatagaagaatgtcccatgtgcagtgagaatctagagagaaaataagtgattacacttaaagtagagagtcagggaagacttcctgggagaggtgacatttagactaaagcataaataatattgatttgtttgccaaatggaggaagcaaagaaggatcctgagtgaaagcatgatgtgtctgaggatttgcaagtcgatcatgaggttgcagcatacatcacatgggagagagttgctgactcttcaggagagcagatcatggtatgctaggacaatcagagtctccactagagcatatgaagggcttaacataagggagtgtcataattacatttatgtttggtcagagcactcaggcattggattggagaatggagttgagatgagaagcagtgaagcacttgctgtagccatcataaaaacctggatcatatcaatagatcgtcataacttggcttcaacaagaattcataaaaccaactcctctctatttcatagtttcatcattttatggaatatcaaaaacctaaagagaaagagaaataaaaataaactatatgaacttctccctgatgaagcattcagtcttgttttcctggatctcatgcatgttaaatacatatttagatctaagccactatatcaaggaagtgaaaaactcttattccttaaatatcaatatgtgcacaaattttcttatacccacataattttagtaaaactttggagaaaaaagtttccagagttctagggctttgttccatttttggaaacagtaattttagaactctctgctttgctttacttattcattttatctcccgctgggtttccttcttgatttctatacctttgtgtctgcattaattaatttttctttcatttattcacacatgcaaccattgtgtatttggtctatgtatcagttagggcaggctaattactctagcaaaccagcagttaacaagaaaccaatcccgttggcagggaactgcactgtgtgaagacattcagagatccaggctccatctatcctaaagcaagcaaacaggctttgagagggagacagagacagagacacagaaagacagagagaaaaagagagaggaagttcttggtgattagaaatttgtgtttctgtgcggtatgtgtatacacaggtggtatttttctatttggagggcttaatgtgtttttaggtgtttgtgggttaggagttagaagaaatagccaaaaaggaggtgtaattaaccctttatctctttctcttgatgggtaatgtggttacttcctttttgttagtttccccataatattatagtaaatacctgagtgtattatgtgtgtgtattttgattatttctctgcactgtgttcctagtagttaaattacttagtcaaaaagcatgaacactttaaaggctatcaaacatagttacattgtttttcagtaaaatatctgtacctttttctttagcatcgaggtatctatttaccagaccttcgtgagcaccgtgcagtttattttttaaaaatatttctcaactttatagtcagtatatttggctattaggataatttcaggatatttgaggaggaactttaagaccggcttataaattacagcacttataaaggaggaaaacatgtggaactcatgtctggtacacatgattctaggaactggtggtgtttggatggcagaagttacaaggaacgcaaaagcagggagcgtgagccaacaccagattgacctcaggcagctgatgctatcgaaggaaaaagggaggacttccatgcaactccagaaaacaaaaccaagacacctgcggtagattctggtttaacaaaagggagaattttctaaaaattttctatagatttggttacttcacaaagcattgagcaccccaggataaaagaatccaactgagagtggcagctttactcttattagagagaagatttctctattaaagacaaaatcaaagcgaaatcaccaacatcttactcatttacttattagacacaatcgtggagcaaatactctgcaccagctactgtgctaactccgttacctggattactcaaattcttacaataactctatatttatttcataattgctttatttagtaatattttaagtgctttttagacacctgctctatgcctgtcttgtgctaggcaccagggggcgtagcagcagaccaggaaaatgtagagtctgcccttacggagctgggagccttgcatgaaagactggcactgacgacacagtggcactgaatgaacgtgtgatcagaagctgagacagggctctaggggaaaaaggcaaagtgcagccaatcctcatagcaaaagagaccgaggaagcctagaagtggtgcttgagtggagagtagaaggatgggtggggggttaaccaggcacaagaggggagggacgggaagggaagtcacaaggtgagaagccctcagacaagcacctgcaattggagggtgcgtgcagctgagaagcagagccaggaggacagtgatagcacttgaggtcagagtggtcatcgggatccaagcctgctggatcttcctggccttaggaaacccagaggcttcatcctttggcaaggggaagcctatataccctgtaggcttaatgacggggagaagaatgtttgtaaaagatctcgctggctgctgaagagagaacatctggagttaactctccaatttcagactcccctgatgaaaactgttacttctgttctccactcccttatttgggcaaagcagtttattttctacccgaagcatatctactaatagaaatgactgagatattcattacgttaggaatgtaatgtaatgattcttagatggtgattcagatgattagttattggaccttcgatgcattttttattttaattttgagattggccgtccccaacgcctctgatgtgtgactttcattactggagatgttgtttctgatgttgctggcggtccctactgaaaaggatgcatgcatgaagactcaaggcaacagtgacttgcacccatttctaacaatgacttgcacccatttctcccgtatgggggtgcttgataagcactgagtggtgtaatttacaacagcttattggcttgatgccatcctatgaatccaccaaccatcatcttctctgaccctttaaaatgacttccctcacaccccctgccatgagatgatatgaagaactaacaacagataatttctatatcaccacattttattatcagcataattctatacagtaaatctgcagtgggtgacttagttttgctgatatgtggcctctagaatattgggaaaatagatacatggaaatttagggagcttgtatcttgcctctccaaccttttaaatttgctgcagaaagttggatatttgttgggtttttcttccttaagtaggcaaacttcagccccaggaggcaatgaagcaaactttaaatgtagccccaggtacttcaaagctggctgaaccatgtgtttgattgcatacaaaatgtgaattgagtagcacagaactgtcctcctagcaactttgtagcacaatgagatcagctgcaagaacggaataaattggagattggcttctgcagttccattcatttgcaaaaatttgcagacaattaagctgtccccctgcagtataggtagctccttttagccaggggctggagatttgttctctctgggaaaatgttaaagctgtgattatctagttatacctgaataaatggatcaaaggacctctccagccaagcacagacctccttgaaaaggtagtctccagcagcaaccctggggaggtttatagcaaagtgtttttagagcagatggttctggagttacagaggccaaagagctgaatgacttgggatgagtcttttacatcttttaacttcaggaaaacagccatggtggttctgccagcaagtcgttgaatggattaagtgagataatcatacaatgtgtttagcactgtgcctggcatgtaataaatactcaataaatggcagtattttctatggcagacttggtgaatccaggactaggatcccaggcaaatcttagggttataaaggttagaaggaaccaggttatgtcatcttgagtctagaatataagcttcaaactctccaaaggaataaccctcaggtccttgaactcaaacccgaagcatcacatctttgcgtgaagcctgcaaaggctcgctattgccttggaagcaaatccagtcttcttaccttgacttacaagactgtccataattgggctgggctgactgcatgagtctcacctttcactgttctcccttaattccctgcctgcctggaagacgtatttcagcttctgcaatgctttgccttgctaaaaatatctcctcttagcaaacaagtttgcccagaagttatgaaagtaggagagggaacaaagatgatagaggtttgtggtttgtttatgaggttttcactatttctccctatcactttttctattatgcaaagccagggtccaggagggcagaaagagggaatgaggacaaattatctggacactgtttgtctgtttgaatgtcagcgtatttaggagatcctccaacaggtggccagcccgggtcaagctgcgtctggccttgtgttcaggtgtgcaggaagtaggatcattcctctcaaatctcaccacttccttcagttggctgttagggaaggcttttatgcccttggctgggtgtgacggaaaggggcagggacagacaaaacttggagtgcggtcccagctgtagaatgccagtctggcagacataacaaaagtgagcacttcttcgcttttgggacaccttccccatttggtcttgacattgagcaccatgctttggcaggtgtcagaggttggctcccgggaaatagaccacgcaaccggggaggtgttatcagcatccatacctcacggggagggaggtcagggggatggggcggggaaggaggctgatggaggagttgctgactgcaggtagctggaggcctcagccttcctgggcagcagggatacgggcagggatgtcccctgagcatggtcccacctggaagccagggggctgaccttgacacactcctgaccagtcagtggatggcgctgcagccccttctgtttagtcttcacatcagcaatgaaagagggtgaagttcatggaaatattgtggggacatatcgcatggtttctgttcatgaaatgtccagaaaagacaaacatatacagccagtggctgtggtaaagtgggaatgactgctaatgggcatgaggtttcatttaagggtgatggagatgttctaaaattatatgtggtgaggattgcacaactctgtaaatttcctaacaatcactgtgttacacacttaaaacgggtgaatttcatggtacgtaaattatacctcaataatacttttaaaatactgcaggcgagaggggctccagccagagaaattgactccaactctccctttccacaaatcaaatgctcagatttgcattgtgggaggagcctgagtgttcactgcaggacaatgtaggttcttcagggagtgcagaccactttcacatgcagcttctcatttcgttctgataacctagaggacgggcaaatcatcgtaggacgatgagcgctgagctacagtgaatgtagcttgttatcttacgacagacctgggagaaggaggaaatccaactaatttatttacttttatccctttgagtctattctccacaaagcagctatgatctgttttattgcaactggactcctcagctcaaaacccttccagggctcactcctcatgcggagtaaaagccagggccctctccatggcctacgtgcctctccagggtctgacttcccttcaccaggtccagactgtctccttcacctcacagcgctcaccttgcccacgccagcagctgccacactgaagctccgccatgcccggtaggcttctgctgctggcagtgcctcctcctcctgcccccttggcccattcttcctccatcttccactgccatctcctcggtggaccgcttcttgcctccctgtctaaaacatcagcaccctctccccctgagcacttccagccctcctccctgctgatcttttttctcttgagccatatgtgttctctttccctttctgtggtttgccccctctctctacaattgaagcttcatgagggcacttgcttcttttaggcactgcaccatccgagatgcctagaattatacctggcagagagaaagggcttggttgatacgttttgaagaaatgaatgaaagaatgaatgaatgacttagttaatatgaatctattctctcgctccttctcacgttctttttctcttcctgccttcctgtttccctgggcctccaccctcccttcccaccctcaacccctcccctgcccctcactgtttcaggggtctcccctttatttctgatatgtgttctttggggcgagtgttgtggtgcttccagacagcgtgatacttgcttcccctgagattgggaaacagggaggaaagcaaatgaggttttaacctcaaatgccctaagacaggaagatgaagaccttgcttagctgcatgaaaccggagatctttgtgtagggatgacagtcctcctctaatagaatccagcatgcgtgaggctccctgaagacacaacactgcccctgtgatggaagcaaggctggatgaggctgcagcaggcctcggatgacctaggctaaagatgctgcggatcactgtccggagactgctgtggggggaatcccacaagtcacacatggtctggtgttggtggcggccccagaacctcactctcctctgcacacctctgcgtgcctacgtctgttcctgtgactgaggggattgtgttcagcacactggaagtgcgaagacgtgtggcatatgtccgtgggtctaggcagctgatgcatgtctgttgcatgtacatctgctcgtgagtgtgtgtgtatgtgtgtctatcagatggattctggtgtgtgtgtaaacccgcatgtgcataagtgtgtgcatttgatgtcacagagaacatttgacatctgcacgcgtctagtaaatctggaaagctggaaggggctgcgtgtctacatgtgtctgtgtttcagatctggccttaggccatccacagccgaattactcactcctgatacagactgagtggctcaccctcattttctcacttcctccgtcctggtgttaataagactcatccttcatttttctaccgtttctgcagttctttagagagtgcagaccactttcacatgcagcttctcatttcattctcataacctagaggacgggcacattatcctcctttacagatgagaaaatttccttcaacccctctgtgtcctgtctcgaggggagcagtattgggcctcttctctgaggctgatgtaactgctgattcctctcacacctcctgtgggcatctcctctgctctcttgcatcttcattcattctgtgtttctttcttcaccactgtgctttctttcctctgaccccttcttcctcaaggtcagccccattccttgtctcccatttaactgaagaacttctttccatagctctccttttcttctatgccagagtcctcactgtccatgtaatcgcctagcacacaccaaaagctgctctttctaaattcagccgtcatctgttcatggtcaagcctagcagcctccgtgattttggaggagacctctgccttgtgtaacgtggctgtgcactgttcctttttggaattctcctctctgtgcttctggtttttctgctacgctgactaaactttctgtggcctttgctgaaactcatcagatggttacgttcctcccttttcccttttccctcttcccataatctgggttgtgccattgtctccatgtcttgcagctactcttgtatatgagtgattgtgacatttgtctccctcctgaatgcaattcctcatgtcccctagaaatctctgcttcacgtccagcaggctcctcaacgtcaacaggtctactctagcactggtaccccaaaatgcctttttaaaagcctttgcccacttggtaatggcaacaccagaagtcaagagatcttattacctccctcctttacgctgatcttcagttctttcccatacactgctcttctgccttttgtaactgtctcttgaattgattacattatttttgtcaccaccatttttgtgttgtccttctctgagtttctggccacggattggcaccctcacaggcttcatgcatgaaatgacagatgcaagtacaccacacgcacaaacacagagagttgtcccgaagcagggtatatggatgtcagtcaaatcatgtatgatggttcttacacggtcccagtcatacagaaacatatggcagaacacacaaactcattagcacagactcgatcaaaggtgggtacagccacaaatatagaagtagacacttggccacaaacacatacttatagatatacacataaatcacaggcaaagatagaagcagagccacaggcccagaaacgcagagccatggataaatattcactgaagtttctcctaatgtcagacaaaaacttaagcatcagaagaagcaggatgtcctgacttcagtcgttccttaagatgcccaccgtgacgggcccagagagtcgacatgcacatggtgacttctctacaatcaatacctccagcagcccccgaaccctgtcccttccaggtactgtttttcccgaatcagagcttcctgcttcttttcttgggcactttagatccacggattaacacaattgtgccacttgccatacttctgggatgcgccgtaataatcaaggaaatggatgggcagctgtggagttgatgagctggtgagctgggaggacaccagaggtaggatggggatgggattcagggagctgaccactctggacacccgtgaggacagaaatatcacccatttgtgggtatgaaaacacaagaaagcaattcatgacactctatgcaaggttcattattgatgacacggtgtgctttgtcattactttggacacatttagacatacattgtcatcatgaactgaggcctatgtttgctctaggatgaagcccattcaccagtcctttacatctgcacaaagtttacgtctttttaaagtgtttctctagaccagctctcatctgaggctcaagatatttttttaataatgaatgatattcagatattacaaatatattttacgtatttcctatttttgccacccttaacaaaccaacagaatcttcatagatgttaaatatcagttttgtgtaaatacaacgcgctctaattttctttcttttttttttttttttctgagatggagtctcaccgtgtcacccaggctggagtacagtggcgcgatctcagctcactgcaacttccatctcccaggttcaagtgattctcctgcctcatcctcccgagtagctgggattacaggcaggtgccaccacacctagctaatttttgtatttttggtagagacggggtttcaccttgttggtcagcctggtctcgaactcctgacctcgtgatcctcccgcctcggcctcccaaagtgctgggattacaggcgtgatccgctgcgcccagccaatgctgtttctttgtttagtgttgggttcgttttgggtggttggcttttttgttcgttttgttatattattcttgctttttcttctgtcttatacagaatctagttttctttgcctgcatattgagtccttttcacttcctagagactaaagtgtctcttacttagtctctttcattgagattttaatattcttctgtgatcactatagtgtatacaaaatagaatgcattgaatatgatattctatattttcctacatagcttgtcttaaatattctctctgctagctaggtaaattggagcagtttgcatgcaacctctctgaactttcttcattgattaaggagggataagatttactttggaggtctgttggaaatatttgagggggctcatgccaagtgcccagcacattggccagcatacgcttgctgtatcattattatagtagtttagagtagtgatggtgagggcattggagtgatgatgatagtggtcggaacatggtcttcacagttgccttattggtcatagcctaggagtattgcctactaacaaacccaaatgtaactttgtccctgctatggaacatttaggatgttttccatttttgccccttataaatcatgtctcactaaacgtcttccttcatacagttttattcttcttttgaatgtaacgtttggatgggttcctagcagtaaaattactgagtgaagggatatgtgcattcataaagctctcgataaatgaatattgcctgattacttttcacaagggtgctatgaatttatactcccacccaaatcaagagaatggctatttatagatgctttcagagccttagcttatcttgtttcctgtttgaactttattacataaattttcctttaaaactgtcacacacacacacacacacacacacacacacacttttatggggccttggggccaaagatggaatgaaactatcatttatcacatgattttgataggaagctgttgttaggattgagatgcttgcttctgatgatgcagaagacagttttaattagtatgtggcattaaataagatcagtttgcatattggaaatgatattctttttcaattatctttcagtcctctgatcagatcaaagaggaagtctcagcttggtgctaacacgcctttaacaccgctctggcccctttttacctgtaagatgaagagctttccataggcaacagtttctagctcaaatttaatggtgtcattaggtctccagcatgtttatttttatgttttccttcttttatgtgaagtgatactaatgttttatttaaaatgatacaaagttttcattttgaacacatttaattaaaaatatgagttacgcatagagcaaacaccctgacagtgtcactccaataactgaacttgtgacatgctacttggagagtgcattccaacagttgccccactgatcatataataacaacacgtttcccttgacaatacactgaatacaagtctccataatgcctgacatagtttgggactttgtgattgtccctttatccctattcatttgtgagtgtaaggaccttgcagtggctcatgaagagagttgctttttattttttatttttaaaattttttttgaagactcttaacaaagtataaccattttgaaaatgcctatctattaccctagataaaaattacctagtatcggaagagtatctaaaaagatattcaaggggtacaagtgcaggcttcttacatgcacacactgtgtagtgggaagtgtggccttttagtgaacccatcacccaaagagtgaacgttgtacccaacaggtgatttttcagctctcaccctcctcccaccctcccactttccgaagtccccactgtctcttattccactctgtatgttcacaagtacccattgttgagctcccaccaaaaagtgaaaatatgcggcatttttctgtttgagttatttcctttggatcatgtcttccggcttcatccatgtggctgcaaaagacatgattttattctttttttaggcttgagtagtattttatggcatgtgcgtgtgtgtgtatgagtatgtgtgtgtgtatatatgtttttgtgtgtgtacacatctttatagatatgtttatatatacgtatagatatatttacatatatgtatagatacaaatatatatatatatatcccacattttctttttttcttttttgagactgattttcactcttgttgcccaggctggagtgcaatggcgcgatctcggctcactgcaacctctgactcttgggttcaagtgattctcctgcctcagcctcatgaatagctgggattacaggcatgcaccaccatgcccggctaattttgtatttttagtagagacgaggtttctccatgttggtcaggctggtctcaaactcccaacctcaggttatccaccctcctcagcctcccaaagggctgggattacaggcgtgagccactgcatctggccccacatttttttttatcctgtcttctgttgatggacacttaggttcattccatgtctttgctattgtgaatagtgctatgataaacacacaagtgcaggtattgttttgatataacgattccttttcctttgtgtatatacctggtagtgggattgctaggttgaatggtagttctgttttcagttctttgagaaatcatcatactgtttttcatagagtttgcactaatttacactcccaccaacagtatataagcattcttttttctcttcagcctcaccaatatttgttgtttaagactttttaatcatagccattctgactggtataagatgatatcgcattgtcgtttcaatttgcatttctctgatgattagtgatattgagcatttttcatatgtctgttggcccgtcgtacgtgtccttttgaagaatgtctgttcatgttgtttgccccactttcttttgtttgtttgtttgttctgagctggagtctcgttctgtcacccaggatggagttcagtggtgtaatcttggctcactgcactgtccgcctcctgggttcaagcaattctcctgcctcagcctccctagtagctgggattacaggtacctgccaccatgcctggctaatttttgtgtttttagttgagacctggtttcaccatgttggccaggctggtctcgaactcctgacctcaggagatcggcctgccctggcctcccaaagtgctgggattataggtgtgagccaccgcacccggcctacccacttttaattgggtcatttttgttgtttgagttccttgtaaattctggataatagtcctttgttgaatacatactttacaaatatttttcccattctctaggttatctgcttagtctgttgattgcttattttgctgtgcagaagcttttaagtttaattaaatttgaattgtccatttttttttttttttggtcatgtttgcttttgaggactaggccataaatcctttgccgaggccaatatctggaagagtttttcctagggtttcttctagaatttttatagttgcaggtcttatgtttaggtctttaatccatcttgagttaatttttgtatatggtgaaagctgtgggtccaatttcactcttaggtatatgattatccaattttccatatgggtgtttaggccaacaccatttattgaatagagcgtcatttccctatcatatatttttgccgactttcttgaagatcagttggttgtaggtatgtggctttagttctggattctctgttctgttccattaatctagatttataccagtaccatcctgttttggttactatagctttgtagtataatttgaagtcaggcaatatgatgcatctaacttagttcttttcacttaggatttgttataaaaccaattctttattggctgtaaatcaaataaaattttatatctaagcaagtcctccagattcctgaccaggtgagtaatccagtagcttggcagattaagaacagcaatatgcaagcaatgagggatgagtaaatcaagactgtcattgtgaatagaatgatttggaagttgggtgttcaaatagcttaatgatagttatagtgaataacaatgtcagctttagtattattctagtaatgtacttggtaatgctaatagggtttgatggaatacagtgaacactttccaaacagctgtatgctttcccaacaaaggaactctatctcggagcagactgatacatcatttcaatgggagattttaatcaatccttttgttttcccttttaggatatatttaaatttgcaagaacttctcctgtcccaagacaaaagaggtccattgtggtatctcccattttaattccagagaatcagagacagcctttcccaagagatgttggcaaggtaagtcagacaaacagcaaatgacaaaaacatgtttttatgaaaagatgagcacagcagactgagtatgactgtcttggtgaccagctggaattagtcttcatctgtctatgataagagaccaaatggtttagtcatgaaaagaatgttggaagatcattcatatgcaaaagaggaaattggaaaaaaccaatagcagctttgaatattacgggatcaacatggtagatgatgttgaaattaagcaggaagatgtcaatggttaagaaacaaggctcattgcttttatagattatattcaggtgatcaccagatagggccccctaggatggtagtatgttgacatgtggccttcactgagatcctgtttttcaaatatttaggtctacgcgtaccactgggtcggttttccaaaaactaaaccagatcaagggaataaaatcatactaatcatatccagaatcggatatggaaaacactgtcccatgaatcagaacaatagcttttccaggaagaaatagtcactgttaaatgtgccaaaatacggatactgcctcatcagtacattctcccctctttaagagagtcaacatggagaatcaaattttgagcagtttgtactttttggttgttagaaacaagtgctcagtgccgcaaaggagaaccagcactcaggaaaagagttttctcagcaaggcaatttacttctgcggaagggtgctgcttgtacttctggccactgggagagcacaccaaacaaaagagggaaggggtttttatccctcacgtggttagtccctgcttctgtgtcctgtccccattggctggagttggattgcacaatctaagctgacctgattggctactgtttaaaattgaatatggctaattaggcaggaagggagaggctgtctgttatggtacaaggcatgtttgggcatgtcagggcacggcaaaggcgggaagggtagtttcattgggaagagctgttttggctggaggggcagtttacagaatgggtagccaggattaaagaggactctttccaaataagaaagagatgtgagtcacagattgggactaatgggagaagttgtttatagagcaggtagcttaggagaagggacaaggaagttgatctcgagaacaaagaacaagggagtcagaaattaaacgtttgaaaaggaacttactgtatcagacattggtgagcctggaattcgaaaaatggtggttggttaaatgaatgatcttaatggcagttgctgttgaactactaattcattaaatacacagtacatgtgatatgctggactccaagctttggactgggtgtgaagaagcagataataaagctaacatgctagtgggaagacagaaacaagaacattgcagagtatgacaaatgctgtgaaaatcagcaatgggatgatgtgaaaaaaagagcaaatggcaggatgaaggagtagagggaggagggaatcttcacgcagatggctgtgatggctggttggaggtactgatatttgaggggagactggaagggtgagaaaggaacagttacaggtatatctggttgaacagcatctttggcagaggtgagtctacattgcaaaggcctgaagatgggaaagaatagcatgtagtagagtcgcaacatgcctgggttgcatgagagtaagcaaggatgacagtggtaaaagtgaaatcagagaggccagcctgcccttggatgaggagttggggtttcatcgtgcatgcagcaggggaccactggaagatttccccagaagactgcatgttttgaaagatcatcctggctgccttgtagagaatgattagtggtagcagagcagtagagaggagtggaagcaaagagacccactaagaggggagtttggtggtgatctgaacaaaggtgacttggactattgaaaattgatcttggacgggcatggtggttcacgcctgtaatcccagcactgtgggacgctgaggcgggaggatcacccgaggtcaggagttcaagaccatcctggccaacgtggcgaaaccccgtctcaactaaaaatacaaaaattagccagtgtcatggcacgcctgtaatcccagctacttgggaagctgaggcaagagaaccacttgaacccaggaggtggaggttgcagtgagccgggatcatgccagtgtactccagcatgggcgacagggtgagactctgtgtcaaacaaacacacaaacaaaaaatcgatctttattgcaaattgaaagaagtgctaatccaatatcctggtaatcattatatttatcattttaaactcccactgtgccaaagatacctttctctaagcaaaaatctttttaagagtctgggacatgatacaaagggaagcagagctgctctaaagggatagccctgtccccttgggcagccctagccactgtgatgatccttttctagacaggtttcctgggagcccaagatgccagatgccaagggacctgactccccacttcttcaaaactcttcccaaacagtttctgagactcaagatgcattctcgtttttcagttttcttttagataatcctgggcttctcagctctcaccatgcatcagaatcagcagagacacttaaaatgcagatgtcagggctccaccctcagagattgattccactggggtgggggtgaggaccatgcatcaatatatgttaaaatatccgaggtgattcagatatgcagccgaggtggaggactgccggtcttaagcagtcctccaagagtggttgtggaccagctacattagcatcgcctgggagcttgctagaaatgcatattttcatgtcccaccccaaaaccactgagccaaaaactctggggttaaagccaggaatctgcgtttttacacagcttctaggtgattgtgatgcacactcaaatttacagagggctgacctgaaatgcactttctcctcctgtccaccactagtacacaatactttcagttgcaattccattaattaggttataataaggacaatcacatttcagttgcctggaaaatcccagtttacacctgtcgtccaaatctgtcatgtccagatttagacaataaattatgtagccatcctatagttttcttcaattacacacaatttcctccggggtatatttgggtgaattttctcacaagcctcttttcttgagctattcaatgggtccataagcatgcagctaattgggaacattcttctgcattgtttttttacttattacagcttcaaaaagcaatttggtttgcaagctgaggactcacttcttcttagccccttatgtgttgcccatacttgttctcaacttagattctctacaaagcaactgcttttctaagtgtggtaggctactaactagacaatgcgcaagagccttcaaaacctctagatgttttttgtagaattactgcactgctttgcaaaaactatttatttgtccctgctttttatgcctttgaaggtacgtattttcctttttgttcctgcttgtttctatttatctgtcttactctttatatctcctgtcttatcctcatcaactccaccacagctgacgagctgtgctctgcagagctgtggaagaggacgtaggtgttttcagtgagtgctggggaggcagggagaagggaaggaagaccacagaggcagagctctggcctccaaacaccaccacgctcccaaaaaatgtctaagtcaggacacctctaattttataaatattacgtattagacttcgatatagaatgccatttgaagaagagattctgcagctctaaaagtataaagacgtttgtctttggcttcccctagaagtggaccgcaagacaagaattcaaatgaaggcagttcatttcagaggtggaggaaatatttgtaataaagtaagggagagacgtggagaagggaaggcagctaggagagaagcttgtttatgaagccagctacccctgtgggtgactggattgtaatgtcaggggctaactttaacatggtgtggaacacactgtcagcgttacaccacccccaggggatggcactgggatactttgacaccagctggggtatttctactcccagcagtcactggtggagggccgcttccaggggtgtaaattccctggcatatctggtctgccctgcactctgtgcactgacgcgacagcctgctgaggtttggaggagaaccttagacaaaaaggattctgtacagcagccaccagtctgctggtctgcactgaaaagctgacacatagaggatgtggacagggcactgatcccttctgcttcatcaccaaaactaatatatctatattattttttgcatacttcatttcatcctctgcttttacctcatttcctgaactagcattctcatgtcctgggcttttgaaaccccctgtacttgcctctctctctccattaataagtagttcctgcatcccaggagggaaaacctctgaaattcaacctaattcatatcaacaagcatatattcagcatctgtttttataaggaactgtgctaggggctgggaatttaatggaggagaaaacagacagaatcattgatcttgcgggattacaaaagaggtgacaatatcagcacatagtcattatttgtccagcactgtgctaagcacttttcatctattatgttgaattcttatgataacaaccacatgaggatcattttccagcatgccaatgaaggtaatgagactcaggggtgacgtaacctgtccaaagccacacagctagttcataacagagccaagctttgttactgctttttgagatttcaaagtctgtgctcttaaccagtatcctcaggaaatactaagcccaatctgagaatactcttccgtggaatgaaatatcttcactgacaatttctctttttaaaacagcattaaaattgagtgcaattcttggcaatgcactcaaaaataaggtggacagagggttggatcaatagatcgatatctgatatgtgataaaggaagtatattaaaatgttagtggtagaatataagttggtgaacatatgggtacttgctgtacaattctttcgagttttctctgcatttggaagttttgtaataaaatgttgggaaaaattaagtttaactaaatataaaattatcataaaagacacaggagttagcatgctggcacaaaaacgccttttaaatcatttgtcttgcatttcaagagggtgaatggagacaaagtacgtaactggttcttgatttttttggtcatattttattacaacctgaattcctgtaaagaaaggagactcatatcctgaagaatgaagacatcaaaagcaaggtgctgtggcaagttagcccttggtggagggtttttcacaactggatatcctgctgtgtagaactgaatacccacagcagggttattcaggcagctccagggatgagagaaagtgtcttgactgatacataatttatctgtctgccaagtaattagttggttggtaagtagctaaactactagaatttgggatctgcttttccgtaatacgagggaatcatattacaaccctgagattccaaatcactgctactcacttagatagcaggtggggagtataagggggtgtatgacccccccccccccccccccgcccacagacacacacaggagacaacccgagagatcactgccagccctgggaaaatgagtttgcctcctaatttctggctcttttccatggtgcattctgccctagactatctgtcatagttttggaagacaaggtaaaacacccagtcgtgaacatacttgctcatacctgtgattttctttccatttttgaactctagacagcagggaggagctgacagtgagtgctctggagaggaacatgcagatcccaaagtggctttttcccctcccccttcaaagtatgactatttcaaaatttgggccataaataatttctcagttttaccaactttcactgataactaattgattgcatctttaaagatttttgagttcttgggcccgattgattgagagcaggggactttaaatctgtaagccagcagggaggtctttgggagatgtattttattctgttttatattaagtttgaaagacaagtcatttatgaaatgcttattagagattctgctttcatcacaaacccttttcatcaaaaccaatgaaagtacttttttacagaaaatcctgttttaaagaccctataaattggtagaatgggcatttagaaggccatctttaacccaggatagaagaaatatgtaactgggccaagtgctgtttgtaaagggaatcaacattgatcattagactaaatcatgaaaaccactcaaccaggactccgctttgattgtgtcatgaacgtaagtcagacatgacggtaatttacatcagctttgccatgttcctcagtgttctgtgcatctgattcttagaggtctcactgcatccagatactctgtacctgagatttatgcccacctatgcgaataggtgccaaggagtctgatagtcttggaatttaatttgttttattctatttaatagccatttgcctcactttgaagacccacgaagaccaagctatatccttagaggctgaaccagaaagctggtactgaagccccagcacctctccatcacccctctcctgaaatgcagactcagggttacttgctgttgcctgattgattttatgatcaggcacttactgggttgtctagggtaacccagtaattgctgtcatccctctacctcttttaaaatctattgttttgtgccctttatctatgtctaactatatacacttttctcagaaatttacatctgcttaatttctaccccccacccaccccccaacacccccccctttttttttttttgagacagagtctttctctgtcaccaggctggagtgcattggtgcaatctctgctcactgcaacgtccgcctcccagcttcaagcaattctcctgctcagcctccctaactgggactacaggtggatgccaccacgcccagctaatttttgtatttttttagtagagacagggtttcaccatgttggccagactcatctggatccatctgcctcggcctcccaaagggtggggattacaagcatgagcacctggccttaatttcccccttttaaggcaactagcagttttattcaataactgaaacttaccataggctagagtataggagaaaaattggaatacagagtatctaagatgcctaaaggctcagtgctcaaaaattcttcttgagatgaacatcacagtttatttctacattcagcagccatagctacacataagcctttcctatttccaagtctttgaactgtcagttcttcctgggatacaccctctgtatccttattccttaggagcagcccacattcacactctaaggctgcactgtcccatggaacattgacattattgcaggaagttctgcctctacacagcccaatatggtacccactaaccacatgtggtcaatgcagttataaagtctttactaattttaattggggctcaaaaagtaacacttcattccattattgggacaacttggcagttgaatgtacctttttcctgatacattttaatctatttacagataaaatattttttactgaaaacgcaatgtccacactgagatgttttgtaagcgtaaaatacacattggatttcaaaagcttatcacacgaacacaaaaagaatggaaaatgtctccttaataatctttgtattgatttcatttggaaacaaatcccttgtatttcttttcactttttttttaacgtggctgccagaaaagtattaaattattaatatggctcacgtatttttatcagatggtgctaatgtaaataaggcctatttttgatacagtctctcctcagtggaattatgtttttgagacagagtcttgctctgtcacccacactggaatgcagtggcgtgatctgtgctcactgcaacctctgcctccggggttcaagagattctcatgcctcagcctccctaatagctgagattacaggtatgcaccaccatgcctggccaacttttgtatttttggtagagatgggggttcaccatattggtcaggctggtctcaaactcctggcctcaagtgatccacctgcctcggctgcccaaagtgctgggattacaggtgtgacccactgagcccggcccatggaattttacttgatctcttttatacattgtttatacatctttgatggcacttaacacattttgagagacaatgtccttccctgccttcccactaactgtaattcatcagatgcggtggcccaggacagggcctaacacagagtagcgactcaaatattctctgaattgaattctagccatatgtatggctgattaacatagacattcactgcttactgattaattaaagtgatcatagcctgctttgttgttagaatggaattaatagaccattatatgatcagtctggatatttccagcaaattttaattttctaaattggtaatgaggccaccagataaattgcttggcagtcaactattatgtcaggtcatataagcattcttagtagatttgttttttttctttgagacagagtctcgctctgtcgcccgggctggagtgcagtggcacaatcttggctcactgcaacctctgcctcccaggttcaagcagttctgcctcagcttcccaagtaactgggattacaggcgcccgccaccatgcccagttaatttttgtatttttaggagagatgagctttcaccatgttagccaggctgctctggaactcctgacctcaggtgatccacctgcctcggcctcccaaagtgctgggattacaggcatgagatgctgtgcccagccagtagatcttgatagatttgatgttgatggattttatgtggggatggggtggggggagagagagagagagagagagagagagagagagagagagagagagagagtgagttacatgactgtatttctgaatttgcctatgtatatgatggtgttttaattccaattaaatgaaaacactcataacttttatcttttttcacaactgaacacagtcaattctaacttatttttgctaagtctaataaaagctatgttcaccattcgcaagtgttgccctcctgcaaattttaattaatgacaaaacataatcgggtggttttggctttttgccaaatacatatatatgcaaaacttccctccatgatctacatcccgcaaataaaggcatctgagcccaaggaggaagcaatatttttaaccctgagtttatcaccctttcggttctccattttaaaggttcctagaactttattgttattatgaacatctggcctcagactgaatttatatttaattatttgtgaacattcaaggaccaggcatttcagcttgaattagcatccagactcagggttgttgaagaattttcaaattggactagaatgttcactacctaatgaatgtctggatctaagccaaacatggctaaccctactgtcctgcttagtttttacaacagccctataaagtaggcaatcctacactcatttctcagatgagaaagtggaaattaagagagattaagtaacttgcccagggtaaccctcttaaagaacggcaatgctgagacccaaaaccaagactcttcaatgccacatcagtgatctgtccaccacaacgtgtgtgaatgcttaaagcttccatgggtctttgctgtttgcatagcacactcacacaaatggtcatttgactctcataagtaccctcagaaatcaatattatgtccccattgtacagtggaggctctgaactgagcatgaccaaggtgcagaagcatcttgcaaaacagtctatttgtggtacaaactgagttgcctttctgtgtcacctgcaattgtaccagggctctggatggattttaaaatagcacatggcatgagttaagccactatggaaaacagtgtggagattcctgaaagaactaaaactagaactaccatttgatccagcaatcccactactgggtatctacccagaggaaaagaagtcattatatgaaaaagatacttgcacacacacgtttatagcagcacaactcacaattgcaaaatcatgtaaccaaatgcccatcaatccacaagtggataaagaaactgtgacatatgtatatatgatggaatactactcagccatccaaaggaatgaattaatggcatttgcagcaacctggatgagattggagactattattctaagtgaagtaactcaggaatggaaaaccaaacatcatatgtccccactgacatgtgggagctaagctatgaggacgcaaaagcataggcatgatacaacggactttggggactgggaggaaaggatgggagaggggagagggataaaagactgtaaacaggatgccgtgtattctgatcgggtgatgggtgcaccaaaatctcacatatcaccactaaagaacttattcatgtaaccaaacaccacctgtaccccaacaacctatagaaattaaaaaaaaaaaaaaagaaatagactttgtctgggcacggtggctcatgcctgtaatcccagcactttgggaggccgaggcaggcggatcatgaggtcaggagatcgagaccatcctggctaacatggtgaaaccctgtctctactaaaaaatacaacaaaaattagccgggcgtagtggtgtgcgcctgtagtcccagctactcgggaggctgaggcaggagaatggcgtgaacccaggaggcagagtttgtagtgagccgagatcgctccactgcactccagcctgggcgacagagcgggactctgtctccaaaaaaaaaaaaaaaaaaaaagaaatagacttcactagaggaaggagaaacatacaagccaggggtgagccaaggatgagaagcatagctcaccatccccctcattccacagggaggtctgccaggggagaaactgggctctcatagctgttccttctctgccggacagcttcagtacaatcttgttagtggacagacgatcaaacaccagggatgttccgcagcctgaatgcagacagcttcagtacaatcttgttagtgggtagatgatcaaacaccagggatgttccgcagcctgaatgcaggttcccagattcgtaggagtggtctgagattccaaagttcaaagtcagatgctttgggtagggatgtgctggaaaactggctctcggaggctggaagccttgagttggagtgtttgcagctactttggcataaattctcccacagcggccagtttcaagctagcagcttacaaaatctctgaatgtttaacaatggacttccatgaaggagtagggttgacttcagcacggcactggccttgggactcagggaccgtgacactggaaggggtcagggggcacatgggtcccaggggagctacgcttgagtgaagccctccattgtggagaagtggcttccacacccacctgttcaccccgggttgcagctggtctcatgcccagtttagcagtgaggatcattttttgacaactctgcctgttgcaggtgttaagtaacttgtccaacttcatgcagcaagtgcaacataaaagcaaagctccaccactcttctccttggcacagaaaaatccaagtcactctcctaaggctggaaaattctgcagcaattgtcccagttctacctggaaaatgaggaagggagtgataaaattctctgtgaagtgaggagaaatgaggttaacctcgccaacatttatttgatgtgcgtgtttgtgcgctgagtcagggccggaggtcgtgtcttcgtttaacaaatagaccacatgttgacaagcaaaaaacggctttctttgtctggcaagaaaagccactgcctcgcttcagacaacgcttttttttgttggtgtctccgctgacaaccctgttcaaagagagccacaaggaatgaaagtgaaagcagaaaaagccaacttcggtgtaattaagagatatcactgcccgtttttctcagtgatgaggccgcagctgactcagtcgataagggccgtgaaggagtggggcccagggcgcagtggggatggactggccttttcacggtccaattactggtccaattactagtccaagttttgaagaggattgaagtagaactggatggagatgggaaagagaccaataaagtgttttttgttttttaggttttttttttaagaggggaggaatgaatgaagaacttcttttattttcttttccggcttggagctagctctggttcccaaatagggtcctgggggaaagacgtgatgtgagtctgggtggctgggaacagtccctcctgggtatctgcgcttggcccacttctgcaaccagtaatggaggagacagaagaacgcttgaatgtgggtttaattgttcccatctgtgagtgttgcattaaagatgttgctgtcttctgttgcatcgggtggtttgggacaagtgatgaagaaagagagtcagttgatgcctcttgagcaggcatacactctccctaggctgaaaattgagctgcattaattcagaaatatttactgagcaactactatgtgtcaagcactgcactggctactgcttatggattcccccgagaagaatgcccgtcctaggagagggggcagacctgtaaacaggcagacaagcgctgtgatggggtgctgtgggatcttggaaaaatcgagaaggcagaagaagtaattccgaagaggactcctgaaggacgcctaagagcaggcaacgcgaagctgagatgggaagaaagcgctctccaggcagtgggaagaacatgatccagtatctacgggcgagagggacggtggtctgtccagagaggtgagaataattcaaagtggctgtgatgcaaggaggaaattgtcacaaataaacttggagaaatcatcaaaggctggaagaggaaaaattgtaaaaactactgtatggaatttggacctttttctacggatgactaagtgttatacattggggaatcacacgatcagatttgcatttcaggaagtttagtcctgttacgctgggtaacacctgaaggctgagaaaaccaggagcaggggtgacaaagagggaggctgtgacagaaatccaggagggtgacgaagggctcccgggcaggggagaggcagaaggactggaaagagggcacagtgaagggccatggtgggggataccaggcaacactggcaagcaagtggacagtgatgagtgaggaggtagaggaaggtcccctcttagctgggacattatgcctctataggacgctgaacaaagtaacctgcggaggtgttactttgtgggaatgtagactgtgaaactgaaggaactgttttatccacctccccgtagtttgctctgtgctgaggctgctgtactgctcctctttgaaataaaagagaactcttcccagaggtgacagatccacctgcgtgctgtatgttgcatggaggtgggcgaacaggttatgtggagggttgttcttggaaagacggattcattttgcaccagtgacaggcttgagggaacaccagcgtgtcacacgtctcttcccagtgtccctgactcatccatgcctagggattttactttagtccttccttgctgtgaatttgaaaacttttattttatttttttctactagctaagaaatgtgtaacagctgtgttcactgttggccttctagcctcaaatttattttaaatacatttcttcttagtgatctcttctttgaatgctgatgttggctatgcattagtttacacaattcacaggctctgtgttgctcaatttttagttcatttatttgacaacttgaaattcatcacaagtggtgcttttattttgttatttgcatctggaaatcattcctaacatgccatgaaatacatctgttttttccttttgcaaatcacttttttttcttattataagagtaatatgtgtttattgtagaaattttagagaaaaatacacattgaaaaataataatataaaaatatccggccaggcgcagtggttcatgcctgtaatcccagcactttgggaggccgaccgggtggatcacctgaggtcgggagtttgagaccaccctgaccaacatggagaaaccccatctctactaaaaatacaaaattagttaggcatggtggtgcatgcctgtaagcccagctactctggaggctgaggcaggagaattgcttgaacccaggaggcagaagttgtggtgagccaagatcataccattacactccagcctgggcaacaagagcaaaactccatctataaataaataaatatccctgagtcccaccattggggataaccgctgtagacatccgagggttttacctctctatttttaaagtgcgtatacattcataaagacacagcatcaggctgtaccaccagaggtttagatcccataggtctggggtgacacctaacagttaacattccaacaagcctcctggcactgctgacaagcccagctccatggccggcccacactttgaggagctccacttctaatcatacctattcctacacatgaccatcttgtgctcatgcattttccacttgccaatgtctcagaaaccttcttcatgtccttcatcaacacgtggtatggcagaccattgctatggccaacactgagtttcagggcttctaatgtgggatctactgcctctgcagggacccacagataggtctgttcactttctcatctgatgtatcttttttcttttttttgagatggagtcgtgctcttcttgcccaggctggagtgcagtggtgtgatcttggctcactacaacctcgctgtctcaggttcaagtgattttcctgcctcagcccccagggtagctgggattacaggcgcctgccaccatgccctggctaatttttgtacttttagtagagaaggggttttgccatgttggccaggcttgtctcgaactcctgacctcaggtgatccacccgcctgggcctccaaaagtgctgggattacaggtgcgagccgctgcacccggccgatctgatgtatcttaaggcatagagcatgacataaaatgactgaagagcacctcacgatttttgtttcttacccttgtttctccctcctgggaacggactgacccaaggtttaaggcaccaagaatgcccagcaatgtatttttttcccagataaaggaagatctgccacatgaaaaatgaccagttatcttggtctattgatgcacaattgctaaacagacaattttcacatccattctcatttgaagttcccaatgaaccagagtcactgaagtatccactatttcccttcctgttgcagaggaatccaccttgaagctatgaatacttttttgttgtatttatatttatcaacacttatatcttctccctctcctgattcagtgagatcagagaatattaaagccggaggggctctggaggtggcctgctccaaatacctcacttgatagataagacacaaaatgatttttctgggatcacaagatgggaacagtccttaataaatctctactccctcactctggtgcccttttgcctacacccagtattctgagccttcattgtcctaggaatggctgccctgagcctggggatgtcccagggtttttaggagcctcagcataagcttgacataattgatgtcagcatgttcacaatctctataggatcatttctactgagactaatcttattctttatattttcatttctcttcgcagtgttcttagaggttgattttttgtttgtttgtttgtttttactttaagttctgggatacatgtgcagaatgtgcaggtttgttacataggtatacatgtgccatggtggcttgctgcacctatcaacccatcatctacgttttaagccccgtgtgcattaggtatttgtcctaatgctctctctccttttgtccccaacccccaacaggccccagtgtgtgatgttcccctccctgtgtccatgtgttctcattgttcagctcccacttacaagtgagaatatgcggcatttggttttctgttctgtcttagtttgctgagaatgatggcttccagctttatccatgtccctgcaaaggacatgaattcattcttttttatggctgcatagtattccatgtgcatatgtgctttcactttaggagctcaactagcaactcccccatgcactccctcctccagtgtcagagcacactgcaggacccacccagtctttgaataggaaagcactggctgaaaagccccagaaagtggggatgtaccagtacaagtttcccacctgtgtatcccactgttttgtttggggagaacaacggatataaccgaaacgggctatctggtgagcataagttctacattaagttgtccctgtgcctgaaccatttttgtttgtttgtttttgtttttttttttttttttttgaaatggagtctcatcctatcacccagctaaagtgcagtggtgtaatctcagctcaccacagcctccgccttctgggttccagccattctcctgtctcagcctcctgagtggctggaactacaggtgtgtgcccccacacctggctaagttttttattttttagcagaggtggggttttgccatgttggccaggctggtctcgaatttctgtcctcaggacccacctgggcctcccaaagtgcttagatgacaggtgtgagccacagtgcctggttgccttgggccattcttcatccagctgcctcctactcatcccttgggtctgaggttgaacgttacctcctcggggaagctttcctcaattccccaaactgaatcaggtccttcctcatgtgtagccgttcgcctagtccttctccagagcactgatcacaccagtgattaattaagtatttgttcaattgattatgcagcaaaccccaagatagcagaatctcagtttttcttatttacccttttatcttcagcatctaggatatgtctggtggactaggctctcaataaatattttttgactgaatgaatggtcaaaaaaggccaactccagtggtctctctacaaggtgataaaagagtaaaggggccgggcgcagtggcttatacctggaatcccagccctttgggaggccgaggcgggcagatcacctgaggttgggagttcaaagaccagcctgacccacatgaagaaaccccgtatgtactgaaaatacaaaattagctgggtgtgatggcacatgcctgtcatcccagctactcaggaaggctgaggcaggaaaatcgcttgaacccgggaggcggaggttgccataagccaagatcgtgccgttgcgctccagcctgggcaacaagagtgaaactccacctcaaaaaataaaaaagagttaagggcaggctgtcttggacacatctctacccctatcttacatgcagaacgaatggtattaattttgtgatgaataaaaaatattttttctttggatatattttaaacttggatatagttcacatattataaaattgagtatatttgatccaatatgtcaagtaccattaaatggataaaatgataaatttggtagaagaaaaaatatttaggaaagtctcagaaatttaaatgtaataaatgaatatgtattcatatacatactataaaactcattatgtaacatattacataaagcacattttgtgttgaggagtgagttccctgtatttagcttcatggaaaaaatagtttcttgtagataaatattacaggtgactgaactaaaaatattttgacaatgtgaactacttggatagcaatattttgagttgttttatacactagttccttatcttaaacagaagttaacatactcatttatcaatggagaggtggcatttatcattaggaccatcaaaacaattgtgttaaaatctcagggacaagaatgagtgcagggattgtaagctcctctgctgggtgcttcgttctgctcttctatacaacctgctctgcatcctcttgagtgctttttaaacttccctcgtctcctccttcgtttccaggctttctcacccactactcctctttgccgttcctctgcctgactctattaagataaactaatccttggaatttgctgctttgaagttgatgtcggctgggaaactcatacacaggcgtgtcccagtcctgtggtctagaatcaacatagtgagacgagacagaaggctggtggttgctgctctgctggttaccagctgtttaaccctcggataggtcacactgaaaacccctgggccctgtttgttcttgtatgagataaggctagtaacactcacattccacgtttggggaaggataaaatgaaatcgcctgattggtcatacttgacccacagctagtgcttggtcaacgtgccccttccttctttctctccctacctggagagcctacagatgtggtaagtgattctgaaggtttctcccatgaggaagtgacacaggcttgtacttatttggatagtcaaggcaccttttgttcctgcggttgacactcttccaaatagttgaagttacgtgtaagtgaacaccacctaaccaatatgctactgtatttataaaggatgctaacttgaattagctttgcccaagcagaatattttaaaaaataaaaataaataagaagcagtagtccattctacctgtctgccaatttctatgttctagttaaggacatgggaacacatgatcagcaatacatgatcagatataatcaccacgagacaaggtgtgttaacaactttacgttcagggcctggaacataatagatgcactgtattttttgactaaataaatagctattcctggaggtgtgatgattatactatgcccagatcctgccaaaggcaaaaaggcaaaaagttatattcagaccagctatctctctatttttttccctgctcagggctaaatttttccgaaaaaatcacataagagtccaactgtcagaatgagttcatcacctgggctggggatcccagattctgtgagcagaagacttcatccacccaggtgtctatttcaagaacagtctcctcttttgcaaaagcgttcatggaaatggccttctctcctaacagacagcagctacagagcctcctttccctgggctgcagagggtaggttaatggagactgaggagccctctggagaacagcaaaaggaacacgatttcacccttcttagcatcctggggcttgtgatacagatggcccatgttgcaaatggagacgccgtggctatgttgccacttgcccttgcagacacaagtacggggacattatattcaattttgggtctccatccatatgctgctcctccaatttatttgtctacatgaagggatatgaagcccaaagccagaggacatccaattcggctttaattacagtgatgagctgtttgtcagggtgccatgagctgcaacgccaccttggtcgctgacaaactcggagcaggggtgacaccaactcccctgttggctgctgatcattgaggcttgggcagcagcagcacttagttcaatatttgttgtttgaaacccaacagttatgactctgccaagcttaatgaaagggagaaaataattatcagagagcttatgcaattttgaagaccaggggcttttaaacaaagttaccatgccagaagtgttcttggcatgtcatgaggactgttgccgttattagcgatgacaatgcagtcattatttttacactggcttaattgttcagcagacaccaaggaccgtgtcaacacagttctgcaaatggaaacaaacacgccatcattcagggtcccactttgatattctgcctttgcacttgtttcattttttctttgaagaacattctatagatcgaaggaattattccagacctctgattcatgctaggcttattctcttcctcattcagtctctcaatcaatcaatacttactgagtacttgtcattgcaagacctgaggaatagaggggctagcagaccagcctgggttctgcccttattggaatctttcaccttctactgcagaaggtcccacctttaggtagaatgatcagagatctctctgaggatgtcacatttaaactgtgactctaaggatgaaaagaagccagatttgtaactaatgaaaggatgttccagccggatgctggaactttgggaggccgaggcgggtggattacctgaggtcgggagttcgggaccaacctggccaacttggtgaaaccccatctctgctaaaaacacaaaaaattagccagacatggtggcagcacctgtaattccagctactcagaaggctggggcaggagaatcgcttgaacctgggaggcagaagttacagtgagccaagattgtgccactgcactccagcctgggcgacagagcaagactctgtctcaaaaaaaaaaaaaaaaagaaaagaaaaggaaggagggaaggaaggcaggaagaaaggaaagaagaatggacatttcaggtggagggatagcaactgcagaggccctggtagttgaagacattatgtctagataactccatcaccatggcttatgccatgtaggggtttgtctgtctcacatagcaagaaacctaaaagtaggcaaaagtttaccagtgcagccatgtcaggaccagcatctctgcaatttgtttggtcttcccttatggttacaagctgcctgcagcagctcaggccatcctatctaaggctggggcaggagtaacaggaaggttttaagctaactatatctgtcattttttgtttgttctatttcaagaaagcaagatattttccagaaactttgagcagttatatgtgtatgtcacgttaaccagaatggtattcaacaggcatccctaactgcagcagcagctggagaagtaagatttagttgcaaataccaataattcaagcacaattggagtttggttatcaaaggacaaaataggccatagatatttcaaaaaaaatggtatgttcaaagtattattttaaaaaggccagggatggggccaagcatggtggctcacgcctgtaattccagcagtttggaaggccaaggcagacagattccttgaggtcaggagttcgaagttagcctagtcaacatggtgaaaccctgtctctactaaaaatacaaaaattagcctggtgtggtggcacacacttgtaatctcagctacccagcaggctgaggcaggaaaattgcttgaactcaagaggtggaggctacagtgagatgagatcacgccgctgtactctggcctgggcaacagagtgagactccatcttaaaaaaaaagcccatggaggctgcactccaaaggtggagcgatagcatagtgtaacatgatttttgagatgtgtgaagaggtcaaatccacagaaactgagggccgtgatcagacatcaccaactgtagtcaaccacatgttaaagttgaattgttccgtcttctgttttccacatccaccttcttccgtccaccctttcctgaaggtccgtgtgaggcctgaccttgctttgattcttgcagtcctcttctaactgtgcccctttgcctccacttcctgcctgcacccttgcatctcctatctgtgacttttaaagaaagtaaatctcaacattcctcagggctccctatgacgtaaattccaagcttctctgtgtgacctcaagtcatttctgatctggtgccttatcctgcagccacagcccctgccacttcctcctttcacgactatcttatcacagctgtcctgttatttgtgattctcccaacatccctcaggaacatttgccttccttgaagtcctttttcttcgggtcctttccagagtcagagtgggcttttcttgacatccttatgggaaagggacaactcattcctttgcctttccaccccacttgcgttccacccctaggttgctacacattcccctagagggcttttgtttgtccacctgagtatcttcttcccactggtctctggggtcacagggggcaaagacctcacctcactcatcttggtctctggctctgagcacagcaccctgacaccatcataagctgtaactacaaattcaatggaattagtatgaaggtaaggagccagcaggttctggtggctcactgaggcattactgttcttgtttttgagatggagtctcactctgttgcccaggctggagtacagtggtacgatgtttgcttaatgcaacctcagcctcctaggtacaagcaattgattctcctgcctcagcctcctgagtagctgggattacaggcgtgcgccaccacgcctggctaatttttgtatttttagtaggcacggggtttcaccattttggccaggctgatcctgaactcctgacctcaagtgatccacccgcctcagcttcccaaagtgctgggattacagatgtgagccactgtgcccagtttgaggcattgctgtttaaggggccagagagaccacaataggcacagaggctgagacaacatgggtggtaccatgtagacaacatgtagacaacatgggtaccatgtagacaacatgtagacaacatgggtggtgccatgtaggctcatccctccatgatttgctggaagaactaagacggcagtaggagaagtggataaaataatgtctgtggagtcagactgcaagggttcaaatcccagccctgccattcaccagccagatgaccttggtcaatgtacgtaatgcctctgtgcctcattttatgcacctgcacagtggaggtaataatagtgcctgcctcataggattttccagaggattgaataagataatctttgagagtattccagtacatggtaaactctcgcaccatattaactattgcagtatggtgttattattattatgaatatctaatacagttaatatctttgtacgtaggagttttagcaggcaggtgtgaatggcacttttgaagatgcagagacagatttatccttatactcctaatatttatcctcaaagacactatttaactcattcaaaaatatttactcttttttaaagaccgctttcagctcctttttatacaaaaaaaaggaattctatcctcattctagcaatagtagcctaaagaaaatcttattacactcattatcttaaattaaggtaattgaaaaccactgtttaagagtagaccccaaatgtatcataaaattaattcaattataaataacaagaattgactgtacttgaatgtgcatgaagtatagaatcatagtggaacatttaagaaatatgtccttatcttgttactatggctacatgttactccaagatacagtagttctatggtaaggttggaattacattatttcctctctatattgaaatattcagcaactaatttcctgtagcttcatagtaaatcatgctaatgacctcagaggtggaaaccaaggtggtgagactttctccctgctctaaggttattccattaaacaaagcagagaatacacatttatactcatttgatcaggaagcataaggaagcttataatgagaaagacatggcaatgacatctcatgaggcgatgttaactttaaactcaagtatttaatattatttattcattgcgtccatgataggatcacaacagtgagaaaactagagattcatatgggcaggaactgagaggggatatggtacaattgaattcaattccacaagtaattcatggaaacttatcatgtgctaggtacgtattaggtaggatacccccataccctattctttgtctactgaaattattataatatttttgtgtatatcactaaacattcaaaacagtgggaataatgaagaaaggaagttacactggtttctaaaagccctatcatcagtagcaatttctcaaaagctcttcatgacatcctagagacatcaaagcattggaagcactggggtgctggggctggctcacggcatcttgcaccagcggtacatatctcttccaaactctgtattcagcgatgtcttgttggtagttgaagtccaccatgatggtaatatttacaccacagaaacaaacaaatattacaagtcaggtctttttttcttcttcccagagaattggctattaaacagttagcagcatgccactgattacaagcagcgatgtgagattgtatcttcttatttcaaagactgctctttccactttatgtgtttgtttccctttcccaaacctcttccacattcacctgtaagactgatttttgcctctctagatgaaggtgagataagagaggtttgtaagcttgtctctgtttacttcaccctgagtcaagccaccaacttctcttgctggactttgtctgtaactttcaaattagtccctttgtgttgatgcttgctcccctccaatccaatctccatccaccaatgagagtgatcttctaaaattgtaagtcacttaagcaaacagaagaaaagtaataataatgacatccctaattctctctctctctgtctcatgtctatgtctatgcctatgcctatatctgtgtctatatctccctatccctacccacttttctctcccttgctatcattatctctgtccccaatatatgcttctgcacatctcacattctggctttttcttatgctgctccccataagacccttcacttctctattgacatcattttcaccttcaactccacactcagatactgactcatacatatgattgattctcacctgcctgtgtcttgttgatccaggtctcagcttagaaattacttcctccaggaagctgtctccaagtcctgttcagatatctgtccttatagagcgttttttatctcacttactatactttttgttgtcttacctatttactatatgcttatatagtaagcaactcttaggaattagacaaaagttcccatttctgtaagacagatttccaaaacaggacagatgcttgatgaggaatgcttgagctggatttcaaccttttcttcccaagtattttgtgtggtgaacaacctgcatgactggcccttccccttaaccatttccattatagcatacattctgtcattgtagcacttagatgtgtatagcaatctttattatctgcctctgtccctgaagattatataccccatcttttttttacattcccagtgcattgtgatcatatattattcatctttatgtgaaacatggtgacaagcatatagtaggtgtgtacattttgcttgaagtaaagtgaaatcaatcttgttcccataccactcaaccttactacctttattcacccagatactaatcaggtactgcttcattccagatgcttagaaagatgagcaaggcacggaatatccctgtaggaaactcgaaggcccatcagagagacagacacataattgaacagtggtgacacaatatgctccatgacaaacatgtgtgagactaactgcattagaattccctggcatgctttaatgaagatttccagactgtacctcacacctaatgaattaacatatttgtgctgcttcttctgtcttctctgtgcccctcttcccatcgtttccaaccaactcagccagtcactgctccctccagcagggaatatgcccctgtgaaatgtacctatgggaggatagccatcattggctagacctggaaactagttattctaacccagttaataacaaacccagaacaactgaacccctaaaaggcggtggatttggacaagaagttctagagagtatttgctaagaggtgttgatatgttgcaaagaatcaatcacttatttttcaaggatagctttaaaaaaaaataaaagcccacctacttagtctattagaaataaagtcagtaggccaggcacagtggttcacgcctgtaatcccagcactttctgaggcagaggcgagcagatcacctgaggtcaggagttcacggccagcctgaccaacatggtgaaactgtctctcctaaaaatacaaatttagctgggtgtggtggcacatgtctgtaatcccagctactcaggaggctgaggcaggagaatcacttgaacctggaaggtggaggttgcagtgagccaagatcgcgccattgcgctccagcctgggcaacaaaaaaaaaagaaaaggaaaagaaaaaaaagaaagtaaatcactaagtagccttttgcaagacaaacaaaaaaaaaaagaatatttaggatttagtctataaccattgacttttggaaatcctgtccttcctaaggaaaattagaggaaaaaaaagagctgaagtctctgttgcatgagaaataccatttgtgattaaactgctgtgaaatacatactcaaaactgtgggaaattcttgccacatctttctaaaattgctgtttgatgtcttacatgccaaaatgactgtgaactagtgctctcttgaaaaccacctaaatgatccacgacaaggaagtcattaattaaataataaggtggatgtggactactatgcaatcattaaaaatctattctcaaataatttttaaacatatagaaaaatgcataaaaatactattaagggaaaatataggttataaaacaatattatagcattgttctagttttactaaaaaatcgtgtgtattcaccaaaatgttgacagtagggtttaaaatggactggtacttaaaggtgattcctttacatttttttctacttgaaatatttctatatttatttgacttcttcataatggccatgttttatttttagggctgccattcaattggtcatccaatctgggacaggtttcagagtaaaagaggaaaccttagcaataatatgggactataggcaaaagcaggactgttttggacaaacacgctatgtggttgttacgggctgaattgcatcccccaaaacccatgtgttgaagtcctaacctctggtctctcagaatgtggctttccttggaaatagggttgtggcagatataattagttaagatggggttatactgaatgatatagattgggtctttaatccaatatgactggtgtccttagaaaaaggaaaaatacggacatagacacgcccacaaagaaagaacactgtgtgagcaggaaagcagagattgggatgatgcatctacaaggcacggaatgccaagaacagacagtaaccaccaaaagccgtaaccgcttagtgggttcaccttacctgctgcctacccagagccaacttctcaagacaggggaattgcaatagagaaaaagtaattcatgcagagccagctgtgtgggagactggagttttattattactccaatcaattcccctgagcatttggggatcagagtttttaaagacaatttggtgggaggggaggggcagtgagttggggagtgctgattggttgggtcggagatgaaatcatggggtgtcatgttcttcttgcactgagtcagttcctgagttgggggtcataagatcagatgggccagtgtctctatctgggtggtgccagttgatccatcaaatgcagagtctgcacaacacctcaaacaatgaccttaggagcagtttagggagggtcagtatcttacagcctccagctgcatgactcctaaaccataatttctaatcttgtggctaatgttagtagtctaatccccaggcaagaaagaggtttgtttcgggaaagggctgttatcacctttgttttaaactataaactaagctcctcccaaagttagttcagcctatgcccaggaatgaacagggacagtttggaggttcgaggcaagatggagtcacttaagttggactgttttcactgtctcagtcataattttgcaaaggcggtttcaatcctataagaccaacatacaacagattctcccttagagactcagaaggaaccaaccctggcattaccttgatctcagacttctaacttccaaaaccatgagacaggaaatgtctgtttaagccactcactttgtggcatttcggttttttgtggtaggcctaggaaactaatacaatggtcattgtagttattttatatttagaaattaagagcaattctggaggtgagagatgggcaggagtagggaagaatgaagttcagtgcaacaaaagaagcttgttcactcaactaagactgtaaacaatgctgtttttcaaaaatacgtattccttctttctgcctggcccctctttagagagccatgtcctgttgatatcaagcttgaccatgtgacttgcttcagcctgtggcgtgtgagtcacagtcacatgttccattgagaaatgggagctttaaagaccatgctacggttctgccacctttgtcgtttgccatgacacgagcttatcctaagggagagctgcttctttagcctgaaacagagttgaaactgatctgcaatgaacctgtcacatgagataaaaatgtatcttttggccaagtgcagtggctcacatctgtaatcccagcactttgggaggctgaggctgggggttcacaaggtcaggagatccagaccatccaggccaacatggtgaaaccctgtctctactaaaaatacaaaaaaataaaataaaattagcaaggtgtggtggcatacacctgtggtcccagctactgtggaggctgaggcaggagaattgcttgaaaccaggaggcagaggttgcagtgagccaagatcgcaccactgcactccaacctggcgacagagagactccatctcaaaaaaaaaaaaaaaaattgtatcttttactagtgttattcaccaagattaggaggccgtagtgttactgcagcagaatgtagcctaagctgactgataaaacattgactaagcaactctcaggtaccatgccaggatgaaaaaattaattagacacagaccctgccagtgaagaactaacattatactgtgtaccattggcctttaaaagataaagatttttggccccaggtgtgttctatattttctgtaagacctgcaagtaaatgttaaatgatgttatttcaaccggtttttctgtagcaaaaatctttaaaagctctcatattcaaagtggttcttgcaatcttgaactacatgtacagatataaaatctgccaattaaaattttatggtttagggaaaaaatcccctctgaaaaataaacctaggtcaattatttcattatttaattctcatttggaaaataagatgttcagacattgagttatattagaaggaagaaaaccacttctgtgggaacagtcaaatttatttcatttactattagagaatgttaatttcaagaagcaatctttgaaagcaaccaaatttggcaaagacaagtagtcttccctgagaaatattggacagcaacagattatataaggaaaggacagaggggagagacatctcaagtgtaggtctggatggaggtagaagagtcatgttctagagtcagcattgtaaagcaaaaattgcatggtgtcaaaattatccttgaaagtcccttaaatggcccttaaattgtctggacctgtgcctttagaggttgaaaggccaagaattaatgtcttttgtttctctggggcagtgaaggccaaggtctaatttgaaaggggcaaaggacgatggggaaaataaaggatctctgcctttcttggtccatcttttggtctcctgtcctctctctaggtgactcttcctccagctctcctcctgctctttcccctcaacagtgcatatagctaaagtcaaacaagttaaatgtgcatgttaggcaactctagtccttacaacttaaaaactttaaaatggatgcattgggggcctattgtgtaccctgtcctaggctagatatggaagagatataaagcagggatgggggtgagatgaggagaggaaacaacagacctcacaggagccaggaagactgaactgcaaacagatgatataaatacagtgtagtcaagtcaaggcagtagctcaggtaaacacacaatgccacaaacaggagttctcaaaccttggctgcattttagaatcacttgagcttccaaaagcttcaatgcccaagacacaccccagatgcaccccaattgccagtgaccctggaatctttggggaggacctggtcatcagcatgtctttgagctccccgggtgagtccacatgcagccaaggttgagactgggggctacagctgtgtagaagagcatctggtgtgggtctgaaggctgggcaggaattagctggtagcagtgtgcattccaggctaggggaaccccagtactaaagcttcttcagcacaaagaggcttggtttgtgctttgaacatagcgtggttataaattaaagaataaccaaactccttgagttgaatcagtacacaccataatgcatcagctcacattgacatggcaacctcttttcatctctctttgttaagggccactggttctttaaaagcatgcgtattaatggattctatctgatgatgattcactccatagttccatcatgtatgcatctctaaccagtataagcaaagcattttcctttcaagagtctaatcctagcattgtgccatatccatggccctctaagatacacaccccatctacaaaggcgacatgtactcttaaggtacaaagcatttcctttaggggagtgattgcctgtgtgtccaagctgatgaagggtgctcttttaagttggagaaaattgattttgttgtggttgttgcacaaaggtttatgttttcaaagcctccagataaaaggcaccatgggcagctaacaagcccctaataggactacatcaagttttactcacctgctgccagggcttgacttctgcgtcttgacgacatgaaaccaggctttgacagcattcatttttgctgaaggaccctcccccagcctccttccataaatcctatgctcctttattccgtattcattcagcacagatgtttttatggccataatatatttatactaattcagaggcttgccatcagtagataggctcatctctctgatccggaaggcggcagaggcactccttctgacattgcagatgaaaataaggtctgcttttttcccacagtgctcttcaaaggagcaattttctaaaattcgaacaagggtgtcatagttaataagatggaattctccttttctttttcttattatattttccaaatcaagggcagtagattccagaactccaatgacgtcaggccactgtactttcaaaatgctgttctcagtcaggtttcttattatctgatcctggttcagtagattgtctcagaattgactttttagattaattttgattcttagttaaattactttttaatagctaattaccacacagtctatctgattaacggtattgtgattcagatcaagcggtgagatgactacaggtaacagacccttgctatcatttgggtgttctcacaaggaacaggagccaggtagtgaaccatgtgcctaccctttgggcagggaatgggtggctctaagagatgacagatgctgtcatccggaatcagttctcatcttggtcaattggatgagtcagagagattttggaaacatcttcaggctaacccaatttacattatagttatattttaattgccttttaaagtctaaatgcagttgattgtgaaaactgtgtcacatcatttaagggaactagagctttctttttatggaaacgcaaaaggacctagcaggaaaataccacattgcctaagcagtaaagaaatatgtccggccgggcgcggtggttcacacctgtcatcccagcgctttgggaggccgaggcgggcagatcacaaagttaggagatttagaacatccgggctaacagggtgaaaccccgtctctactagaaatataaaaaaaaaaaaaaaaaaaaaaaaattatctgggcatggtggtgcttgcctgtagtcccagcaactcgggaggcagaggcaggagagtagcttgaacctgggaggcagaggttgcagtgagccaagatcatgccactgcattccagcctgggtgacagagtgagactctgtctcaaaaaaaaagaaagaaaaaagaaaacagaaagaaatgtgtcctcaaagcttcctcagattgttctagaaaagagcactagcagcccccaaccaatgcatgccgtgaactcattccaggtatcatgcacctttgattgtttcactttccttgggtcaaacctttagaaagtgggttccctgtctcaggcactgagctaggtaaattcaggggataagatcaggaagagtcccttcctgaatccaggtactcccactccccccggacaacaaggtcagaggcaatccctcgccttcacctctcatcttatttttaaataaaagtttctctttctttatgttcttcgctttctccttcaacaagattgtttcctgctccctccccacccctgctgcctctctgaatgttgtttctcctcactgcactgtgctgtgcagtgaatccatatttcttttccttttttccttttcacacttgaccacgtctttattcaataactctgccccttcacagcacagggcccggtggaggctgcccttccagggagcccaggctcacgtgtacttgccagggctggctgtccctgtccagcaggtcacagacctctcctggtctgacactgaggagtgaccagtgctgactcagagcagcccatctacgggcgcactgttcagaaagtcgtggaggtagatatactgctccagcgttggggtcataaggccacaggccggggactgctgcagagccacgttaaacagatccacggtacactcagtccctgcctggtgctgcagctgctccatggccaggaaggtgcccagctgggtcgcacccttgctcgagtcactgagcagtgtgcctggcttctggctcttgccctgagagcagcactggcccatggtagccaggaagggcggcggggtggtccttggtacctggagccatcaaatgctgggctctctttgggcttcttcgcagcagccttctttctttactttactcacttcctaaataacactgttctcaggaccttcattactgcatatatattaataattcacaaatctgaatttcatcctttgcctctcatttggtttccaaatttattttcactcacaattcctacatagtcagacaccttcaacttcacgtttccattttgattctttgtcttgccttccatgtcttgtagcttatctatttttttctgtctcggtaaaagttcccatttgcccacagtagaggattgaaaataatctggcttttaaaaataccctgggggaaacaaaaaaaaagaccattcatcagtctgctgattctatatctctgagtaacactgtgaattcctgtgactctagttgagttaaatttattcctagcttttaaaaataaagccaatgaaagaccagagagattattacaaagcctgcattcttgtgaagttgctgaatccacagttttattttagtcaaatcacatttccatattgcaaaaatattttctaaacaattaatgggtatcatatggggtcagtcttgtggcgtttattcttttgtaacactgagctaaagtctctatgggaaagataaataggttgttggagaattaaactggtcaagaagtgaacattgatgcctaaacctctcctctgaaattttgagcacatgttaacataggcacataaaaaagagccttagcagaaagaagaaacgatatttccattgttgggtcacagtggtcactaaaggggatataactttaatttctcatttgaacgtacatggcatccatttaaccaactcatttacagcatagccgcctgtcaagcatataaaactgtaccacattgagctggatcggtttttaaattctaatataatgcacctgggcacggtgggtcatgtctgtaatcctagcactttgggagactgaggctagtggatcacttgaggccaggagttcaagaccagcctggccaacatggcgaaaacccgtatctactaaaaatacaaaaaattagccgggcatggtggtgcatacctgtaatctcagctactcaggaggctgaggcacgagaattgcttgaacccaggaggcagaggttgcagtgagccgatatcacaccactgcattccagcccgggtgacagagcaagactctgtctcaaaaaataaagagaaaaaaaaaattgttacataatgcaccctcgcacatgctgttggatgtaccatgattcaaactatgaattctgtaggaaagctacattttaaacatgtttgggtgaaaatgatgtgtcaatgtaggttcaatgactgtatcaaatgtaccactctggtgggggtcattggtaatgagggaggctacatgtggaggcaggaggtatatgagaaatctctgtagctgactttcaattttattataaacctgaaactgctcttaaaaaaaccgtaaaaaaataagtttgatgaacttggttttcaagcaggtagcaattaagactgtggttgtcatagagacagacctatggcaatggagatgaagggtgggagcttggctttatcagaatggcaattctgcatttttgtgaatgtcagcaaatgaatttgacccatgacgtatggacgtagatcaaagggcacatttagcatactgtcaatgtggtgctcgtgtggccttccaaaaggccagttccacagtgataaccaccactaataatcctacaaacctctccagctgctttcagtgacatgacttctgatctggagggaaagaaaagaggggtgatattttataaatatcaattttcaaaaatctctgatctgttggtattaactgatgagctcagagatgctcggaaacctcctgcctgcacaacaactgtaaccatggcaacctgcatttttaaaggatgttaaagatgtttttaaacatcaggtgagaaaaacagtttccacacaagtgtttgtctgggatgttatgtctaattcctccagtacacatttttccgttactgggacttgatacaatgctggaagctttcctgttagggcagaaattgggcaacccaagacagtcacagatcttgagatcgctgccattgctatgaaaatgaggcattcttattgcatctagactgagcatcagcatgcctggtgttcttatacgtcatacatgaaagagattggcaacccttcctgaaagctttgaatttttgatatcatttgttccacgtgattttctaaggctatattggaccactatacattctagaacaaattaattaaagcctccagtttccagggagatatactaatatctcaataaagtgctggatttgagtaaaagacagagaatcatgtctgtaatcctagcactttgggaggctaagttcaatgtagtattcagaatttgaatattgagcttctatattaaagaaatcatcaaataaataaataagggtctatcagttttctgaagattcagatttttgttgtttttaaatgagtaattctaattgtattttaaatgagtatagggagggtccattttaaggagtcagaatgtaatcaaagatgcctattactattatattttcagatagaaacagataaagttcaagcagtgcaaatactaaataagcaaattaagcattatgtcttttttttatggtctgccactcatccacaaccaccagcatttgtcttgacaaaccaccaacatttccctcccccgccttgactgtgcatggatttgcatatttatagagttaaagaatcacccaccatggttctctttcttatccacattcttgtcttacccatccgtctctgtcactctcctgatatacctcttccctactaattacattaatcaacaacaaacaacaactctaaaagattccccgagatgagagtttcagaagcctgagacgctatgtcaaacaacccaccgtagttattcagggacactgcaactcaaaatgaggtagccatcgatccagagaacaaatgatcattattcatgtaactctcttctttgcttaagaatccatctttttctatcagtgccaaattctctcactactttcctggttctaattcagaagtaagtaaagtcagctagtccctttgtttgggggttaggcccattttataaagaattaaaggaaaataggttaaacatgaactgcttctcagacgtggcatttacatgcctggtgcttccttagctcatcatataaccaagtactggaatctgttttacagataataagaaacattcacgtgttccatcttttacatatgtgaggaccaggcactgactagaaaattttcatcaccattgtcctcatcatcaccatcattagcatcttgtcgtcatcattgtcacgatgacaaagatgctttcatgatgatgaaagcatcatcatgctttatttacgtgatatcattgaatccttccaacaagataccagaccattttattgtagacattttacagatatttacactgaagttcagagttgttgagtggtttacccaagaatacgtagcaagtaaatgatagagctgaaaattcaatctgtctttctctagtgctaagccttagtttccctaccaagttttaaaggttgaacaaagcaaggtgttgaaagagcaccctgagtctgacagtcagaggggaatcagggcaggaagtatctactgaagaggtcctcaaatttcaggttgcctaaacagttactgaatgagcttgtcaaaatgcataaagaaggccctacaccactaccactaccaccaccctctgacacacatacacacagattgtgattcaataggcctgagattagtccaaaatctgtatttgtggcaaactccccaggtgatttcaacagagacagtctgtaggccacccttggagaaatggtgttatagctggattggggactgttgagatgcctaaatccccaacttgtagagctagcttgggctgctcccaagtctagcacactcattgatatggtttggctgtgtccccacgtaaatctcatcttgaattgtaacccccacaattcccatgtgtcgtaggaggaacctggtgggaggtgattgaatcattgaggcaggtctttcccatgctgttcttgtgatagtgaataagcctcacaagatctgatggttatataaaaatgagaatttccctgcacaagttctcttctcttatctgccaccatgtgagacatgccattcaccttccaccatgattgtgaggcttccccagccacatggaactgtaagtccaataaacctttatttttgtaaattgcccaatctcgagtatgtctttatcagtagtgcaaaaaatggactaatacactcacctatgtagggaaacctctttgttccctacataggttctctgcattggttcagagtccatctcttccactgggatgtccatcttgtggtcaaaacctgcaccccaggtaacataaaataaaaataacaatggctataattgtgaaccgcccgctaacctcctcttgtagtgctccaggccagacgctcatcaccttgttttgttgtctttgccatcagcattatagtagagccattggcactcacccatgtccagccccgttcctcctgggcacacagaaatttccgactctgttttctattgcctttgcagtcagatggaaccatatgactagtgctagccaaagtgtgtcatctccactctctttctttccttggtaccatggatgtgtttgatatggtgccagctgcaaagtagtggaggcttcttcagtgtgggttcttgagctgtcatatagcataaagccgccacccaccattctgaattcacagcatgagcaagagataaacaaacctttgttgagttaaggctctgggattttgttttattttgttcagtttttaatttctgtaccatatcctaacccatcctaaccaataaaacctcgtcgctgtcaacatcatcatcatcatcgcaataataaaatgtattaattatgaacataaaaccttaccgtgtgctgaacattagactaagcattttgcaaacattatctaatttaataatcacaccaacactataaaaaagacatagttgttatctgtgtcttacccagctggtaactgatcgggaaaaaaatgaaaacccagcagcctgactccaaagcccgtgtgcttatccaaacactacagcgtaggttgcttagtgccagcttcagtggttagttctttacatgcttatcataggtaatcctctgtcaacctgtagaagtaggcatgattaacttaattttccattgtgaacactgaaggttggacagattcaatgtctggtctgaggccacacatcacacaccacacactacataccacacatcacacaccacacatcacataccacacaccacacaccacacatggtggagttaggtcacaatccacgtccctctgactcttgaaggaagcatcatttattgaaaaactagagtgtctaagcaggtgattttgattccttcaagtctgtttcagaaatgtctaggggccccacagatctcctgaggtcaggggttcaaaaccagcctggccaacatggtgaaaccccatctctactaaaaatacagaaattagccaggcatggtgggggcgcctgcaatcccagctactcaggaggctgaggcaagagaatcgcttgaacttgggaggcggaggttgcagtgagccgagattgtgccattgcactctaggctgggtgacaagagcgagactctgtctcaaaaaaagaaaaaaaaaatcatcgttttactgatgatatttacaataacagcttctgccagtaatagagactaccaataaccaatgctatttattaaatactaacagtgtgtatatatatatatgcatgctggctagtgtcacgccctcacaaagtggacattattatcttacagataaaaacactaatgcttggagagtttcattgtttgccacagggtgcccaggtaaaaccatggcagaactggagacaatccaggcagcctggctccaaaaccttgcagttggccagcacactctctgcccagagcccagcccacgctctgatcacagaaagtgtgtgggagatgagtagaagcaggagaaaaaaaaaaaaaaagtaaaatgtaggctaaggggttgtcctgtaagaatttaggaatccctaagaaggagaactagaggatcaagggaaaaaggccaagtccagtaagtccctccaaacgtcaagtggggacatctcagtagagtatacccctacaactgatctgccaagatgttccacaatacaaaaaggattctgttggcaaaaacaatgcccacccctgcctgtcttgaagattcaaaatgcacagtagatgatagatgatggatattctaagatttgttgtagcaagaggctggttgtgtgcttaactcttcctttctaatttgcttttgaccacagcaccctttttattatgcaaaacctattaacatctactgaaaggcactcagcatttgagggaggggactagcaggctgcagaggagggtgctaagttctgtgctgaggaaggtggttggttgtggaagatgtagtggtcacaaatgagaagagtggacagtgggtacagggtagggatgatgagacctggaattgatgacctcagcagagaaggggaggaaggataagaagcaaataacagtgacatatgtgtaagttaaaaagatggaggtagagctagtttccaagatggcttaaaaatacacatgggtgccggtttgacctcaaaatagaaattagagacctagaattcaggagagaaggcagaactagcaaatggagactctaggtcaccttacctctccttttcttggaggaatggtggaaagagaagaacaactgaaaggcttcagcacaatcgctctgtaggacccaggagagagaagagtagcctggaatcaacagtggtgggagaggctggagggcctcaggaaattcaaggcaaaagagtagttagctctaatgaccattctttaaaagtagaaaaaatgaaagtggagatgtgcattgtttgtggaaagatagaaccttcctcagtcagaaagcattttgccattagcagcaggcagtgatgctgacaatttgcagttggtggccaggttttaaacagtagtttgggcaagaaagggtatccagcaaatcaatttgcaatagctgatccctgtcattaagggagtcaattcttgatactgtaagtgaataaccaagtgctgctctggtacaattgaggtatgaaataccagacctgactattttatgtaaatctctaacatggtgtttaagcaggacagagcagcggggaggaaggggcttaagcagaaatgggctttgaggacctctcggcccagacaggaagagtaattgggctaagatgagagaggggcaaaactcagcacatctccaaagccatccaaggttgcggacaattaacctcttgattcctccctcctttccttccaagatcagatttttatcgtctcagaaacatatgaacttcaagaaaatgtgaggaacacagactttctgagccagcttccattgacatgccatttgattaatttatgtggttgggacagcagttcagagggaatatagattgtgctcttacctgccccatttccatatttaatatattcaggcatggttatgatagagcatctcatgtttacactaactttgtgtcttttgaagttcacttttaactttgtgttgataaaatactattttctaattcagatttttcaaaaaatgcccgttgggcatcaagtagcttttacagaatgaggtgttcttagcattattatgaagcaaggacaagtgtattaccgccattcacggagacatttttgcagtgttgcaaatctcccaaatgtttcaaaaaattacagcagttgcctgttgcacctcacaattagctgcctaagattctaggagagaagcagttggattttatatgtgaaaatgcctctatttgctgcatttttactttttgagaagttgcaagttacatgaaaataaacatactatataagaaaacacggcagatttctcctggtgttttaataattccacgaaggtttatgaatattggcaaacgtatttgcagtggtacttccctgctatttactttgtagactttgagtcttagattcttgtctgtaagtgaaatgtagtattaaaaaaaaaaaaaaggccgggcacagtggctcacgcctgtaatcccagaactttgggaggctgaggcaggtggatcacttgaggtcaggagtttgagaccagcctggccaacatggtgaaatcccgtctctactaaaaatacaaaaattagctgggcatgctggtgcatacctgtaatcccagttactcactaggctgaggcaggagaatctcttgaacctgggaagcggcagaagttgcagtgagctgagatcacaccattgcactccagcctgagggacagagtgagaccctttcccaaaaaaaaaaaaaaaaaaaaaagcattacaagttggagtagcctgggctcccgtgttggctttattactgagctgtgtgcaggtggatgttttgctaaatctttctatgttccacgttatcaagaccctttctctcttttcccaaagctctcgtatcaattccatttaagccaaatctcattatttcattgcttttttttttaattatcctatttttaaaattattctccctccttctggtttccattttcaaatagttcaactggatagacataatagcaaaggcatagaatcaacctaggtgcccagcagtggtggactggattgaaaaaaaacgtggtacatatgtatcatggaataccatgcagccataaaaaaataaaatcacaagctttgcagcaacatggatgcagccaggggctattatcctaagcgaattaatgcaggaacagaaaaccaaataccacatgttctcacttataagtgggacctaaacagtgaatactcacggacataaagatggcaacaatagacagtggggactactagagtggggagggaaagaggggtatgagggttgaaaaactactagatgctgtgctagctaggtgacaggaccaatgatactcaaacctcagcgccacacaatatacctaggtaacaaacctgcacttgtacccgctgaatctaaaacgaaagttgaaattataaaataaataaataaatgtggtgcttatttttaaaataaatgaacaaaaaaaccccaaagagcttagctaggtgttaagtaccatccaatggacggtgccatccattatataatatagatatttacacacacactcaaacacgcatacatgtatgtatgtgtatatatatacacacacatatatttacgactgtagccttctttccagcagaagcagtttgccaaatgcctctgcccttccttagcccaaatgctaatagtagctatttcatgaatagatacagaatgacagagtcaactttacctaacttctccaaaatgccgactccagtattccattttcaaattaacttattctgattataaaagtaatgttcagtattgttagtaaaataaattttaaaaaaaacgaacttgtaatttccccactcagagatagcttctgataacatattggtgcttttacttctatttttttctatccatatgagtataattaaatacatattcacatctatatctatactcattcatatatattcatatgtaagattaaactatatgttcaaattgtattctgctttttaaaatcacactttattttctgggaatgttctcttcataaagttcttccaaaccatgatatttaatgtccacataagaaaacatctcatggactctcaatttattgaaacttttccctagttttggttattctgtttcccaccagtcattaattactttaaacaattctgtgaggaccattcaggtacacagacgtgggtccacagttatctattttcttagcctcagtgcttggaagttgaaatttgtattgaataactaaattcctttgacaattaaaacataattatcaaacttttttgcaaagaaataacactatggtatatgacatctatggcatatgacagtccctgcttaccttatgcttgccggcattcagtgcttaggtttccttttttttttgagacggcatctcactttgtcgccaggctggagtgcagtggcgggatcttggctcactgcaacctccacctcctgggttcaagcgattctcctgtctcaccctcctgagtagctgggactacaggcgcctgccaccacacccagctattttttgtatttttagtagagacaggatttcaccatattggccaggattgtcttgatgtcttgacctcataatctgcctgcctcggcttcccgaagtgctgggagtaaggtgtgagccaccacacccggccaagctttcttaaatgggccactttgattgatgaaaatgataaggtactgtggcctttttttttgccatttaaaaaacagtggtaaggttttttttttgtttctccatgtcttgggaagcagctgcctgttcaagccctctttccttttcctatttgggtgttaatggcttccctattgattcataaaggcccactacttattgtggatattaatctcttgcctgtcatatgtttgttgcctttcttttatgccagctagttatttgaattaattggatttgatgttttgaaatactgaatttttaaatctttagacagatacaataccattttttccttatgcgtattctcttgtttatacaattaacaatcttggcctgttccaaaatcaaagtcacatgaatacatatatttttctaagtttttatggcttcatattcacatctgattcttcagtccctctagatcttactttcgatgtatggtttaatgtgaagtcccatttcaagtttttacccttcaaattaattttccttccaaatgttattttattttattttaaatacccattctttttctggttttgtcacatagctttcatgtgatgttaagctctaatacatacaacaatttactttgggaccatctcatatattaaattttgcaaaaatgccatactgttccaacactcatagttttataatgtgtcttaacacatgacaataaacccttctaaaatacacacaggtttcagaactgccttaattattttttgctttgatttttcctctagaaaaaaaatgtgatcattttctcagactcccaccctacttgttttctcaaagctactgtcacactctggatgtacaaggtcaggggtggtgagagatcagggtgtttaggagtgtttgcttgactgatggagacacagggttcccaaactggaagatgacaacataggagaagcttccagttttccagtcaaagatactatgtttcatgaggcaaagcgtgagaaactcaccaatacaatttcccccaattccactctatcagcctttgagattttccggacagctatctgtcagtcttagtacttaaaattgttggaagtttgaacacaattcttcaaagatattttagtgaggaacaagagattttgctttggaagatcctgaacagatttccttacaaaaagtatttctaagcacccatccctataatatatctaaatgttaaatgcttattgatggagtaaaatggaaagtccaagagtcgtaacattatctggtaacagtgtggatgagaggtatgggagatgtaggcatgtgcatgtttcctgatttgaccaaacttttcaacatgagtgacccttctaactagttttccaaaaatagagagaagagatccagcatcaatgaaaatgacaaaattgacaaagttttgccttggccctcttccatcgtcgctatcctcttctcctctactcaacctccccatcagtctttttacccgcccgcctccttttttttgagggaagctgtattaggccattctcacatggctataaagaaatacctgagactgggtaatttataaagagaagaggtttaattcgctcgtggttctgcaggctgtgcaggaagcatggtggcttctgcctctggggaggccttaggaaacttatagtcatggtggaaggcaaaggggaagcaggcacttcttcctggcagaacatggcagaaaaggggcatggcggaaacagggcaagagaatggggtggggaagtactacacacttttaaaggaccagatcttgtgagaactctatcatgagaacagcaccaaagggatggtcctaaaccattcatggaggatgcacccccatgatccagtcacctgccaccaggccccacctccaacatgggggattacagttgaacatgagatttgggtgaggacacagatccaaaccatatcaaaagcttttctaattaggttactcattctatgaaaatagactgcccataaataatctttgtttttcagatgaagatttggcaagttctgtgcctagcacgatggctgacatgagataagtgcacaggaaattttgaaatatctgtgtctctatcttcatttccttgtttgtgtctccaatttcctatatgccatcaggggatttagtgacactgcaaatagcatgctctttggcaggcacgcctctcccatttccccagaacctcttcgtctttctgaggcatggagtcccaagctgtatgttttcaggtagtattgtaggaagattaacagtttcctgacatctttcttgcaaaggcatgaatacctccaccggtgcagatcaacataagaaatttaatgtttaccttgccattttataatgctatcaactttctcaaaatctgtccctctgcactctgttatttaagatttattgtcatcctgcatggtgagatagctggtggacattagccccattctcaggggtagctgctatggttgaaacatgctctaccaaaattcgtatgttgaagtcataatccccagtaattcagagtgtgaccttacttggacataggatctttacagaggtaatcatgttaaactgaggtcatttgagtagaccctagtataatatgactgatgcctataaaaagagaaatttggagatagactcacactcagagagaactccacatgaaaataaaggcagatggccgggtacggtggctcatgcctgtaatcccagcactttgggaggccgaggcaggcagatcacttgaggtcaggcattcaagaccagcctgggctatagtgaaaccccgtctctactaaaaatatgaaaaatttagccaggcgtagtggtgcatgcttgtaattccagctactcatgaggctgatacgcaagaattgcttgaaccccagaggcggaggttgcagtgagctgagatcacgccattgcacttcagcctaggtgacagagagactctgtctcaaaaaagaaaaaaaaagctaaaaacacaaaataacagcagaaatcaggatgatacatctataagcccaaaaatgccaaaaaatgcaaaacaaacaaacaacaagaaaaatccatgagaagctaggagacaggcttggaacagattcctcctcacagacctcagaagcaccttgatctcagattttcagcctccatcactgtgagacaatcaatttctgttgcttaagccacccaatctacagtactttgtcataacagccctaacaaacaacatagtagataaaaacaaaaaacaaacaataaaaaaagaaaacaaagaaggctaaatagcttccttctgaatgtggatcgtttcatcagaggatttgatctactgaaccttctactgcactaaaaattctcatttcatcaagtataatgaactgaagtcaaagggatttatttgatgctgaaccaagccaacactctccccaccccaccttagtctaccgttaacgtgtccgaaattgcatgcgttgttttgcttggatgttactagcccttgctgggaaaggtacttggcactaatgtgactatttaaactaatattcacaaagcagttaccctgtgccaggcttatatggattcatgtaattctcacattaattctgtgagactggtgccatgactatgccacttacatatgtccagccagaatctctagttataacttgttcctggtcatacactctgctggttgtgaatccagcgtttgaactcaggcagtctgaccctgggggtgacatttaaactactttattgctgggttctatgttctcaaaagtttagaaggtatttgttaaagagaattggaatatttgctatggaacttgtcagagcttttaaatatgctattatcttagggaatctctgagagtgtggtaaagtaagcagcatttctagcacatagttaaccgtgggtctctttttattaaggcaagatctcttgggactggtgtttcttgaatagacttgccagacaaaatacaagaccccattatgaaatttcagataaacaatgactagtgttttagaataagcacatcccaactattgcactggacatattaatactaaagaatttgtgtttgtttatctgaaattctaattttactagggcgttctgtatttttatttgcaaaatttggcaaactatatgaaagatgcttcgaaaactatagagaacacagccaaagatccctgcctctcccaatcttctgggcctctttctttaggaaacaaacataaacctgcccaaactgaggttgtaccctttttacctgccctgttaccttcctagcatccatcttgctgtccttcattctgccaccctggggttcctatcaaactctgcttcctgtctcttatgacttagaacatgccatcccagacccagggaacagaacaggcatatccctggttatttcaaagccagtatcacaccagcatgtagagatatgaccagacaataacaatcctcctccagttatcactcgagggaaaggagagggacttatggggaacagatgcagataaaacccaaatctgatgccttgaggctggtcagtatgaagtctgtcctgtggtatccctctgcaacatttccatttcaggggagttgagggcttatcaagcttaggaagcaatgtgtactgaaaaggatgaggtcagttcggggtctgtcaaatcaattgaacatatcttgaaccctgaattctatcatcaatctcactttacaatccatcccttccaattaatgctgcatataataacaccactcaatgatgttcatacatcccatcttcttacttggcactatcttttttttctttttaagagattaatttgtctttccaatatattcaagttatcttgaccaatgtttcagaattacttagagctttatggattgcagcaagaccgaagcaaatgaccactcataattcagaatatttctgagccagaataaagtttacacttcatgaccataaagaggaccctttatgcttgtatgtagaagctcaattcaggttccaaacctgcactgtccagttaggtagccactagccacctgtggttacttaaatttacccttaagctaattaaaataaagttaaaactttagtttacgagccatatgtattagtctgttttcacacttctataaagacatacctgagattaggtaatatataaagaaaaaaggtttccttgactcacatttctacatggttggggaggccttaggaaacttaacaatcatggcagaatgtgaaggagaaacaaggcacatcttatcacagtaaagcaggagagagagagaaaaagagccaaggagaactgccaaacacttttaaaccatcagatgttgtgtgaactcactcactatcatgagaacagcttgggggaactgcccccatgatccagtcctctccaaccaggtccctcccctgacacatggggattaaaatttgaggtgagatttgggtggggacacagagccaaaccatatcaccatgctagccacatttcaaatcatcagctacgtatcgctggtggctattatatgcagtacatacatactgcacagtgtagatatgaaacgtttccatcatcatagaaagctctcttggacagccctattctagatgctttattctcaaacatgccacaggataacacataagatattggcatggataccattctatttggtttgggacagaagaaataaggaaaaatgtttctgaaacagggagtccattttagattattttatatgaagttatcaatagtttattaatatattgattaaaagatgacaagttctcaacccccacgatagcccactggtgaagacagaaccatgcagacactattaattcggctctgtttctttttctaatgagccagtgtggagactggggaagaggaagggattgtttggaaagatcagagcatccaggagaaactgtatggggatgggggcaccactgactgaatcagagcctccagtttgctttgggtgaccacagagggactgaacaaacccctgtgttgtcagtccttagttttgagaatagccttgaccagcacacttgttcactgaggaaggatacgaaaatgcagataagttaaaacaaacaaacaaacaccgtcattcttactctggcagccagatgagtcaccaacacattaaattctttatagatctctataccttcctttatgtaaatgtgtataatatgctcacaaaaataagatcataatatacatactgttttttcaacctgcttttttttttttttttttttttttgagacggagtttcactcttattgcccaggctagagtgtaatggcgcgatctcggctcaccgcaacctccgcttcccaggttcaagcgattctcctgcctcagcctcccaagtagctgggattacaggcatgtgccacaatgcctggctaatttttgtttttgtttttgtttttgtttttttttcagtagagacggggtttctccatgtaggtcaggctggtcttgaaatctctacctcaggtcatccacttgcctcggtctcccagagtgctgggattacaggcgtgagctaccattcccggcctcaacctactttttaaattaatatgcttcaacacatttccaagccaaaatgacttgtaaaacgttgtacttaaagattgtggctacgcttggtggctcacgcctgtaatcccagcactttgggaggctgaggcaggcagaccacgaggtcaggagttcgagaccagcctgggcaacatggtgaaaccctgtctcttctaaaaatacaaaaattagcctggcgtggtggcaggtgcctgtaatcccagctactcaggaggctgaggcaggagaattgcttgaacctgggaggcgggggttgcaatgagcccagattgcatcactgcactccagcctgggtgacagagcaagaatccagctagagaaaaaaaaaaaaaaaaaaaaaagtccttgtgcattaatctgttctataggtgtttttagtggaacatttagtgggggtccagttcatccccaattataaatataattccactgagcatcctcaactttgtgcacattcctaataatctgcaaggaatacatttatggaaggagaattactgtcttaaaagggggttggggtgggtatatattattaaagtttgcgataaaagtctttagttgcttgatgaaatggaggcagaagtttaatccctaaggacccttctaattccaaagttgtctgagtgccggattgtagctctgttgagcctgggtcttaagtctgagcgagcccttagttaccttcctctcccatcagcctgagccagagttagcctgaggtcccaaactatgagcaggagaatgtcaccctaggaatggcaactagaaagtttttaccccggatgccatgatgaggcactgccatccactggagcttgctgtgattatggaaatgttctctatctgcacatccagtatgataagcactgaccacatctggctgctgaggacttgagatgtggctggtgtgaccgaataactgggattttaaatcttatttaattttaatagccacatgtggctagtggctaacattttagacagctgttctaagagcatacctctgagactcaaatactcagatctttgccacattgttttatcttaaatatgacaattgataacattgctcatgctcagctgcttgcttcaaatgacatttatttccctcgctagttcttcaaaggtagggactaatcaccaaatctccaatgatagtctgatgccatccccaggtctgctacagcacaaaggggaccctcaatgaataagcatgtcaacatcaatcactttcctcaaagtttaactcagctatgatagatcatggcatatccgcaagccaagctactcatccaaaatatggagatcttgtaagttggagattgtgatgataatagtacctgtcccttagtattgttgtgaggattaaatataagaagagcacttaatattagtgcctagtgcagggtgagtctccagtgaatggggaccattactcttgcctccaacattgtagcaaggtcccctccacatagggataagcctgtcaagacccacgcctgttactcaaaatctcttttagggttatttaaatacgtggtcaagtattgcattaggagaaatggcttaagaacaagagaatgtcaaaccaaattgagttccccttattgtgtgctctcatgaagcacttaccacaatgataattatttgcagtagtattacctaatacctgcttttcccaccatgctataaacacaccagagcaagactgtttatcttgttcacggatgtattcccagtgctaaacatatagtaggtgtttaataaatcctgaatgatagattgaggatgagtgggtagtagatgggcaggaataaaggagctacgggaaaccctagcatagaaaaaaatagtaccagaacccctgaaatctagtcctgtttaggttcacagctaactatcggtccactgaaaagccctggttttggcttctctgttttataaagtgaaaaaggttgatccagattagggtttttcagcctcagaactatagacatttggggcagataattatgttgtgggaggccgtcctgtgcttataaaaggatgtttaatgcacctgtggctgtacccattagctaccagcagccctcctccgccagctgcgacaactaaaaatgtctccagaaaaatgttccaagcagggaaaactcccccgccgcaccccagttgagaaccactgatttagatcctgtctgaagtcccctctggcactgatagtctaagattcttcttgggaccataatttctgaacatgtgaattttctgacatttcatagatggttatagaattataagaatatttccagctactcacgcaaataactcagacctgattatcaatttaatatttggatcagtgggccattaaaatgctgatttgaaattcaattttccatttttaaaaatgatcactttgtgaattctgttagctggttgattttatttaaatggagtgtgtaatttttcccgctctgtgttcatgaataacgctttatagttgaatgtcagaatgcctgctaatgaccctaacaatcatagcttatttctagagaatccatacagtcattgaggctttgttttttttcatcttccactcgtttccttggaataagacctttaattaatgctcattaagatgcacaaatagcctggccttgaatcctcccagtgtttggttcactctcccctaacttattaaagttgcttctggaagttacatagagacgtgcagttaattcctggaacagtgtgtttgtgcttctcattatgcaaaaaatatacaccttggtcaaaaaggaggtatatttttacacaactatttgttcataggacatgtatgcattaagcctcaacaaatgcgccaccctattggcaattatggaattcgagtctcacatcagagcaaatgtggtggtggcctagtaggactttcaatccccttccttggaaaactgccttagtaaggagttcagggattccaggaaatacaggaaagcctttgggatgtgtagtcccattcatatgaaatccacatttcccagaagaccacagaacttttgtgttccatgcagtgtccctagcactacaagctattatctccttaaatctctcaaccctatcaggcacatgctaacaggaccatgattttactatcaacaaaagggaggatgggcgcggtggctcacgcctggaatcccagcactttgggaggccgaggtgggtggatcacctgagatcaggagatggagaccatcctggctaacacagtgaaaccccgtctctactaaaaaaaaaaaaaaaaaaaaattagccgggcgtggtggcgggcacctgtagtcccagctactcgggaggctgaggcaggggaatggagtgaacccgggaggtggagcttgcagtgagccgagatcacgccacggcactccagcctgggctacagagcgagactctctctcagaaaaaaaaaaagaaaagggagcctccctagagaggtgttaagtaacctgcctgaagtcacagaaccagagtttgaattcgtctccccagatttctggaattgcagtcttttccagtgctacattgcccctagatttaggataaaatacaaatgacttatattttccacttaaaagaagcattccttagcatcaaactaaagttagttcaacatatattcctatcaaaataggttaagtttttttttttttaatttataagtgcttatgaacaggaaacgatgggagaatagcttactttcaatgactgctttgagcgtctaattttaatccatatattttctgtaggccactgtttgtagcttttagagtagatttccctctcttaaaagtaaactttgttttacttagaaaacacagagaccttggagcatagtgattgttgtgtttttaaatttcattggtttaattgtcgtttaaaagtaaggttttttttgttgttgttggtttgtttgtttgttttttttattaggaaaacattctcttcatcacatagccctaaatcaatcaacatattttaagagaactgaaatggttttggggtaactttatttttgctattgtagtctttggaggaaataaatgcaaatgaaaaaatcagttaagatcagacgatggatgtattttttttttcacatcctttcctttataaggttaggaacaaacaaacttcctaggaactatcctaatatggattatcataatctatgtttttacaaaaatagtgccaaggaatggaaccaatttaaatggcttagagcatgagacttttaacgtaggactcaccttttggtggtagctaactgaaatgacatcagatctgtaaagaagtgtcccatcatttaagatttcttcagttacaacctaaaagaagccatatgtttgaagtgtgtgctttgtacattttatgtgaaaacatggtcccagcagtccatattatcttggaactatgcagactcccgaagccatgcctccttttcacagacgtaattattagactatgcatgccaattttaattctagaaaaacggtcactctaggtaatgttctttaagacaaacaaacaaaggctgcttaatccatgatgctgtagtcatttgttggcttgtttattttaatccccaatttacaacaaaatgtgttttttttttcttacagagaacccacaatcctattaacagcgaacttctcttgaatgaaggcattacagcagatttaaatccatgcattacaattttagcaatttaatgaacatcctatttggcgacattattgctttaaaggaataaatcacaaacattttacttcccacta

SEQ ID NO: 770 - DNA, 554233 bp, Homo sapiens; identical to SEQ ID NO: 769

SEQ ID NO: 771 - DNA, 102494 bp, Homo sapiens
tttcatatttgcatatactttaataacaagttcattttagtaataaatgaacaaagaaacagagacagagaacttaacacatgatacttccacaagtttgggtctaaaaaggtttacatcaaagtttaaaacatatactgtctgtgttaacagaggctacaataccaatttggattacgcacattatctaaaacattattatcaaagagtgcaaagttagatcaaacaacatcaagaaaattctgtcctaaaattttaacgtcttttaagaaagtctaaaaacctccttttttcccactgacttcaaaactttgagttttatatcagaatatcaatttgtcattttaactttaccatacatgaaaaattatcaaaaatatatcgatgggtctatactaattgtgactgtttatatttacattaagcaaattctcttgccaagttctttatatacaaattaccaattgtcctctgtgaaattcattaaaaagttaaaaaccacagaaatgtcattagaaacaacatatttcaatatgtaactgctttccatcaatgaagaatatttttaaataacttaattgaaaagtattgaactccccaccaatttcagctgcaacagtattcctcctgaatgttttctgtgatttaagggggaaaaaaaaactaggtaaagcttgattgcaaataattcaatgacaaaaatgtgatgagtgtttattgaccttatcttcaagatacttatagtctaattaggttgacataaaaaaactaagcaataaaaaatgtaaacagtgttagaaactgaagaaacagaaaatttttaaaaactggcaaatccaacgtataaatatttttcatattaatttaaatcacaaaatgacatcccaaatccaattaaattgaatgcaggcaaggctttctgatacttctaataagggccagcattttaaaaaattttgaactattcccaaattggaaataatttagattttagaagcatcataacagataaaagaaatttatcaacatttaagaggcaaagatttaggggaaagttcataaaaagattatattaatgtcactaaaataaacaggccactttaattgttttagactcatagttacatagtaaggaaataaaaaagttgtctttttctaagaaaaaacttgaccacaaaatcataaacatctctaatttaaagagcattggttcagatgaatataaaactggtgcaacaatttctccagtacagatgcatgtctcttgaccaaaaattaactgagtttgtaaaaattgcttaaaaattaatgcctcaagattttctggtttgaaaatagagatttgctccatttttgaaattatcttaatttatgttaattatatactcttctaaagcaagaaatacagctctaaaatatttacctaattagtgctctgtctctggactttaggaccaatactctgtgtgtcctcttcctgactaggacgtttcccaccactgagaccagtgcccatggagcttcttcctgcacatttaaaaaatgtatgtttaagataggaaaaggaaaaagaacagtatgctccaatgcttcattcttaccttgcttcaacaggtgagtttgctgactgtcgccatgagcatagtgtaaaataccactcccttgagagcaacctgttagtatttaaaacacagtaaaattacttaaaatcaaatccaagatgtatgtattattaagtctacaaatccaacttttagcgcttgtacttaaggtcatttatatgcttttaagactaaatctcaatcttcctatgaaccaaaaatcacatgctcaaaccaggaaaacttaaatttaggctcacagaagtgttgacagctcaaaggaaaaatcattgatgatcattttctaaaaaacatttccttactagatgacaatttgaaacttgaccatgaaggtaaaacataggggcaagagtgagatagacattcctccctcactcttgtcccttttcccacgcttttccttcagagctcctccaaacatatttccttgaggataagggaataagggcctgcccgatgagttaaacaattcaaatcatacgacaagcagaagacacagactatgtggcagttacctagcctaagcaatcctatcaacccttctaaaaacaaacactattataggagaataggttggctagaacagagaagtatgttttagggaaacatttctgtcagtgtgtccagtttatggaaaaatatgagcattctggacctatccacgagcaggtggataggtcaacaccttatggcctgaacaagactgtgcacttactttcgttttaattaacttcaatcccaggcaatcagtggcagttgctcaccctaagtgagtatgaagtactatcccatagttgttttaatttgcatttccctaatgactaataatgccgatgaactgatattttacaataaaaaaacctaaaagttaaataaaaactaaaacatattgctacagtagtaaacatattacagtctgttttattataagaacaaaagtaagacttctatgtatagtttattcctttcctgagcacatgtgcacacacacacaaatacaaagatgagcagagaaaaatgcaatttgtgttgcagagattaagaatgttccacagtcattaaaaaaacaaacaaaaacaaacaaacaaaaaactaagacaagtaaaagaattttgccctttgacatgccttgtaaggtactataaaagcctacagacaggataagtgtaaggcataaaaggatatgctttagaagcatttaagtcctttcaaatggggcagaaacctgagaggagaaatgtttaatattaatagcatagcccaagccgtgtcttttcacaatttcccatttccaggtctaaaatgtttttttccttcatctgactacccaaatgctactcaatcctgccacctttcaagaaagtttctctagtcccttcagctctcaataatctctcccttttctcatattgcacatggaggcagcatcttataatttatcactttttcatttgtttttgttttccctccacacccccatttatacttaagttctacttagcttttcatgtctcatgtcttttgaaagcctccaagaagctggctacaaactatgttacaggcaaatatttacatgattaaaataatttcaagatttattaattcttctattatataataaactaccctatatacatttgtgaagcaaaattgtcccaatttaacctgctactatgattagcttttgaagataattccaaataaacgacacaggtttgagtggtctaagaagcagtctgtgccatcattgtgtattagcccaacccttggttcctagcccattgctacctgcctgttatcttagtgcttcacagagcttctgtccctcactcatgtgtgggctgacaaggcaggctgtgaactgaacaagagatctgaaagaacttttgaaatgattatcttgtggaagtttattcaaattgtaggagatactgagaaggaacatttctcaagtatactgccatcactggcaactgtcgactgctgggtggatcacattccaggaataaaatattttctcttgtaaacacttatggcattccatttgcagaggaggcccaatgatgcaggaagaagtacaagctttggagctagtcagacttggatctgaatcttagctcaactacttactaactgtgggatcttggttaagttacctaatctttctaggattatttccccaaatataaaatgaggatcccactacctcctccccaggttactgtgagaaagtatgcaaaaatcccttactatctactgggcaaaggtaggcagtcaaaatgtgagtgcttttgtccccttctcccaaaactaattcttggaggataaaatacatgctgttttcatgaggatgcaggacatttctgaattcaaaaaggttcagtttttaaaaggttttattcttaatatcaacttagaacatctgacttaaaaaagcattcctcaaatgctaccctgtttttatcctgttttttttattttgaaaaatatagattcacaaacagttgtaaagttagtacaaagaggtcctgtttccctatcttcttagtgacatcttatgaaactacagtacaacaatataaccaggtattgacattgatacaaagtgtttgtatgattttatgctcttttatcacatgtatagatttcttttttcttttttttcccttcaatttttattttaagttctggggtacatgtgcaggatgtgcaggtttgttacataggcaaacatgtgccatgggggtttgctgcacagatcaacccatcacctaggtattaagaccagcatgcattagctattcttcctaatgctctccctgcccctgcccccccaacagaccccagcatgtgtgttttgttgttttttgtttttgagatggagttttgctcttgttatccaggctggagtgcaatggcgcgatctcagctcaccacaacctctgcctcctgggttcaagtgattctcctgcctcagcctcccaagtagctgggattacaggcatgcgctaccacgcccggccaattttgtctttttagtagagacgggggtttctccatgttggtcaggggctggtctcaaactcccaacctcaggtgatccacccacctcggcctcccaaagtgctgggattacaagtgtgagctactgcacctggccccagtatgtgttgttctccgcatgtatccatgtgttctcatcattctacttccacttacaagcaagaacatgaggtgtttggttttctgttcctgccttagtttgctgaggataatggctacaagctccatcatgtccctgcaaagaacatgatctcgttcctttttatggctgcatagtatttcatggtacatatgtaccacattttctttatctagtctatcatcgactggcatttaggttgattccacgtctttgctaatgtgaatagtgctgcaatgaacatacgtgtgcatgtatctttataacagaatgatttatattcctttgggtatatacccagtaatgggattgctcagtcaaatggtattcctgcttctagatctttgaggaatcaccacactctcttccacaatggttgaactaatttacaatcccatcaacaatgtaaaagccttcctttttctctgcatcctcaccagcatctgttgtttcttgactttttaataatcaccattctcactgatgctgtcctattttttaatcaaattactgagcttcatgctatttttggtcaaagccaaaaactaatatgatggttcaaatttctaacacatactgagttcctgaaattattaatatcacacataagaatttacatggtcactaaatttgtatcatacagaaaactactacagaccagactttataagaaaaacttatgtgcaaaaagactagagggctctatgcatgtgtacaataaatcttttggccatgttcacagggccactgactttcttaactaattaccttatagttgccatacacctaaggagtaaaaaataataagcattctgaaaatatgacatttgagtttcattttatccttaaaattgctctcctcagtttgcaagagctttaacttgacccagtatctattatacgtaatgatattttccatctctaaaatgtcatcaatggagtgaagagatgtgtctgggtgcacatgtatgcatgcatacaaagaatctattaagctaatttcaaagacagatttttataaaatatgttagtgaggatcaataacaaatatatttgtttaataacctcttcatgttactaagtgcagaaatttccttttcacttacttccactgctgctacaacctgggatattttctgcagaatatcccatgaagcctccattcccattaggattagaaggtactgatgccagaagacctaaaggacaaaaaaattttcttttaaattatgatcaagataaaattcaaagataagtacataaacagctgccaaagaaacaaagacagttcttaacatacctagtcctctatatcgtgaaagctgctgatagatctgtttcatcctttcgatattcaaacggcttgcctcagcatggttcaccattggtttaggataattaactcctatcaaacatttggctaccttttggataccttctggtgcattccagggatcatagatatattttgcagggaagcctcttaggacaggcaaataacgcctttgggagaaaaaagaaagattactaataaaatgcactctaagcaaactataactactagctatgacagaccaaaatcaaatcaagaccatttaaatgatctgtttacccttctcatctctgctgcccatcatgagtggggaatactttaagcattgattaaacatgaaaagctcttcttgaattaactattccaaactgagtagtaatcacccttgatttacctgatatagtctccattgggatctgttctcctaccaaaaccaacagggcaatagcagtgaaaaaactgttgaaaaaaggaactacaagacagccacatccaacttccagcatttatgctccaatctgcatcaagcaataattcttcaaataccttcagaagtaacagtaaccaattagtttgcacacacataattcgcaaagcaagcattttcaaggtcacagtagagccaaagtcaaggcaaagaaaatctagcacagaattgtaaaattaaacattccaaagttagcttccctatgttctgttctataatgagctcttccagagaaagaaacatagtggtaatatagtatgcttctgaagagaatttacttttccaacctctgcagtgttactgggagaatggaaggtaaaaaaaatattcaaatcactgatttaaaaggatgtggatttaaaaggatattattagtagacacaggaaaagcagtcaaccactttcaagaaagcaaaaatgctattacataaaacaccaacaaaaacttagcttcatattctagcctaaataaaggaagcatactcaaatataaattcacttaaaaatatatactagcattacatagtttaatttcgaattccttgatcagaaagaaaatagaattaaaataaatgatttttatatatattcattaagtatgttatatattgtctttgtatacaacggtgtactaggaaatataagagattaaacacacacacacacacacacacacacacacacaagctcagaaatggtccttggatggggcaaatgtatggtattgccagaaaggtaaaaaatgtacgtaatggccgggcacggtggctcatgcgtgtaatcccagcactttgggaggctgaggcagggggatcatttgaggtcaggagttcaagaccagcctgggcaatatggtaaaaccctctctctactaaaaatgcaaaattagctgggcacagtggtgggcacctgtaatcccagctactcgggaggttgaggcaggagaatcacttgaacctggaaggcgtaggttgcagtgagctgagatcacgtcattgcaccccggcctgggctacagagtgagagactccgtctcaaaaaaaaaaaaaaaaaaaaagtacctaagtcttattacgtgtaatccacaagatgtcgtcacaaaatgtagtatgcttctctttacataatagaagtattactaaaaagctgagaagtgaggtgaaatgatttatattttaaaatttataatatgaattcactatctctaggaactctttagtgaattcttttcgtgatagaaatatcacctataaatatatctatcaacaaattcagtgttaaattttacagttctcttagtggctaggctggtttaaccattaaaatgactttaggttaatcaatttaaccagttttcacctttttgcttgtctgattataccatttttctctgaaagtgtccccgtatttggggaattaaatgttttatccactgaaaaactacaccataaatgaatctataaacagacaacttctaggatttgttttattaaggtaaggattccttcaaaataaggcatgctatatcagttagaacacttaccttcattccttcttcccaactaatccacaggtcccctcgtgtcaggaagcaagcaactgcatgcctggctagatgatgaatccaaccctcctgacgaagctgtgtcatgatggcatcaatccatggaaagcctgtccggccttccgcccatttggctaaagcctcaggatttttatcccaaggaatctgaacacagatagggtttccttccattttatcaaagcgtggattatttgttgctgctgtatagaaaaattcacgccataacagttgcccataaagggaaaggggaggggaactgttcttctttacctatggttaaaaagcaaagaagtattatcagaatttttttttaaagtattaaacaataagctctaattttagagaatacctttttgtagagatctgttagtttgaagtaaaacagtcgacatgacaaacaaccaaatcggagataaggactaagtccagtagggcttgcaagcagagaattcgcattcattcgaggtctttcaaaatttgccacccaagcctgaaaacacacagagaaaattatattaactaattgtctttttcattttaaaagaacactcagaatggagatttttttttttaaagttacatagttcttggggaataaaatcttatcctagccacaaattacatgttttaataaaaaataagacaggataaaaaagtgagcattcttttgtttcagtcgtccttgtgcagcacatactcatgtgaaataaatttccttcaaatttccaacagaaagctgagagcaccttcaatctctctctcttttttttttttcctgagacagggtctcgctctgtcacccaggctggagtgcagtggctcaatctcggctcactgcaacctccagctcccgggtggaggattctcttgcctcagcctcctgagtagctgcgactacaggcatgcgccaccacgcccggctaatttttgtatttttagtagggatgggatttcaccatgttggccaggctggtctcaaactcctgaccccaaatgatctgcccacctcagcctcccaaagtgttgggattacaggtatgagccaccaggcctggaaaatttatttatttattttgagatggagtctcactccatcacccaggctggagtacagtggtacgatcttggcttactgcgacttctgcctcctgggttcaaacaattctcatgcctcagcatcccaagtagctggaattaaaggcacacaccaccaccctggctaacttttgtatttttagtaaagatgggggttttgccatgttggccaggctggtcttgaactcctgacctcaagtgatccacctgcgtcagcctcccaaagtgctgggattacaggcgtaagccaccatgcctggctttcaacctctctttaacacaaaggtaaaggtgaaatataattctattctagtttcgaaattgtggccactagatactagcttaggtagaaagaacagaagaggtagtgcggtagtagctaaaggggaaataattagaagagaaggagaaagagcatttaaatgaggagatggtagttaactttcaaacaattaggtttgtgctattttaaccatttctgttaatcctcccctttcaacaatctatttgttatttttaaaagagagaaaaattattttttaaatggcagtttggaaatacaagcatagctatataatctacattatcatacttttctttccaaatgcctttccaaacgagtaagtgcttcagtttctccacctggccacactgcagaggataagccatctgtatcaaaacctacaagaaagaaaagaaaaaaacatcattcttccgaaactaatttttatttaaccccaataactgggagaacaaattactttgcagaaaaattaagagagtaccataaaaatgaactgaaggcctaaataagccctcacctatagaggatatgacatggtttcaatttttcaggatgtacatcttaaggtggtaacaatagatcacatatttataaaacacataaatgatgaacaaacatatcacttcttaaagggttctttttcttctccccctgccctttctttctctcctaatgcaaaatactttacatggcaaaattaaaaggggaattttctgagtaatttatgatttattaacttgcaagcctcacactgactacagtttacactcacctagctcttccagtgaagggactccatatttctcatcatggtcatcagacagaggagttgtgcacttttctatcacttctgaagtaattgtctctactggtatctctagtggttccattttgctgatgagagtctggaatcttttataagttagaggcggttgtccaccattgagttctatgatcctataacaagagttagtaaaatgtagttagtattaaaaaagacaatacattttggctaataagctcccaaaaggcttaaaaagcagaaaataaaattaatcactgaagtctttgagggtgttagcttgttataatgaccaagaaatgtgtccaaaatgattaatgagtccaaaaatcattctcctgagcttctagacatcctctgggtatcaaatatactacacaaatatactacacaaatattaaacctttaagacaaagaatattaaaaacttatgagaggaaaaaacaagtaagaggggaaattagtctaaaggcaattacaaaaagttaatacacacagacatatgaaaaacatgttatggcccagctcaaagaatctcaatcatcaataaaaactaaaccaggttgataattatatgaaagagtaatcagcaggtctcatttaggaaaaataaattttattgtatatatttgagtttacaacacattatgggatacatgtagatagtaaaatggttactatagtgaagcagattaacatatttataatctcagttacttttttgtatgtgtgtgacaaaagcagctaaaatctacttatttgattaaaattccaaataaaatacaattttattaactaaaatccttactctgtacactagacctctagtgttgttcatcttacataacttctactttgtatccttggacctacattcctgatatggtttggctgtgcccccaccaaaatctcatcttgagttgtaactcccacaattcccacatcatgggagggaccctgtgggaggtaactgaatcatgggggcaggtctttcccgtgctgttctcatgatagtgagtaagtctcacaagatctgatggtttttaaaagggggagttaccctgcacaagatccctccttgcctgctgtcatccatgtaagacatgacttgctcctccttgccttccaccatgattgtgaggccttctgagccgtgtggaattgtaagtccattaaatctttcttttgtaaattgcccagtctcgggtatgtctttatcagcatcgtgaaaacagactaaaacaattaccctatttccttcagcaaattttataaattttgattctatattactgtggtgacaattacttcctattttctattgtgctaatgaaggcatgagagatgtcagcatatgtatctatgtcacatacttagaacacataagcccccaaatttcaagttatttaaatttaagtatctttttacttctgatcattaattaactcaatcaattattaattaaaaaaataactagctttgccaatggtagttaaagattaagtttagacactcttttggaataactactctttttcactatggccatttgcttagcatttggccttaataaaaaatgacaggtgaaatccaactccatcattttatagatgtgaaaacaggcctaccaggagagttaagtaaactagtcaaggtcatataactgataaacggcaaatcaaggttttcttagtgtattttagtgtatttttcattatacaatacgtagtgatgtatcaactacagatacatacagaaagtaatacagaaagcaatcaccataaaagatatcctgtttaagtaaattttgttttggtgtattttgaatttattcatagggttgcaatgaattttgctgaatgtaatgatgctacaataatactactgaggacattgttaattacacaacagtagcaaaatgagaatcttaggacaaaacattttctatatgttacattttaatatgatagattacatatagtaaatattcacattcaatccaataaacacttgatttttttttttttttttgagacagagtcttgctctattgcccaggctggaatgcagtggtgctatcttggctcactgcaacgtctgcctcccgggttcaagtgattctcctccctcagcctcccaagtagctggattacaggcacccgccactatgcctggctaatttttgtatttttagtagagatgagggtttcaccattttggccaggctggtcttgaactcctgacctcgtgatccatctgcctcggcctcccaaagtgctgggattacaggtgtgagccatcgcgcctagcctaaacaattttatgcataacactgagtctcccacttagaagcaactgcttttatcctgtgttgccccctccttgctatgagctccttaaagttaagcaaattggtgagctcgaaggcaagattattattaaaagatatatgaattctagcttagtatcaagacctttgtctgaatcaaatcatgattttttgatacatttaaaatgtgaaatcaaatcaactagtttgtcatgttacagaatttgttttactaacttgataaaatacataaattactaaaaaagtaaaatgatttaaaaggtaaataaattataagatttcagtacttaaaaggacaatggtatgccaaaagttttaaaaagttaagttttacagacctctaagactcatagcatataacactccctaaatttaagtttgaccacagaatttctgtgggacaaagcatcaccaaggactggtgctggaagaaatacactttgggaaatattctattatgccattgttcagaggactacagctatgcaatgttatattacatccaatttgcatctggatttaaaatccagacagacataatagatatacatgaaataagataacattaaacaagcatacaaaatatgtcaaggcaatttataactatatataactataaaattgataatgctaagagcccagaaaggcaagaccacaggaggctgagttaagagtagtcaaggaaaattctgtaatagtcttaatccataatagttttgaaactgaaatgctgatacctgtcattgggtcaatagcagctaaataaaatgctaaggatttgacatatgttcacttaattctcccataactctgtgaagtacatgttatttctactttataaacctcagttaaaaacttatctatgtagttaataccaccgaactatatacttaaaaatggttaagatggtaaatattatgttatacgcattttcccacagtaaaaaaaaaaaaaggactcacttgtctaggtcatataatgtatgtgaaattcttacaatgacttctactccagcttcagttgccagtttcttaatagctgcgtctcgttcctttccaaagggctcagaatcatactcaattgaaagtttagtaatgttccattcctaaagtaagagaaaggggaacaatgtacaccaattgtaatagttattttttctattataacgaaaagtgaaaaagctgaaaatctacatatcaaaggattatacataaatcaaactttgaatatgcaggaaaaagtaaacaatttatcaattaaaaaatacataagtaatgaatgcataacccattagattctaggcattatgctaggcaacaatctagcaaagcaatatgcttaaaaccagctcttatactaaatgtgtttgtagagcactttactttttcaaattactcatacttacattatttcatttgagcctcaaaacaacactcagagtttggcactttggttagtatttccattttggagataagtttatttttaaaacttagggacctgccagagttcacagaaagccagaccacctgaatttatgtctgttgagtctaagaactggtctttaactaacctttgatattgatatggtataagctgcctggctgaggtcgtgtgtgtgtgtgtatgtaaatattttctttctgattactaaaaaacgttaactgaaaaatttggagatggtaataataatagcagttacttattatcaggagctatgttaataagttctgtacatctccttatactgattttaaatgaggaaactgtgacttaaaggaattgatttttcttaaggagaaagttttttttttattctaagtctattctgatttatctcataaagaaaaaattctaccattatttaactgcctatatggtaacatactataattcaccaaacacctccagattagacaagggctattccaatggtgggtttaaaaaaattgctattctaggcggcgtgcggtggctcatgcctgtaatcctagcactctgggaggctggggtgggtggatcacctgaggtcaggagttcaagaccagcctggccagcatggtgaaaccccgtctctactaaaaataaaatcattagctgggtatggtggcacatgcttgtaattccagctactcgggaggctgaggaagtagaatcacttgaacccgggaggtggaggttgcagtgtgccactgcactccagactgagcgacaggagcgaggctccatctcaaaaaaaaaaaattgctattataaactttacagtatatatctttacctttatgcacacatcttacaaattatagggtatttatccaattttttcctagaaataatcccttgaaaaacaactgatggatcaaagataagcacattcaaaattctgataggctgtcaaattatgtaccagaaagactgtacaaatttatattcccatcagcagtgcacctaaggcttgatctccacacacttgccaataatatgtattagtaatcttttttttttttttttttagatgacatctcactttgtcacccaggctgaagtgcagtggctgaagtgcagtggcatgatcttggctcactgcaacctccacctcccaggttcaagcgattctcctgcctcagcctcccgagtagctgggattaaaggcacataccaccacaactagctaatttttgtattttcagtagagaaggcattttgccattttggccaggctggtctcaaattcctgacctccatctacctcggcctcccaaagtgctgggattacaggcgtgagccaccatgcccagccagtaattgtttttaaatgtctgctaaactattaggaaaaaaatagtatctcattaaaaattttttcctttcttaaaagtcctgaaaagtgcacatcaagaaattaagggctgttgactttgaggaatagaatttgagcatgtaaataagataacttttacattctgctgcattgctcagatttgttagtacgaacttgctatttttgaaatttaaaaataaaactaagatgagaatagaaaagcattctatttctttgttttatagtgaggtagtatagaatagtttaaaaacacaggatctaacaagttagacttcctaagttcaaagactggctcaactacttaggcaaactgctaaactctccatgcctgtttcctagtctataaaatgggtagagtaagtaaggtgcagagagagtgcctagcacgtaataaaccctatgtaagtatttgctacagtgatgtgaaaaaattaaccatattattgggttgctaaagaattaaataacataatgcatatagagtgtttaggacagagcacaatgcatagcaagccctcaatgaatgacaggaactctttttcttctttttttttttttttaagagttaggctcccactctgttgcccaagctggagtgcaatggtgcaatcatagctcattgcaacctcagactccaggacttgagcaattctcccacctcaacctcccgagtagctaggactacaggcatgcaccaccataaccagctaacttaattttttttcgtaaagacagggtctcactgtattgcccaagctagtctcaaaatcctgccctcaagagatcctccttcctcagcctcccaacgtgctgggattacagacgagagccaatgtgcctagtgcaatttagcactgttttttgaaaaacattattttaaatcttagtaaatactgaagtgagtcaataaataacacttcctgccccttttccttcttgagttcagtcacgtaagccagggggctaaagataaaaatatcagccatattattagcaaagctgaattgtagaaaacataccaggtttcagggcaggtaaacttgctaatactatttcactgttgaatcaaacagatttacctactcaatcataagcagcacctcccgcagtgtgggctttccctataaaacgtatcacatagaagaggagaatataacgtgtgctctctacaactaaaagaaaaggaaccgtctcagctaaactagcccagctccttctcctaaactcaccaatgagatcattcacttttccttccctggggataaattagtgaacatctctccaaaagaaaaatgaaaatctagggaagagaaagtttcccaaaattaaatgcattcagtaatacactaagtatttattataattctaattatatgacagatattatgctagatgcccctctcctggagcttattgagaaagagtggcaatacagaggtaaattactgaatacgtaactattagggaaaaaaatgctatgataaagaatacggggatggggtatgaggtggtaagctaataatccacactctgtcttccatgactgcactggctagacttcaagtaatttgtaaaagcaaatatccttgttttttcctatcttgggtagaaagcattcagtgtttcacctttaagtaagattttatgtttttttgtagacttcctttatcaaattgctatttagcacttgatatggtttggctgtgtccccacccaaatctcattttgaattgcagctcccataatccccacatgtcatgggagggacccagtgggaggtaactgaatcatgggggtgggtttcgcccgtgctgttctcatgatagtgaataagtctcacaaggtctgatggtttttttaaagggcagttcccctacccatgctctcttgccagctgccatgtaacatgtgcctttgctcctccatcttccactaggattgtgaggcctccccagtcacgtgaaactgtgagtcaattacatctctttcctttataaattacccagtctcaggtatgtctttatttgcagtgtgagaacaaactaatatagcactttaaagaatttctagttagctaaaagacctttttaaaaagtatacacgggtgttgaattatgtcagatgcgttctcttcatttgttaagataatttctcttttcctttatcctattaacccagtaggttatattaattgatttttttaatgctcaaccaactttgtattcatgagataaaccccacttgatcctgaagtagcagtattttaaaatattgcaggctgggcacggtggctcacaccagtgagctctttgggaggctgaggcaggcggatagcctgagctcaggagtttgagaccactctgggcaacatggtgaaaccccgtctccaataaagatacaacaattagccagacgtggtggtgggtgcctgtaattccagctactcaggaggctgaggcaggagaattgcttgaacccgggaggtagacgttgcagtgagccaaggttgtaccactgcactccagcctgggcgacagagcaagactccatctcagaaaaaacaaaaaaacaaaaaaacatatatatatatatatatatatatatatatatatatataaaatctctatatctccaggttcacggtccggtacggtggctcatacctgtaattccagcactttgggaagtcaacatgggaggatggcttgagcacaggagttcgagctcagcctaggtaaatataatgagaccacatagtgtctttacaaaaaaaactttttttaaataaaaaatattgctagattcaatttagtgatttctgagtctttgtttatgggggacacttggctatacttttaattttttctcaaactttccttgtcaggttgtggtatcagggttatgctgtcctcataaaatgagttgggaagtaatctcaatcttgttttctgaaagagtttaatttaagaaggaaatacttccttcttaaatgtgtgatataactcaaaataaagccatctaagggcttgaagtttgtttatgggaaggtttttaattacaaattcaatttatttaagagatatagggctattcaggttttctttttcttcttatgagagttctagtaaattatacctttcaagaaattttttcatctcagatatataatttattgacagtatagtgtttacgatattctttactatgcttttaaagtctggagaatctctagtgatgtcctctttcttattcctgatataggtaacttgtattttctttcttttttgtccgaatcagtattaagagtttatcaattttattaatgttttcaaagaacccgtttttggctttgttgactaacaggagacaaaaatcacatcagcaatttgaacatgaaaaatttacaagggcaactcattttattgtgctttgctatttattgcacttctcagatattgtgcattttataaatcaaaggctaacggcaaccctgcactaagcaattctattggtgccattttcccaaaagcatgtgctcacctcgtgtctctgtgtcacattttatcaattctcacagtatttcaaactttttcattattatatctgttatgatgacctgtgatctcttctctttttttttaagagacgtggtttcactgtatcacccaggctggtcttgaactcctggcctcaagtgatcctcccatttcagcctcctgagtagctggcactacaggtaccagtcactacacccagcttttatcagagatctctgatgctactattgtaattgttttggggtgccatgaattgcacccataaaagagggtgaacttaactgataaatgtagtgtggtctgtctgccctacccagcctttcccccatctctttcaccctctctccctctcctcaggcctccttattccctgagacaacaatattgaaattaggccagttagtaaccctacaatggtctctaagtgttcaagtgaaacgaggagtcacacatctctcactttcaaccaaaagctagaaataagcttagtgaggaaggcatgttgaaaggtgagacaggccaggctgggcgcagtggctcacgcatgtaatcccagcactttgggaggccaaggcgggcggatcacgaggtcaggagttccagaccagcctggcaacatggtaaaaccctgtctctactaaaaacaaacaaacaaacaaaaactgggcatggtggcatgtgcctgtaatcccagctactcgggaggctgaggcaggagaatcgtttgaacccggaaagcggagtttgcagtgagctgagatcgagccattgcactccagcctgggcaacagggcaagactctgtctcaaaaaacaaacaaaaaaaaaaaacaaaaaagaaagctgaggcaggccaaaagctaggccatttgcaccagttagccaagatgtctaaacaaaggaaaagttcttgaaggaaattaaaagtgctactccaatgaacacatgaatcataaaaaaaaacaaagcagccttaatggcgatatggagaaaactttaggggtctggatagaagatcaaaccagatacaatactcccttaaagcatagtcctaatccagagagaggccctaacactcttcgattctgtgaaggctgagagaggtgaggaagctgcagaaggaaagttggaagctagcagaggttggttcataaggtttaagcaaagaagctgtctccataacctaaaagtacaaagtgaagcaacaagtgctgggtggagaagtagcaagttatccagatctatctaagataatgaattaaggtggctacactaaactacagattttcagtgttgatgaagcagccttctattggaagaagatgtcatctaggactttcatagctagacagaaaaagtcaatgccaggccaggcactgtggctcatgcctgtaatcccagcactttgggaagctgaggcaggcagatgcttgaggtcaggagttcgagaccagtctggccaacatggtgaaaccctgtctctactaaaaatacaaaatttagccgggcatggtggtgcacgcctgcagtccaagctactcaggaggctgaggcaggagaatcaattgagcccaggaggcgaaggctgcagtgagccaagatcgtgccactgcactgcagcgtgggtgacagaggaagactccgtctcaaaaataaaaaaagaagaaaaagtcaatgcctagcttcaaagcttcaaaggacaggctgactttcttgtgaggggctaacatagctggtgactttaagttgaagccaattctcattgcccattctaaaactcctaggtcccttgagaactatgctaaatctactctgcctgtgcagaacaggaacaacaaagcctggatgacagcacatgtgtttacaacatggtttatacatattttaagctctctgttgagacctactactcagaaagaaagactcctttaaaaatatcactgctcacagacaaacgtactttgtcatccaaaagttccaatggagatttattagggagattaacattgttttcattcctaccaatgtaacatcaattctgcagcccatggatcaaggaataattctgactttcaagttttattaagaaacacattttgtaaggctatagctgccacagacagtgattcttttgatgggtctgagcaaagtaaattgaaaatctttggaaaggattcaccattctagatgccaataagaacacttgtgattcatgggaggaggttaaaatatcaacattaacagcaatttggaagaagctgattccagtcctcatggatgactctgaggggttcaagacttcagtggaggaaggaactacaaatgtggtagaaatagcaatagaattaaaactagaagtgcagcctgaggatgtgactgaattactgcaatcttatgataaaacttgaatggatgaggagccgctttctatggatgagcaagaaagtggtttcctgaaatggaatctactgctggtgaagatgctgtgaacatcatcaaaatgataaaaaaggatttaggttataacacaaatttagttgatgaagcagtggcagggtttgagaggactgactccaatttttaaagttgtactgtgggtaaaatgctatcaaacagcattgcatgctatagagaaatctttggtgaaaggaagagtcaattgatgtggcaaacttcattactgtcttaagaaattgccatagccaccacaaccatcagcaaccactaccctgatgagccagtagccatcagcattgaggcaagaacctccaccagcaaaaaagattatgacttgctgaaggcttagatgatcactagcatttttttagcaacaaaatatctttaattaaggtgtgtattttttttagtcataatgctactgcacacagaaaagactacagaatagtataaagacaacttttatacatatgcattggaaaacaaaaaaattgtgacttgctttattgtgatgtttgctttattgcaatatttactttattgtggtggtctcgaaccaaacttgtaacatctcccaggtatgcctgtatcaaaaattgtaattgttagctactaaaggtggtcaacaatgacaaggaataaaacaggagataaggctacacttcagtatggtaggtagtagccactaggccacgtgtggcttctgagcactgaaatgtgactagctggcactgagatcagctggaagtataaaatacatacaagatttcaagaacttcatatttttttaaaactccgtttaaaataagctattttaaaagataaaatagcttattaatacttttatatagaatattttagatatactgtgttgaataaatcattaaaattaatttcacctgtttgtttttacttttttaatgtggctattagaaaattttaaatttaacatgacttctattggatggtactgctctaaggtgttcaaaagtaccaattgcagaaagcagctgccacctctatgtggacggaaaataaacaaggaatgaataaaaaacttaacaaaagctccctccaccaagccactgagattcatggctcattggatggagcgtgctgccacaggaacacacaaccttccctgtaaagaaatttaccggagggcaatgaccaaaggtgtttcataccaataacctgctggttggctgagaaacttcctggtaggtatgggctaaccaggttatctgtagaagctgtccaccaggtggcatagaaacttatcagagggtataaataggcttacacagaaattcaccagagggtgtatgtaggctgtggctggttcaggagggctgctgaggtgaatgctactgatcctccggcatactcatctgctagcccagggaaaaaaagcacaagtatatcaagaagaaaagcttcttctctcctgctgtgacacagtatcacacagtagggcaagaagggtgggtttggcactaagaaataataaactaattaatgcatactgattttctttattgttttctatttcattgattcccgttcctctttattttttgttttctttctactaactattagtttaatgtgttctttttctatctttaaggtagaaacttagttcttgatttttccttttctaatacaatattgaaagctataatattaagtttcctctaagcactgctttagctgcattctgtaaattttgatatacagtcctcccttggtatctgcaggaaattggttccaggaccccctgtggataccaaaattcacaaatgctcaagtcccttatgtagaatggtgtagcattaggatataacctgggtgtatctatatatatatattttgtgtgtttttgtttctttttttttagacagagtcacactctgttgcgcaggctagagcacagtagtgcaatctcagctcactgcaacctccgcctcctgggttcaagtgtttctcctgcctcagcctcctaagtagctgggattacaggtgtgcatcaccactcccagctaatatttgtagttttagtagagacggggtttcaccatgttggtcaggctggtcttgcactcccgaccttgtgatccgccggcctcagcctcccaaagtgctgggattacaggcgtgagccaccacgcccagcctttaaagactttattttctcaattctctaacgggttcaaacaaaataagaggaaaaaagacctctataattttgtgtcacattcactttcatctccttgttaatatgggaaacaatgatctattgtgagtttttacatcttaaccagagatggaagtccctatctactctttttttttttttgagacaaggtctcactctgttgcccaggctggagtgcagtggcatgaatatagctcactgcagcattaacctcctgggttcaagtgatcatccctcccacctcagcctcctgagtagctaggaccacaggcatgcgccaccatacccagctaatttttaaaaatttttgtagagatgcggtctcagcatgttgtccaggcttatctactcgttagagcaggtttttattttaagcaacacgtagttacctttgaatttcaatacctagatttaacagtaagactgcaaatagcaccaacatattttcatttgagtaagtgaatattcactttgcaattttttttgagcgagggtcttgctctgttgtccaggctggagtagagtggcatgatcttggctcactgcagcctccaactttccaggctaaagtgatcctcctacctcagccactggagtagctgggactacaggtgtatgctaccatgcccagctaatttttaaaattttctgtagagacagagtctcactatgttgcccaggctggtctcaaactcctgggctcaagcacttggcaattttaagcaataagatttgtatctatttttgtgtatcacaattacttgttaatcagaaaggataacatgaacaactaaatgaatataaagttcttggctggacgtggtggctcacgcctgtaatcccagcactttgggaggcaaaggcaggtagaccacttaaggtcaggacttcgagaccaggctggccaacatggtgaaacctcatctctactaaaaatacaaaaattagctgggcatggtggcgcactcctgtagtcccagctactcagtaggctgaggcacgagaatcacttgaacccaggaggtggaggctgcagtgagctgagatcgtgccactgcactctagcctgggtgacaaagtgagacttggtctcaaaaaacaaaaataaaataaaacaaaacaaaagaaagaaatagcactcccaaacaattttaaaaaaaagttcttaagtcataattaatatactgtgaaaataagcaatgtaaaatttgatagtaaaactaaaagttgtaaatcacatatgtcctaggagaaagcatttattttttaaattgacagtaaattaaacagtataattgcataaaaatgtaaagctacctcacaaaataatccaaatacaaagaaggtaaaactctaaaaatttccatccatccatccatcatcctttccttctgtttcataactctagtcttagggtctaaactactatttatatactgaagagtcctaaatttagtccagacttctccctgagcactagacttgaatgccttctcaacatgtacattaacatgcctaaaaggcatcccaaactaaaaatttataaaatgaacttcttattttttccttaaacttgttcctccatagtctgttattccattaaatgggaatccattctgccatgcgtccaggctaaaaacctagagtcatccttgactctcatatatcacatataggcaaaccttacagcctctatttaaaatatatatccaaaaccctaccacttctcaacacctctacagctaccctggtcctggtcatcatcatcttattcctaaataactgccattgcctcctaactgatctttctgcttctgcctctacaacacttccaatcccctgtgtattctccacaaacagccagagaaattcttgtaaatcatgagttaaatcatgtcactcttctactcaaaactctccaatggcatctatttcactccgagtaaaggctgaagctcctaacatgatctataaagccctatgatctggcttccagccacctctccgacgccatttcttcttttcactcactgtgctctagcacactggccttgttgttgttccctaaacaaatcatgcacatgtctacttcaaggcctttgttaagcactgtttcctctgccttccatgctccttccccatgttgcagttagcttagtggaattgttaattctcaaaattctgtcaggtatctggatggttcttttattggtttcactcggatctgctcatgaggctgcaattcgctggcagcttggctggggctggagtgcctaagatagtcaaactcacacatctcagactttggtgttggctgttgtttggtccactctctatatgtggcctcccaaagttagatattctaccccaggctttcttacatgatagaaggagcatcctaagaggggaaaagtagaagctgaaaggtcgcttaaggcctaggatttggaattcacaatgtcttctttgacacttggttaaaaacaagttgtaagggcaagtcagattcaatggggtaaggaaataaactctaccttttgacggaaagagctgcaaaatattgtggatatgatataccacaacccagatgcatggctcactcttcatatgcttgctcaaatgtcaccttatcagtgaggccttctttgattccatataaagtaactttccctcaccttgacatttactatcccacattttactcttctctacagcacatatcaccacctgacattgcatgtttacttatttgtttactatctgtctccttccactacagtgtaagcaccatgaagacagaaattttttgtttcactactgtatctccagtacctcagacacagccttgtatatagcaggcactcaatcagtatctgttgaatacattctatcaagcatgtgtcatgaattaacaaagcaagatccaaagtaacttaaaaaagcataatataaattttactgttgaaaaatggtggctttatatgttcttttattctgtgattttgaacaaaacattttataatgcttcagtgtggccatctatagactttagccatgtgtcactgtttcttagatataatgaggctgggcacagtggctcatgcctgttatcccagcactttgggaggccaaggtggtggagactcctggatcctgaagccaggagtttaagaccagtctggccaattggcgaaaccctttctctgctaaaaatacaaaaattagcaaggtgtggtggtgcatgcctataatctcagctacgtgggtggctgaggcacaagaatggcttgagcctggaaggcaaatgttgcagtgagccaagacagcactactgcactccagcctgggcaacagagcaagactctctctcaaaaaataaaaataaaaatagaaataattaaaaaaagaaatagatataatgagaatgtttttaaaaaatctagatattaattatgcacctagtctctaaaaccaataatttaaactccttattaaaagtttctgcagggcctagaaagagccatcttgttagcctatattaagtcagagtttaacttagaaaagaaactaagtaaaaaacgccagaaaaaatgacaatagtttattagatatatatgtgtttacctaagtgtgtataaaaatgttctgacccattcctgaatctactccttataaacagaataaattgagtgaatgacacagaagaaagatacatactaggggagatatcagtactggagccactgacacaactatcccaattaactaagggtactgttaccaggtctaaactagccttacctccaatgtggaaaaccagattaattacctattaaaaatcctcactacttgctgtactagaaccaaaagacctgagacactaattaagtaactcagctagttaatgacagaagaatcttctccctcagagaaactgtggttgtgatggttagggtgaaggtgggggacaacatgcttttaattgtatatccttttagccttttttttttaaacatatgcacgttgaacctataagcaaaaagtaaaaatcaaaacattaattcaataaaaaggaattaattccctctatggctctagatatggtaaataaatctaaaaggaagtttttataaatggaattttatacagactactatatgtagctaaagaaaaaatcagaataaaataataagtactatatgtatatgtatgtgttcatgtatttgtatattagggcccatgtggaaacccattcctctctgccaaattgataagataggacatcatttaaatacagaagatagtttggcccaataatgtgctattttaggcagaagaaatctcaaaacaaagaacacaaaacacttgctggtttgaaaaatgttgtttcaaaaacaagtaaataagaattttgttattttaaagcaactagggctaggtgctacagcttatgcctgtaatcccagtgctttgggaggttgaaggaggattgcctgaggctagaagattgagactagcctgagcaacatagcaagactaccaaacaaaaaaaaaattagccaagtatggtggtatacagctgcagtcttagctactcgatcctgtagtcctaggatcacttgagcctaggagtttgaggctgcaatgagctacaatggcaccactgcactacagtcagggcaacagagcgaaaccctgtctccccagcaccaaacaaaaaaaaaggcaactccacttaggattcattttatttatatcaaacagatttagagatagggttgaaacaattatcgacacacactcttatattcatgagttgctgatagattattatcattgcttctgatatgctttcttgttagaactctcccaaatacctaggttaaattctaacttgatctattacagttgtgaaccctctttattgaatgtaaattttcacaaacattaaatgtgtctttcatacaagcaaaaaaaaaaaaaaaggctaagtaatgcttatttgattcccagcactggggattgatcttctcattcacataaagagctgttctcttctacattaagaaatacaaatagaaacattgctatttcaaaaatttgatgaatcaaatgattcaagaaaaagcagatatacatttataaagtttaatagtagttgacatggtttgggatctatgtcctcacccaaatctcaagttgaattataatcgccaatgttggaagtggagcctggtgggaggtgattggatcatggtggcagatttccccttggtgctctgatagtgagtgagtgcttgcaagatctgtttttttttttgttttttgttttttttaaagtgtggcacctccccgctccttctctcttcctcctgctctggccatgtgaagttcttacttcccctttcccttccccttccaccatgattgtaagtttcctgaggccttcccagaagccactatgcttcctgtacagcctgcagaactgtgagccaattaaatctcttttctttataaattatacagtctcagatatttctttgcagcaatgtgaaaatggactaatacagtaataaataggaagggatgaatacaaaaagggcaatgaggaaactcagtttctggtctgggcatttccatgagctagttgtatgatcttgggcaactcaattattctctaggcctaattttttcatttggaaaaaagggaagagataagattaggtatcttaaacatttttaaagatttttaagatcctactaagttttttaaaaagcactacagtgctgggcgcagtggctcacacctttaattccagcactttgggaggtcgaggccggtggatcacctaaggtcaggagttcgagaccagcctgaccaacatggtgaaaccctgtctctactaaaagtacaaaattagccaggcatggtggcgtgcgccagtaatcccagctactcaggaagctgaggcagaagaatcacctgaacccaggaggcagaggttgtagtgcgctgagattgcgccattgcactctagcctgggcgacaagagcaagactccatctcaaaaaaagaaaaaaaaaagcactacaaattctgtattattggtaaaatgtccattgttacaatcctttgacccagaaagtcttctaagaattatcccacaaatgtactggcccatgtgagcaaagattcataaatgtggacaagtaagttcactggcatttatactagcaaaaggcctacagagaaaataattaaacgttcagtagaaagctagtttaaaaaattatagccatctacaaaatggaatactatgaagtcatctgaaagaccgaggaaatgatatggaacaacttccaaaagatatggttatgtgaacaaagcatggcagagaatggtgtgtatagtgtgtcattttaacttttaacaaaggggacagtaacacagacacaaacacatggatgtgtgtgtgtgtatacacatatatatatacacacacacacacaaaaatatatatatatacacacacaaaaaattcttgtttatgcaaagaatatttctaattggataaacaagaaactggaattggatacataagaaactggtagtagctgttgcttctgggagggcaacgagcagtttaaggtagaagaaagattgaacttttcattgtaaactattttctcactgtctgatttttaccatgtatagctttttcattaaataaagaaaaaaaacccacaaaatttttacttgaaaatacttatattcgctacattttcaattagtcaaaaaactttatttaccaaatatgtaatattatctgagaaaagattgttttatgcaaatatttttcaaattaccttgaaaagcctgggaaacacatctgctggttgtccacgaatcacaaacagacgggagtttaattttcgtagattggcatcaagatcctcaagacactgaagcaaaaatctagagagaagaaagtattatttaaattattaaaaaatacatatttagaagacataaattattacaaagtcatgttattctaaaagttgaaatgccaacctatcatcttattacctcctattgatatatactttttccaaaaaccatactaatatatattttttaattatagcacaaattacctagtattttaataaaatactgaataaaatcactaattttcattaaataaaagtgactattagcaaaaatttaatttgtgaacataaaaacatacaaagaagtatcaaagcaattaaattggtttcattgtttaaacttgatgaaatattttctgtatgaaaatggcttttcatatagaaaggaaaacttgaaaaatctagaatatcttctgctggggggaaaaaaccagaaacatcctatgtaatgaataagcaagtgaataatttaagaatatcatggtaaaaaggaatctgaggggacaaaaaaaaaagattatgagtacttttttgtaatattgtaatcatttaagagattgaaatcataatgcccattttcaagtttctaatttattaaaaaaagaaactaataagtagatgccaaattatgtggttattaattccctgagtgtagaaaatgccagattaacttctaaaaaaaaaaaaaaagaaaaggtttcatggagttggggtggagattatagactttttcaatgaaataagtagtaacaaggcttacacatgacagatatctaggaaaattctggggcagtaccagaagactgcttactgtgcatcttctgttgcgaagaaatggaacattcccaagaacaaatttaaaagagatgtcacccatggaaggtccaatcttattatttgactcatgttaagtttcatttagattctgttcttttcagctggacgtatcttatttcctattttgcttcttttatgtttttgatctcaaggttaagtatttgtctgcctttttcacaggccacatggtctttcagaatagcaattatctcttacttgtgaagaggagtgattaagaagcagggaaatgcaaattctagaagtgcactatctaatatggtaaccaaaaggcacatgtagccatttaaatttaagttagttaaatttaaaaatcagttccttagtcacacttgccacatttcaagtcctcaacagccacatgtatagctggtggctggctaccatactgaacagtatagctacagaacatttccatcattgcagaaagttctactggacagattgttctaaaaagctgcttggtctagatcattttgttcgctttacacattccgataccatcatttcaccaaataagtcttgttgattttttacaactgtagttattagtgacataagtgcactagtcaggtctgacacttcttcctctttaggagcaccatctgtacagcttgaagagtcaaggtgctatatttttatgaggatgttaaagacatcccaccatttcaccttaggaagtctcatgggtttccaagtaggaagcaaacctttctatccccacatttatattttatcacatcccttttctgccttggtttggagtcacctccctaacacctgatccccatcctaacccaccactaccaatgtacaaatatttcaggggagaagactgttgttgttagatggatagtgatataaaagcattggagtttaataaaattatctccaactatgaataatttatcatgtctggtgacaaatgtttattgggaagcatctaattttatgtatttgcttggcaagaagagttactagacagaacaaagatcgaagggtttttacacagatcaaaaattaagaagttgaaagaactagcaattttaagttttcttaaattgaaacagtacaaaacttaaatgtcctggagggggtaatctaaggcaataataatcccctaatctctgttgtaccattagtttcaaaatcttccccaccagaagtgagtaagaactgagaacagcaagagttctccatattcaactttttggtcaaaacaattctatgtggtgcaagagttcaatgacagtaagatgggataagaaacaaaccaaaaggacatgattaattcataaaatgaagaattaagtatggattaattaataatctttccctttcttaataggctgaataagcattccgaatgcttttaataaacattctttttttttttttggagacaggattgtgctctgttgctaaggctggaatcatggttcactgcagccttgacttctcccacctaagcctctagagtgactgggaccacaggcatatgccatcatgcccagctaatttttgtagtttttgtagaggtggggtctccccacgttgcccaggctggtctcgaactcctggcctcaagtcatcctcccacctcagcctcccgaagtgctgggattataggcatgaaccatcacaggcctggccttaataaacattatatgaaccaaacaaatgcacagaatgatatggactaaagtaatgtgttacaataggaaaagttttgaaacctaagaattaattttgttttggtacttcatgaaacaaaagactaaaagctgtatttaagtatggtgttcttcttccacagatataacttacatctctcatttcacataaaagctgcacagatttaaaaaatagaaacacttaaaaaataatataggtattttgtaatcaaatattttaagtagaaaagatccaaaaagaaaagcaaaagagaaggctaaagtagaacacactatgatgctattctttgttataaggcttttaaaactatttgcatatattactctgataaaataaaatttacattgcatgcatctacttttgtttatatgtgcacaagaaaataattggaaaaatacttaccaagctattaatcatatctccccgttagggagtgggggtttgagataggggtgagaaacagagaaacaaacacatttttttaacttcataaaaaaagtttaaaattgataattagcatacattccttcaaagtagaagaaaaacgagatacactacatatgtatctggtttaatacatggtgaacgtcttttcaaggcaatggacgtacttctacagcatcaattttcatagtttcatagtacttcattgcacagatgtcctataatttaacaagtctatcaacaaattactatccttaaatcaatcctgaaaagtcctatctagtctcctcatctgtaaaattgggacagtaatcggacctgtctcatagcattgttcgtgagattaaataaattaacatatgcgaagctcttagaatagtgcctgcccatagtaagcacaattatatgttatctattactttttagtgttctccttcctttccacttctgtttttgctacaataattctagttcatattatctcttgcttgtatttactgcaatgccttaaaatagatctgcctactaacaatctctctccattctaattcattttatatgcaattccagatcttcatgaggcacaccttcccatacaaaggttttcaacgactcattccctatacaatacacaacaaatcattttgcttggctactaacctagggttctaggttgatttcctacctcatacccctttctctcacaccaaaccaaacttctctttcagcacacattcaatctcctggaatgtgctccagggcctttccttggcttggaatacctttcccaattcctatccctttaagttcatatcacactaaccttaaatcttccatcttaaagtcacttctacatcttctgaacctctgaggtacattatgtccttcagaggatgaaaaaattttacctcatattatacatattatatatataacatatatataaaatatatatattatatataattacatatatattacatatatatataaaatatatatatatatattacatatatatataaaataaaacctcctcctaatggatttcaaattaagtcagttctccccatctctctctttctgagacacagtcttgttctgtcatccaggctggagtgcagtggcacgatctcagctcactgcagcctccacctcccaggttcaggcaattcttgcgcctcagcctcccaagcagctgggattacaggagtgtgctaccaccctggctaattatttttgtatttttagtagagatagggtttcaccatgttggccaggctggtcttgaactcctgacctcaggtgatccacctgcctcagcctccccaagtgctgggattacaggcatgagccatcaggcctggccctaactacagttttcttaatctatattttggtttctatatttggcaaacaaatctcattatgtgccttgtataatttgttgaaaagattagaaacaggatcaaatgacctagtaggggtgtcttgtgtaactgttgaaaggattaggagcctcataaaatcacctagtagagtctctagcacatggtagatatgtatcaaacagaagttgttattttcccttgagaataattcctgtttttttttttttttttttttaaagaaaacaccccatgcatttctatatgtaaatacttgggcatgacaaaagaaaacgtgaattagttggatgcctacacctgtatacagaattactttgaattcacaacttcatctgaatgtgactttgaactatgatttgaaggaaacctttcccagtagcaaggtcaatgtgactataaatattataaaacaaggtacaacgcaattaagactcaactaatctctaagcatataatttttccttgataatacctctaacagcccaggttcaaagtatcaactcagtgatgtgtgtgatttctctttaatgctgaacgaataatgttacttcaaaactatacaaaatctaatgctcaatcctttacccttaactgggaaaggattagatctgttagagttcagattcagtgtgttccaaagaacacaccaagttcaactttaatgtaatagaaatgcatgtgctctgggacactcaatattgaatgaaatgaatgatttatttttaatatattccactgaaaatacatatgatatcatcttaacaggaacatactttcagaccttctccaatttggcatatatattattttcttgaactacacccatttgatggctccgttattactgctattaactacatacaacaggttgctttttaaataggccaaatgatagtaaaactcactatatcccttcatataattgtactgcctacatagaagcacagtcctcatattatttaattacaatactgaacacaccactttaaattgaagaggcattaggtgacaaaatatatatttcttcactttaaacattttaaggatttttttcctccagagatcactatctattgctgttattttaaaaattatatgcagtaagcttccttataccacttccaaaagatgacttcaacatgaatcaacagaaatattttcctaaagtaggtcattgctatagcaaccagtggacggtttagtatactccgtcacaatgacctacttaccagtctgtgctagaacagctttatataactagaatttctagttctgtctatgaaatagtccaaaaaaggcaatggtaagatacaacataatcctattgctgctgaacacaaggcattaagaacatgtaccatgccagaataaagccatgtggttctgtatgctagtttgtaaaatatatcttacacactcagcaataaaaactacacttacaatatctaaacaggaacaactcattgctgaccccaaagaactgattcaaagaatataaactaaaatcactaaaactacaaggagaataaccttattatccacataaaacaagagttaaatgtagaaaaaactaaagttctgtatacaccatcataaagaaaaaaaatggagattctcagtcattaaccaaagtctattatattttattagagatttaaaaaatataacaatttgtgtgtgtgtaaatttaataaaatttacatatgctcttttttctggtttgttacaaatttttagtgctttcatctaacttaattttacctaaattgtctggatatttgtgatacacactttccctgaagataagagtttaatgttcaataaagatgaaatatatattttaaaagcaaactttgcatttgccacactctaaaagccataaaccagtagacctatatcactttttataactaatattttgcaatgccctcttttaaatcctgaaataaaagacctagataatataacatttccatacacacaattttaaagcattaatatcatgctctaattgaaacatataggagaaattaaaggaaagtcattaatattttaaaaagaagtaacatgtacttctagaggtaaatatgtgggcatgatataaggagacaatgaattaaaactcagtgtccacacctacatacagaatcatttaaaatttaacagctacaaaacagactaacacagttgtgttactggcgactcaaacatcatacaccatgagtgatattgcctttggtgatgtgattttctgaaatattgaccaagacaggaaagttcagaaaaaaaagcaaagtacaatctttcctttatttatataggtgataaatacattccagggaaactcagtgtatattaaaattgtgtaaaaaatacctactgtttatacataaagatttaggctctaggttcagacaattatgaataagtttttcacttacattaaacatctggaagaacatttgaaatttatgtgtaactcagaaaaactattttatttacttatttactttagagacagggtctcgttatgttgcccaggctggcctcaaattcctggactcaagtgatcctcccatctcggttcctgaatagtcaggactacgtgcatgcacactatggcacctagagacaactatttattttgagggattactctgagtactgaaagaaatcttccattcttggcttctccttactaattccactagcaccttccaatcattgtgacaactggccggacacaggggctcatgcctgtaatcctagcacttttgggaagccaaggtgggtggatcacttgagcgcaggagtttgagaccagcctgagcaacatagggagatctcatctctacaaaaagtacaaaaaaactagctgggcgtggtggcgtatgcctgtagtcctaactacttggggtgggctgaggcaggaggatcaattgagcctgggaggttgaggctgcactgagctggctgtaatcatgccactgcacactgtactccagcctgggcgacagagtgaggtcttgcctcaaaaaaaaaaaaaaaaaaaatcaatcattatgacaactgaaaattcctctacaaaatttctaaaatgtgtttgaaggagtgatactgttaattacttctataatttcaatcactgatttatgagtcatacaaagataaatgaggttccaatactcacagagcttaaaacctaaaaaagtaacctgaatatgtatattatgtaaataaatactacagaactggctatggtagaataaaacatataaaatacaaatagatatcactaatatgctctgaaaaatcaggtgggagaaatcatttctggatttttctttccttgttttgatatggggagcggcttaggcaaaaatttcaaggatgtggtggtgatggtaggtagtgaccctgaagtatcaatacaatagctggagataaggaaggagaattattggccactggactgtagcctgcaactaggccttgttcaccacttcccactgtccaattcctgacatatagcaggagttcaataaatatctatctaatgactaaataaattaatgaaagcagaagaaagggattttaaaggcttgattcaacagtcaatgaagaaggaacaagaatgggaaagaatattctctgaatgtctattgtgctggatactttacatatattatattcccaacaattttacaaggtatctcattttaaaaatgatggaatctgaaactcaccaaggacatttccatacccaggtaaacaatgaagcagaaaatttaatctggatgtctctgactccaaaccatagtgctctttgtactacataatgtgacttttctacagaatatgtaataatctaagatgttttaggaaaattaatttgacagctttaagaacataacaatgactagtatacagtttttgtcctcaagctgaggaataggcgtgtgtatcaattaagaagaatttaggatataccatggtaacaaatcagtcaaaacaggtcacatggccaagttagtcttcaaaaaggcaggaaagcataatcttcttgcaggaagggacactaaataacagtgtacagtaatgatatctaccacaatatctaagcactgatattatgtgccatgtggtaaattttattatgaaaagtgtattatggtagcccagaagaaacctaactgtgtgggggtggggaagggggcaggggaaggcacaaggaagaaaagatttgagtagagtttagaattaataggtgttgcttaaggtgataaagcagaaatgggcaaccaaagcagaaaaaatagtatgtatgcttaaatcacagaaactcagaagagctgggggttgggggtacctggggactgtaagtattatgctttctatactaagttgtatattctccccaacacaagctttaacatttcaaaatatattcaaatcaatgtcaaaacaaacctgttatcaacttctgttgttgacagtacaccggattaagataccctaacagaaataactaacaaactgagaaacaacaacaacaacagaaaagttcttaaaataattcaccgggttgtccaaaaagcaagaaggcataacaggtcacagggagctaaagtcagctttagccctggggatttctgcagagccctgagaactctgagcttcatctgggttgaagaggacaggagataaagcccaagacccacccaaagtaaggaagctaataatagattcaatataaagcctgggcttccaaaagctttagtaaataagacataaatcttttttttttttttttgcttattatacccagactgctctgaaagatacaaatcttaagtcacagatgaagactacaaagaaacttatctgtctctagccagtttgggatgaaagaaaataaaatctctccttgaatggaaaggaaaaaatagtaactttacagcagtgaatactgacaagtactaccttaaccacacaatcagagtcaacaacaccagtgataggtcaatcatgttgatattatgttcactctgacttaatgtgatgagaaaaccatttcacctctgtgatattgtcccccaaacccccataaccctagtttaattatcaaaaaaaatcagagaaactcaaattgagggccgttctacaaaacatttgaccagtactcaaaaccacagaggtcattaaaaatagagaaagcctaagaaactgttacagaggagacaaaggagacgtatgactagatgcagtgtggtattctagatgggattgtggaaaagaaaaacttagtggaaatctgaataaagtctggagtttagttagtactatggtttctttttcttttcttttctttttcttttgagagggagtttcgctcttgtcgcccaggatagagtgcagtggcatgatcttggctcactgcaacctccacctcccgggttcaagcgattctcctgcctcagcttcccaagtagttgggactacaggcatgcgccaccacgcccggctaattttgtatttttagtagagacggggtttcgccacgttggccaggctggtctggaactcctgacctcaggtgatccacctgcctcggcctcccaaagtgctgggattacaggcatgagccaccacgcccggccagtactatggtttcttagttttaataaaagcaccatggaaatggaaatgttaatattacaggaaacaggatacagagcatacaggaactctgtgtattatctctgcatattttctacaaatctaaaattattcaaaaaaattttattaaaaaaatcctccgagaatgaatcacctcaacgcaaattcatggaaactatgtggtcccaaacacctcaagcatgacaatgcgtttaaagtggtcacaggcttggtgtgctctgagataactgttacagacacacacacacacacacacgtcacaaatcctctctgtattctcaactttaaaactcagacttcaggccaggcacggtggctcacgcctataatctcagagcccacgagttctagaccagcctgggcaacatggagaaaccctgattaaattagttgggcatgatggcatgcacctgtaatctcaactactcgggaagcaaaggtgggaggatcgctcaagcccaagaagtcaaggctacagtgagctgtgatcacttccctgcactctagcctgcatgacagagcaagatcaattttaaattggtatcatttatatgttttgaaattagaaaatacttgaagacttgaaattaagaaaaacagcagaataaatccttaaaaactaaaaagaagaaaatgataaagaacagaaattagtgaaaacagaacacaaattcgtgagaaacagcaaagccaaaatgtattatatgaagagacaataatataaatgtccgacaagaataattaagaaaaaaaatgggagagggaagagtaagaaatgttaagaattttttaaaaagtggggacataatcttagatactgcagggattaaacggaaaataaataattttatgcaaacaaatttgaaaacttagatgaaataaattccttgctaaaactgactcaagaaacttaaaacttaccaaaatggactcaagagtaaagaaagaacaggaataattctaagtcactaaataaattgaatccatagcttaaaatcttacaagaaaaacacaagagtcagttagctttacagatgaattctacaaaatatttaaggaatagataattctatttttacaaaggattccaatctcataaaaaggatagacagaaaaggaatatttaacttattttataaggttagatttaccttgacaccaaaaccagacaaagacagtataaaagaaaattataaactaatttcactcatgagcatattatcacagcaaaccaaatcctgcaatatacaaaacatattatatatcatgatcaagttgggcttatcctcagaaagttaaatcatttaatatttacaaattggttactgtaattcacctcattcatagaataaagaagaaaaactatataaccaattgacgagatgtataaagagtagcaacaaaatctcaattccctttagcttcaataaactagaactagtaggtaacatccctaatctgaaaaagggtacccgtaaaaatacttagggaaaacagcatatgtaatagtgaaatgttgaaagcacttcctttaagatcggaaagaagacaaagatgcctactcccaccgcttctctatgcaatctagtaggcctaactaatgtagtgcaggttgagcatcccaaatctgaaatgcttcaaaatccaacacattttgagtgctgacactgtcacaggcatttgaaccagagtgactccatcttaaatagggccttggtaaaataaggctgagacctgctgagcagtacttccaggaagttaggcgttcttagtcacagggtgagacaggaggtcggcaggactggtatcacaagatacaggtcataaagaccctgctgataaaacagaatgcagtaaagaaggtagccaaaacccaccaaaccaagatggagacgaaagtgacctctggtcatcctcactccacattatacactaattataatgcattagcaagttaagacacccccactaatgccatgacagtttacaaatgccaagacaacatccagatgttaccctatatggtctaaaaagaggagaaatcttcacttctgacaactccccaccacttttccggaaaactcatgaataagccaccccttgtttagcatatactcttgactgagtatactcagtcaagaaacccatgatgctgctctgtctatggactggccattttttgtttctctacttgtctaataaattcgctttcattttactctgtggacttgctccaaattctttcttaagtgagttccaagaaccctctcttaagggctgaatcagaagcccatgtctggtaacatgacattcaaaggaaatgctccaatgaattcggttgctcaactagtaatgtcaatattcagaaatatggggaagaatctgaaatctaaaacacttctggtcccaggctttatggacaaaggatactcaacctgtaacggaagaggaagaaataaaaggcataaggatgggaaaggaagaagcaaaaccatgattatttatagatgataggcaaataagtactatcgatacagaaaaaaataaatacataaataagcgtttcaaaggattaaaatcacttaatttctggcatcaattagactaatataatccttgtaacttatgcctctctgatctcaaaaatcacacagagctatttatagtccagaaattgtattagttcttatctaactttagaaatcactgcattgtgactctaccaggttaggccaaataaagtataagatatacttctaggatttaaaggatctacatacaactaaaataacatctgcctaacgtgttcaaaaacatgctgtcccagatctatgaataatgcttttctgtagtctaacagccctatttcaaatttctgtccttcaaaaagatattaataatgctgaaaaattattccactttttttgatctatgacttagcacatgtaactattcaggtctgtttgaagtttggccaatggtcaagatttttctcgtactgacattactgcaaaaatttagtcacttatgcaatctatccagtaatgtatctattaacaatttattgagagcctattaagtgtcagacattgttgtggtccctggtaataaagcagagaacaaaattaagtgcctgctatcatgaggtttggatgttagatgataattatgatgataatgatgattacagctgcaaacatttagaaagtgtgtataagacactgctctaagcactttaaatgtttatactcaataaccctttgatataggtacttcctccatttcaaatgaggaaactgaaacatatactggttaagtaattttcccaaggacacttgaataataaagtggcaaagccatgatttcaaacccagtcagcttggctccaaattccaagctccttgaaccatacagtatttcagtgctgataatttttatggagaaaactaaaatagagtagaaggatatcggggggtataattttatgcaaagcagtcatagaaggatttattcatatccttccatttattaaacatctccctttgaagattgcctcagaccatctcctcccacagtcttccaatctcatttaattccatccttcaagttaatcagggcaaagactcacctggttggtcagaatagaacagggttatgctgcagtaacaaacaacctcccaaatcagtggcttgacaaaacaaaagttttcatcttgctcatgctgagttcactgcagctccagctagttatcttctaatggtgactttaccgtcccagctattatgaccttgtggttctataatttcaacacaaggcctcctccacagtaggggaagaactgggaaacatacagggctttacattgccttcaccaagtacttcctcacacaattcattggccagaaagagtcacacggcctcgccagactgcaaagagagctgagaattgaaatgttgcatagcccaggtacgaatggtgaattggatattggtgaacactaccacatcatccttgacctctctttctttcatagtccacatctaaaactatggcaaatcttaacagctctatgttcaaaatacatccagaatctgattacttctgactgcctttacctctacagctcaggttcaattcttcatcatttctgacctagatgattccactggccttctatctgatctcactgcttccatacttgtccttactgccatccagtccagtcttcacccagatgccaagtggtcatgtcatctctatgaacaaagtctccaactgcaatgacttcccagtccatttaaagttggtggtttttttttttttttaagtccttaaaatggctttctaggtcctacagaacgaacccgggcaaccaataccactatgactccatctttcttactactctccttctcactcactctgttccagccacatgtcctccttgggatcctgtgagcatgccagaaatgctcctacttcagtacctttgcacaggatgttctttccatccagaatacatttccctcatacatccacagggttcaattcctctctttctttaggtcattgctcaaaggtcatctctgaagtgaggctctctctgaccatcttatctaaaatagacctctccccacctctggcccctagcattcctgagcccccttccttgctatctctttaacatactatataatttatttatgtgttaatgacctgtatctcacccccactcagatgtaaattccatgaaagtaaggtttttgcctcttttattcactacattcaataaatatatatagtttcaatgaatgaagatgacatgtgagcagaaagacacctaagggggtaaatgacctatacagataacagagaaaacagaacatcacagagggaataaaggcccagacacatgggacctcatgactgtttgaggaacaaaaaataggccaatatgcttggacatcaaatagtaaggggaaagaataataagaaaatggtaatcccagcactttgggggccaaggcaggtggatcacctgaggtcaggagttcgagaccagcctggccaacatggtgaaaccctgtctttactgaaaatacaaaaattagccaggcgtggtggtgcgcgcctataatcccaactactcgggaggcagaggcaggagaatcacttgaaactgggaggtggaggttgcagtgagccaagatcacaccattgcactccagtgtgggcagcaagagtgaaactcaatttcaaaaaaaaaaggaaaatgatgttcaggttctactgggagtcaatcacatgtgtccgtgtaaatcatggtagagacttaagtttttactctgagtgagttgggaactcattgaaagcttttgagcagaggttggaacataatataaatttgttttttagaaattattttatttatttatttatttatttattttagagaaagagtctcactctgttgcccaggctgaagtgcagtggcatgatcatagctcactgcagcctcaaattcctaggcttaaacgatcctcccacctcagcctcccaagtagctgggactacaggcacataccagcacacctggctaactttttaattttttgtagctatggggtctcactatgttgccaaggctggattcgaactcccaatctcaagcaatccttctgctttggcctcccaaagcattaggattacaggtgtgagccaccacagctggccctgaatttgcctttaaaaggatcacttgggctgctgagtagaaaataagtaccaggcaaagaaagggcaggcacaggaaaatcacttagaggttactacttctttacaagagagatgatgatgacatggataaaactggtaatggtgaaaatggtaaaagagtggggatctgaatagaaattcaagagctaatacagcaaaggaaatgagatgactaagtctggagttcatggtagaaggctgaatttgagatataaaactggaaatcatcagcacatttgtagtagtcttaagactagatgaaggaaaagaatggctgacagaaagaagcagcttcactttgaataaacagaaggaatgatagagaaggctgaagagagagcagaaaagaggaaagatggaataaagtctacagaagcagtggcaaaggatagatgtatgtattctcagaaggaaagatggatggattgacttataaaagaaatggaggaaggaaaaacagctaaatgggacagagaagcaaagatagaagacagaagcaagggcatgtgggacagcaaaacgaagactaacggaatataaaagcaagaatggataaagacagatggaaaatcgtaagagggtcaaaaagaaggaaataagaacgatgtcagtgaaatgatagaataggaagtcctggactttcctttcatccacagacacactgattcaacagcaatacacagatcaattccctttgtgagaaacaaactagttgagaagctcctgcacattgggagaatgtgaaactagccacactgaaactagcaggagacaccctctcatcaaaatctccactcttggcacagagccatatgattgagacaaaactctcagctcctaggttttccctgaggaagatacatccaatgttccatccctcccagctgctgcccaagagactagcatctgtatcattcaacacagagtgctgggcgtggtggtgcatgcctgtaatcccagctactcgggaaggctgaggcagaagaatcacttgaacctggaaggcggaagttgcagtgagccgggatcgtgccattgtactccagcctgggcaacaacagcaaaactccacctcaaaaaaaataaaataaataaaataaggccttcatcttacactatacacaagaatcagctcaacatggattaagacttaaatgtaaggtctgaaactgtaacactcctacaagaaaacagaggaaaaagctttgtgacattgggtcttggcaatgctttcatcaatatgactccaaaggaactggcaacaaaagcaaaaatagatgacatcaaactaaaaccttctgcacagcaaaggaaactatcaacagagagaaaagctcacctatagaatggaagaaaatatttgcaaaccatttatctgataaggagtaaatttccaaaatatgtaaggaactcctgcaactcaataacagaaaacaacccgttaaaaaatgggctatgcatttgaacaggcatttttctaaaggaaacaaacaaatggccaacaggtatatgaaatgatgttcacatcacaaatcattagagaaatgcaaatcaaaaccacaatgagatatcaccttatacctattagctattgtcaaaaaaataaaaggcaatgtgttggcaaggatatggagaaactggaaccctaatgtaatgttggtggcgctgcaaaatggtgtgatcagtgtagaaaaaagcatagaggttcctaaaaaatttttgaatagaactaccatatgatttggccactcaactcaaggtttttatccaaaagaactaaactaaggattccaaagcaatattagcactcccaagttcactgcagcactattcaaaatagccacaagatggaatgaatccaaaagaatggattaagaaaatattatacatacatacatatacacacacgtatatgcatacatacacacaaatataaaatacacacacaatggaatattatttggctattaaaaagaagcaatccttcaatatgtgacaacatggatgaaccttgaggacattatgctaagtaaaataagccagtgaaaaaaggacaaatactgcatgattccatttatatgaggtatataaactggtcaaactcatagaagcagagaatacatagaatggtggctatctggtgctacaggaaaggggaaacaggaagttgctaatcgacaggtatacagtgtcagttatgagagatgaatactttctttccttttttttttttttagttttttttttttttttgagacggagtctcgctctgtcacccaggctggaggtgcagtggcacaatctcggctcactgcaacctctgcctcctggttcaagtgatttttctgccccagcctcccgagtagctgggactacaggtgtgcaccaccacacctggctaatttttgtatatttagtagagatggagtttcaccatattggccaggctggtttcaaactcctgacctcatgatccacccacatcggcctcccaaagtgctgagattacaggtgtgagccatgtgcccagccaaaagatgaaaacttcctaaaaatctgttgtagaactttgtgactatagttaataatgtattttacacttaaaaatctttcaacagggtagatctcaattattcctacagcaataaaatatatttttaaaaaaaagaagagggaagagtagataggaacaatcaaaccaaaattttagaatcctaaatctgacgtgatattctgtaacaaaaaaggtcaattactaataagtgagttatgaaccttccatgaatctcaaatatattgcatatacacttgatttcatctttgtaagtgagacatatctcttgactttatggatgctatataaacctttaaaaaaaaaaaaaagagatgggatcttgctatgctgcccaggctggtcttgaactctcagtctcaagtgatcttcctgcctcaacctcccaagtgctgtgattacaggcatgagccactgcatctgccctatggatgctatacaactaaatgacagaacctgttctacacttacagagagaaatatgagaggtgaagctaagaattaattagataacatgtagaaccgcctattgaggtacattctttcatttatacagccaacatttgggcgtttactcaggatacaaaaaaaaaaaattctactccttagaatctccaccatttaatgagattaaaatacacaaatttattgttatattaatgaatgcattgtatcattgatgtccccaatgttaaagcacataaaaaaggaaagcaattatactagggaagatctctaaggttttataacagaaagatggtaactaatctgggtctttttatatctatcatggcactttgtgacagcagcttaagttgatctttacttgaagtattttttaacttctgaggttgacttaacactagcataaggctatgtaatttatgccttcctaatctctaaatcacataacagtatttgaaatataggacttttactattccatgtgtatttttagaagctgctgcaacataacactacaggccaaaaatcatgtataaaatatacttctaggctttacaggattaatatggaactaaatgaagtatgttcaacatgtttacaaaagcaaatggaggagctatatatgctggttttctgatattcctatttttacgctagatgaattcaagtttttcagatgctttcatagtggtaggactatggggtgggggtggggaagagtgccaggaaaagaaaaataaagctgtaaaagttgaatacagcacccagattttggtttttaaatatcgtcccccaataagaataaccaagactcaacagagcagttgctgattccggggctgcggaaaggaaaacagaagatgaactggagcatttcatagtgtcagaaaaaagtgctcaagacaaataggattggtgtatgttaaacaacaggatgggtgccaacactggaacaatttaaatgaaataaacagtaatagcagtacattatgacccaaagagtaaaaaaaatatactcatgagtctgtacttttataaatgaatgactgaataattaaatcaatgagggagaaggaacaactcttcattacagaagaattccaactaataaatataggatgaatgaagggaatagaaaaatcatcattagaatagcacataattcaggcaagatctactgttgaatactaaaattcatggttgaatgtttaaggagacagaatatttacaaagtctgaaagtatctctcccaaaatattaattacagaagaaaaatagtaattttacagctgagaaacctggcagacattaactgaaacacatgatcaaggttagtatcatttgtaacaagacataccgataccacatatcccctgatataaaaaaaaggcacatcacttctgtggcatttttcccccaaaatgcataaccttaatctaactatgagaaaatatcagataaaatcaaattgaggagcagtctacaaaatacttcgccaggtaatgatatactgtatctgagtaagatggccaactggaagcccctagcactcatcgccatcacaaagacagacagaacaacaaataaacaaatgtattttgaagaaaatagctaagggagaacactggggtatatcacaggaacagaaaccctggtgagtacagaaacttaggatggccacacggagaatggaaggaaatgccgggcctccaccacctcatcctccaaatgggatcagctgaaagccaggaggaacttctcatggtgaggagataagcaagaggatcccagcaacctccatcaacaccttgaacatgtagagatcttacctcacaggtacaaagtccagctgacggaattacctggagtccacgtaactgtgctcaccgtagagaaaaagcaaacactaggctccacaccctgcagctacagggctactacgctatgccatcgtagaattggaactatggctggagggtgtcttgctctggcggtgagtagccgtgactctccttcatctctgagactaagatgcaactgaaccaccgccccagccaagtggtccaacatccccaagccaagcttcctttcctgtggggccaagcagagacagagccactttacttacccctccacccttgtgcttgagctgaagtagtatcttgcctcttgcaaaaacagtaccttggccactctgagcagtcatgtctccctgaagtctaagatgaagcagtgccctgcatcccaggaaatggtgacttggccacccagaagaatgatcatgcattacagtacctaagctgaagtggagccctacatcccagggaaatggttcctggtcttcccagaataatcacactctaccaagcttgagctgaagcagcattatcaccctctgggaataggtgccttggctgagccgagcagctgcacatctcagagctgagctgatgtagtaccctgcatcccagggcaaaaaagcagtggctaagctgagatactctgctctacaggccaaacagctctagtatcctgcttctgtggagctggactagctacctagagtgtgagttgctgagatacccatctcccttgatggtggggtcagaactgtgctgttccctgttcctcgcagggtccaatgacagctgtgctctgccattctgggtatttgctgccactacatctggcctcccagagggaggatactgctgagccccactataccacggtctagagttattactacacagttgctcatcctctagaacccaaattgccactgagccctattggctcagattcctaaactgcagctgaattttgctccccaggctcaaacctccaaagtaccccttactccatggagtcaggccagagctgtgttctgcctccttcaggggtagaatcatagctacaactcagcttcctgagaccaggctgctagatggtacctgagtcacagattttggttctatggacaaccggtatccaaccctgccacagaaagcgaacctgtactccaagacccagttgccaaaacagggtcatgagaccctgagattaggacctccatctgccccacagctgctctggacatctgcacctggaacccagagctgctgcagctgcttgtaggttgtgtcagacctgacaataagaggaatccccttggctaagtctcctaattgtggggaaaatgagaatagaagaatcccaaaaagcctatgacaccaagaacattaacaatctatgctgctgcagctgctgccgccacaaagttctacagcctaggctactgaggtgcccacagttattgctgatgttcaatgcagctggagcagctgcatggagactataccactgcacctatctggaaagagagtcaccataccctttccaaatggcacactaaaacccaataacaggtgaaagtctgtctctatgaaagatattttaggaagtttggaagagacaactgttctaccagatgcacagacatcaatgcagggaccaatacagacagactattcaatgaaatcaggaaaacaattcacaatataaacaagaaattcaacaaagagatataaataaaaagaaccaaacaaaaacgctgtagctgaagaattcaataaatgaaatttaaagaaatacattagagagcttcagcagcacactttgatcaaaaagaaagaatctctgaatatgaaggtaagttatttgaaatttgtcattggagaaagaaaaggaaataagaatgaaaaagaacgaagaaagcctacaagacttatgagacaacattaagcaaacaaaactttctattatgggagtttcagaagaagaagggaaaaggtgtagaaaaacctatttaatgaaatcatagcagaaaacttctcaagtctggggagaaatatgcacattcagatccaggaagctcaaaggtccccaaatagattcaatccaaatcattcctcacggcacattacagtcaaattgtcaaaagttaaagacaaagagagaattctaaaaacagcaagagaaaagtgtcaagtcatataaaaggaaatctccattagactaatagcagatttctctgaagaaagctcacaggccaggagaaaatgggatgatctattcaaagtgctaagagaaaaaaaaaatgccaccaaaaataccatactcagcaaagatatccttcagaaacaagggagaaataaaatctttcccagacaagcaaaactgaggaaatttatcaccactagataaggcttacaagaaattctcaagggcagccgggtgcagtggctcatgctcgtaatcccagcactttgggaggctgaagtgggtggatcatgaggtcaagagatagagacaagcatggccaacgtggcgaaaccctgtctctactaaaaatacaaaaatttgtcagttttggcttctgttgccattgcttttggtattttatacatgaagtccttgcccatgcctatgtcccgaatggtattgcctaggttttcttctagggtttttatggttttaggtctaacatttaagtctttaatccatcttgaattaatttttgtataaggtgtaaggaagggatccagtttcagccttctacctatggctagccagttgtcccagctcactcatagtgggggaactgaacaatgagaacacttggacacaggaagggggacatcacacaccggggcctgttgtggggtgcggggagcgggggagggatagcattaggagatatacctaatgtaaatgataagttaatgggtgcagcacaccaacatggcacatgtatacatatgtaacaaacctgcatgttgtccacatgtaccctagaacttaaagtataattacaaaaaaatacaaaaattagctaggtgtggtggccagcacctgtagtcccagctattcaggaggctggggcaggagaattgcttgaacctaggaggcggaggttgcagtgagccgagattgcaccactgcactccagcctggcgacagagcaagactctgtcttaaaaaaaaaaaaaaaaaattagttgggcatggtggcacacacctgtcatcccagctactcgggaggctgaggcacaagaatcacttgaacccaggaagtggaggttccagtgagccaagatcatgtgactgcactccaggctgggtgacagagtgagactttgcctcaaaaaaaaaaaatgctcaaaggcatcctacatctaaaaacacaaagacaataatcactatcacgtaaatatgcacaagtataaaactcactggtagaacagataacacaaattagaaaaagaataaaaacttacaactacagaaaaccaccaaaccacaatgataaacaataagagagaaagaaagaaacaaagaatacacaaaacaactaacaaagtgacaggaataagacctcaccaatcagtaataaccttgaataataaattgattaaattccccactaaaaagctacagagtagccaaatggattttaaaaacaaaatgatccaattgtattctgccaacaagaaacttaattcacctgtaagaaacatacagaatgaaagtgaagggatgaataaagatattccacacaaacaaaaaccaaaagcaaaaaggaatagcaatatttacactagacaaagcagaatttaagtcaaaaactaaaaagaaacaaaagctcataatataatgataaaaggatcaattcaacaagaggatataacaactgttaatataatgtatccaacactggagcacccagatataaagcaaatattattcaatctaaaaggatagattccattacaataatagggacttaatcatccaactctcagcattgagaagatcatctaggcagaagaaaatcaacaaagaaacactggacttaaactgcactcaagaccaaatggacccaacagacatttagaacacttcgttccacagttgtagaatacacattcttttcattggcatatgaaacgttcttgtggacagaccacacgttaggtcacaaaacaagacacaacaaatttaagataactgaaatcatatcaagtatcttttctgaccacaatggaataaaattataaatcactacaagaacttttgaagttatacaaatatagggaaatcaaagaacccacttctgaatgaccagtggatcaatgaagaaattaagaaaaagatttaaacatttaaatcatttcatttgaaacaaatgaaaattaaaaaccaacataccaaaacctatggactacaacaaaaacagtattaagaagcttatagcaataaacactgatatggtttggctctgtgtccacacccaaatctcatcttgaattgtagttcccataatcccaaagtgtcatgggaggaactaggtggaaggtaattgaatcatggaggcagttcccaccatgctgttctccttatagtgaatttgttctcacaagatctgatgattttataagaagcttccccctttgcttggcactcattttccttcctgctgccacgtgaagaaggatgagtttgcttccccttctgccatgattgtaaggtttcttaaggcctccccagccctgcagaactgtgagtcaattaaacctcttttctttataaattacccagtctcaggtatttcttcacagcggtataagaacagactaatacaaacacctatgtcagaaaagtaggaagatttcaaataaacaatctaacaatgcattacaaggaaccagacaagcaaaaacaaagcaaacccaaaattcatagagaaaaaaaccaatcaaggttggtgcaaaataaacaaaattgagactaaaaaaaattacaaaagatcaacaaaatgaaaatttttaaagacaaaattgacaaaccaataggtagactaatatagaaaacaagtactattataaaataactgttcaaagcaattatattattttttgaatgctagtatccattcagatttttttttttgagatggactcttgctctgtcgcccaggctggagtgcaatggcattatctccatttactgcaacctccgccccctgggttcaagcaattctcctgcctcagacttctgagtagctgggattacaggcacctgccaccacacctggctaactttttgtatttttagtagagacagggtttcactacgttggccaggctggtctcgaactctggacctcatgatccacccacctcggcctcccaaagtgctgggattacaggcgtgcgctactgtgcccagccattcattcagatttatccacatacttatggtttctattgctctttatatctttctgtatctctgtatttctatatagaatcattttccttttgcctggcaaaacccctctagatttccttcatatttgatctgcagattctgtttatctgtcctctccttttgggatttcaatacaaacatttcagattcctttaccaaataccgtatgtctctcatgctattttctgtattttccatcctattattttgtgtttgaatctggctatttcttctgaactatcagtttatcaattctctcctcagctatatctaatcttctgataaacctatccactgacttgttaacttcagctatcgtatttttcatttctaatattttcatttgagtatttaaagctctctgtcaaaattccctattgtattcaatttttgaaaatattaatcacagctgtttttaaatccataattgataagtctaatgtggatttcctatgagtctaattgtctggtttttttcctcctggtttcagtcattttttgtctttcaaaatgcctggttattttttaccgtgttccagacattatatttaaaaagctatagatatcctcctttagagaaccttaacatttacttgtggcacacttctaaaatatgatctaacaccattaatcacttaagtattaagctgatttccctatggactttagtgcttgtataggatattttactcactctattcctaggatattgcctttcaggggtttcaaccaaaagctgaaatagtccagggctcctcttccttgttagtctctgaactccatttttttccctttcagcccaacacaactgctaaaaattctgctcagtctctcagtcaccattgtaattttcagaattgacttttgcattaaggaaaaaacagcatcaaatgtcaagttcgattatcttggttttccttttcttccagatcttagccccacaaattcttactatcttttttttgtttgttttgggatggggtctcattctgttggccaggccagagtgcagtagtgcgatcttggctcactgcagcctccgcctcctggggtcaagtgattctcctgactcagcctcctgagtagctgggactacaggcacgtgccaccaaacctgactaatttttgtatttttttaagtagagttggggtttcaccatgttggccagcctggtctcaaactcctgacctcaagtgatctccctacttcggcctcccaaagtgctggaattacaggtgtgagccatcgtgtccagacaaattcttattatctgtgtaactctctgatggcttcaaagagatttttaaaaaatattttctcagctttcctatgtatttttagtatacatacctggtgtttggtctaggacaaccaaatcagccacttccagaagtagaaatgcccagtttaacatgtatttagtttgaagtgcctatgagacatccaagaggacttgttaattataaaatgatgtacataattctggaatttaagctagacatctgcaatagtagacataaatttgggacttactgtagaaatggccctaattgctataaaactagatatacaagtggaagaacagttggaaggaagaaaaactaaggcattcaaggaagtaaggagataaagaaaatggagtggttacaaaagacaaagtgggggagacacaaggggaaagtaaaagcaagagagcatctttccataagaaaataggaataatggaaagagaagaagaaaaagctagaaaaaatggaaaggtagagagaaaaacaatgaggagggctgggaagaaagatggcaaggggagggaagtttggaagaaggaaggtaggataggcaggtagcaccaaaaaaggaagggagagacagaataagtgatatgatttggacattgtgtcccctacaaagctcatgttgaaatgtgacctccagtattggaggtgggcctaggggggagccatttgggtcactggggcagatacctcatcaatgggttggtgctatcgtcatgatgcgtgagttttcactctattagttcatgtaagatttggttgtttaaaagaccctggcacctcctcccctctctcttgctccctctcttgtcatgtgattctcctgcttccctttcaccttctgccacaattgtaagtttcctgaggccctcaacagaagcaagtgttagcagcagcttccagtatagcctacagaagtgtgtgccaaaatatctcttttctttataaattacctagtctgagatgttccctcatagcagcacaaacagaaataacacaaaaaggaagaaaggctgacagaaaggacagacctttgtaagatggatctttgtaaagatgacagagacagactaaccagccttggaaggacagactaaccagtcttagaaaggacaaatgggtgtttggatgtcaattatgaaagaaggagggggcagcatgaaagaaaggaagagtggaatggatgagaaagagcaggacagaaagattcagacactttgataaggagacttaacaggaagtgagtatgagagctctagaaaaaagaaaataatgaaagaacaacaaaataaatccaattaagatagccactaaatatgatgtggttttcaaaagaaaggtggagaaacagtttaaaaatttcaaacaagagggttatgaacctgtcatggactgaaaacaaatttcaattacatgcgtttacacatttgaaaataaaaatgttccctaaccatatagctgttatgtaattatatgaaaaacatgtgttatgtagagaaaaaacaaacaaacaaacagaaacaacagaactattcttaactaatcctgtgagtcacattatcttatttaggtaaaaagttacatttaggcctgtattaatttttaaatattcttatagtcctactgcttttatgtcctttttatggtaaaatattagtgaccaataaaatgcagaaaattgtatctgaagcactttcattcactcattctttcaatcaacatttgggtattttcttgagttaaaaaaaatcaataaagctttaaaaatagataaataagaagatacagaattcccatccttgaagcctcccaaatttaatgagaataagatatggatattacctatcaaactgcattattaaagttcatggcacagaggagtcaatctgtcaaggaaggtccataaagtttcacgaagataatctttgatatgggccttttaactatcatagcatttcactttgtgacagcagcataaaatgatctgtaatagaagtatatataccttctagagttgaattacactagcacaagtctatataacttatgccaccatgatttcaaaaaccacatagaggtaattgtaatctaaggctcctactaatttttatctatttttaaagaacactatattgtgactccaaaggggagggaaaatcagcagaacatctacttggggactttaggagacttatataaaattaaataaaatctgttaagcatttgtaaaaggcaaattagaactatatataatgattttctgtagtctaaaagaaatttcccttctcaaaaaaattattcaaaaatgctgaaaattattctgatttttctgacctatgatataaattgtaaacaactatcccaagtttgcacgaggtttttctaacggttacttggtaaggatgatttttaaagagaaagacaagaaaaagaaaatcaagaaggtcataaaagaacctagaattctatacccagtgtaaataaggatggtatcttcagacaaacttgggagagtttaccattagcagccttttactatagagaattctaaaaaatctaacgtaattagatttgagactctcctaaaatgacagtacctctttaccacaagggcagtcccttgaataacactttataatcatttatttattcaacaaatatttattgagaacttatgtactaaagactgtactagatattagaaacacacctgtggttttttaaagtcaaacttcctacaatttgaagctaatattctagaaggagagggagtaaagacagaataatacaaaaacagtaaagcaaactgttcaaatggtaataactgaataacataaagttaaaggggaaactgggacttcagggaataaaggaatggagactggtattttatatgaaacaagtcaagaaaatactcactgataatagaacatctgtgcagaaacctgaaggaaagttggagagcaagcagtgctggtaaggaaacattttgtgcagagggaacagcagatgtacaacacaggtgaagaacatgcatggcactttaaaaagaatactcaaaaaaccagtatggccacagcacagagagtgaaagagtggcaagagattattaggttagaaagttatcaagttccagttcacatgacatcttgtagactatggtaagggctctgccttttactctgagatataagccactagagattgatcctacttgtgattatgaaggatcacaatgagctgaagaggaagaaggagagaaccagagaatctgaagggaaattattcggtagttaatgtggaagcatgagatggtccgaacttggatacattttgaaggcagagcccatataatttaatcaacatgtttaaagtaaaaaaagcaaggaataagaaatggcagatttgaaaaagaaccaaagaaaatctccatatatgaaaaatataataattgaaatccaaacttaacagatacagttaaaaataacatttatagaatagctgataaaaagacatttttaaaaatgaagtacagagaaccaaagagatggaaaatatgaagaaaataaaagagtgcagtaaaaatgtctaacacacgtacaaatgtattttttttttgagacggagtttcactcttgctgcccaggctggagtgcaatggcgcaatctcagctcaccataacctctgcctcccgggttcaagcaattctcctgcctcagcctcctgagtagctgggattacaggcatgtgccaccacacccgacaaattttttgtatttttagtagagagggggtttctccatgttggtcaggctgatctcgaacttccaacctcaggtgatttgcctgcctcggcctcccaaagtgctgggattacaggcataagccacggtggccggctacaaatgtatttccaaaaagagaaaataaagcaaggcaaagcaagatctgaaaaagtaacagctgaaaaactttcaaagctgatgaaagatagcaacagacaggtttcaaggagcactgtaaatccaagagaagtaaatacaaagaaactcagacggagattcatcatcgaaaaacttcagaacatgtcagagaaagagaatatttaaaattagacaaaaagaaacaagatattacccccaaaaaaagtatgagtgggagtggcagctgactataactacatccccaacaggctcagagaaaatcactgtcaacctagaattctatatccagtgtaaacaaggccagtatcttcaaacaaacctaagagagtttaccatcaccagtctttttctatagagaattctaaaagatacatctgagataaaagaaaaatgttccccaatggaagagctgagatgctaggaagaataaagaacattgtaaatagtagatatgtgggtaaatgaatactggccttataaaacaagaataatatattttggtttttaaaaacaaaaacagagaaatgaccagaattagaatatataaatcagaagaaaggtaattagagtttgcgtttcaagggccttgaattatctaataaatagacaaaattattgattaactttagacattaaccaatgtgcttctggtaatttctagagtaaacactaaaagaatagctaaaataatgtgtaattattttattaattaataaatttattaagtctgataaattaataaatctagttattagaaagaaattaatgaaatttaaaacaacagaatttaaaagaatattaaaaaatagaacaggaaggacaaaaagaaaacacaaaataatatgacaataaatccaaatactttggtaattataacaaatgtaaacagactaacgaaaggcttcaattaattaaaaactatcagactaaataaacaaaagttaatatatgctatttacaagagacatctaaaagactccagaaagtttgaaaaaaaaaaaaagggatacaaaaaagttgactataaacataccaaagaaagctgccatagctatattaattataaacataatgaactgtaaagaaatatactataaagtcacgttcataatgactttaaccaggttaataatcatctaaatatatacatattttacacatttctccacacctcgtaatgataagaacaaaagccttcacttcaccaggagaacatatatttaattttagcatttcaaattgtataaagtaaaaatgacagagcttcaaataaagacagatctatgattaaactgtggggattttaacattcttctgataataattgagataagcagaccaaaaatgagtacagaagatttggacaacttattaacaaccttgacctaatggaaaaacaaagaatatcccgtctaataacaatgaagacagcagtatacacatggaacatttttaaaaattcagcatatattggaccatttaaaaaaaagtctatataaatttcaaagaactgaaattatttacagcatagtctctgaccttgacgtatttatgctaaaaattaatactgaaaagacaattagaaaactttgcatgtttggaatataataaatattataagtaacaaaggatataattctaaataattcacagaccaaagaaaaaaatcataacaaaatttagaaaatattttgaactgaataatgaaaataccacattaaagagaatgtggaataaaactacagtagcaattagagggatatttacacacctaaataattgtatcagataaaaaggaaaggctaaaaatagcctaagaattcagcctattaaattgaataggctaaatagggtattcaataggctaactccatttcaataagttagcgtaaaaaaaagcagaacaaagaaataaaattaacacattctgaaataaaaaacaaacctaccatagtgaaggcaaataaagttggttgtctgaaaagacaataaaactaaccaacctctgatgaaatgtatcaggacaaaaggtaggagacacaaataagcaatatcaaaaatgaaaaggtttgggtgtaattgctcacacctgtaatcccagcactttgggagactgaggcaggagaatggcttgagtgtaggagacagagcaagaccctgtctcaaaaaaaaaaagaatgaaagaaaagggcaaaataaccatagatactacatatatttatatcaaacaagaataaagctaaatgggtttcaatttcaagtaacagcttaggttatttagatcaatctaattggtctaaacaaacaaaaatactggttaagatatataaaatatctccctaaagagttggcaagacaataaggaattcccaaaccaaaagctaagtcgaacatataattagtttttgccctaagaacatttgctaataatcccagagaaccttaatagtggttttgacagcctcacggtacaaggacagaaattaaagcctagaaccagctcaagacagagagtctaagatactccaaaacattaagccaagatgccaaaaggctagacatcgttagggaagacgtgaaccagaaacaaaatcctcctccacaccttttgtgaggttgccttggcactcagcagaaaaagatggaaaatataaataaaaagtaaagaatttataggctgtaagcactggccagcccttaggtggattttcatcagaggggcacaagaaatctcaaacaataaatttaaagtgccctgcagtggtaatgactctaatgccattaagaagtaagttcaaattctagagcaagcttgcccaacctgtggcctgcgggctgcatgtggcccaggtcagctttgaatgtggcccaacacaattttgtaaactttctcaaaacattatgagatttaagcacagacttttttttttttaagctcatcagctatcattaatgttagtatattttatgtgtagcctatgacaattcttccaatgtggcccagggaagccaaaagattgttctagaggaagacaaccttataaaaggcctcaggaagttcccacaaataatctttcaaaaaatgagaaaaatcttcaaagcagctagaggataggagtagatgacaaattacattcaaaggagaaacagtttccaacagcaataaaggtaaccagaagacaacagaatattttcaataaactggtaacaaacccagaaacctaaaattctatattcatgaagatatctttcaagaattaagacaaacatatagacattttgataaaagataaaagagtttgtctccaaaagatgtcactaaaaaaaattctaaatgatatattttaggcagaagtaaagtgattacagatgattgtctagtatgtaagaaatatgtaaagctatcatgtaacaataaaaaaaagaaaaaattaagagaaaatgaagtcactgcattagatgcctcctaagtacttacaatacagaagagcaaatagttacataagcaccataatatactgcagtaagtattgtacaatacttagtcatacttttgttaacaagattgaaaaatctacactgactaaacaatgaaaatggtataaagaaagcccaataaatgccaagtagaaagatttatggagtgcctgtcacttaataggcataaataataatcagcaaataatgggttggcaaatcaggaggcaatatggcacaggaatttaaaaagaaagccctgcctacccactcgtgaatgagtaaaacgagcggaatctaacatcaggagtgagggaatagaagaatgcctctttctttctctccaaagttttctcacaaacccacatttcaaagatgagaggactggcatataattgagtaaaactgcaaaaacaaacaaaagcctttaagaaaagtttcagcttagctgggcgtggtggtatgtgcctgtactcctagctacttgggaggctgaggtgggaggatcacctgagtccaggagctgggggccacagtggactatcatcatgccactgtactccagcctgggtgacagagcaagaccctgtctctataagaatgaataaataaatgaaaaaataagaatgagttaattaaggttaggactggtggctcacacctgtaactgcaacactttggaaggctgagtcaagagaactgattgaggccaggagttcaagaccagcctgggcaacaaagtgagacgccgtctctccaaaaaaacaacaaaaaaaattagctgggcatggtggcatgtgcctgtggtcccagttactcaggaggctgaggccacttgagcccaggagtttgaggctgtagtaagccatgatcacaccactgcactccagcctgggcaacagagcaaggccctgtctcaaaaataaaaaaacaaacaaatatataaagtgtcaggaatattcaaactgaagtttaaaaaaaagttaaagatgagaatataactccttttaaaattcatgctcatggcaagaaaattaacaaagagaatacaagcctataactcagaataatataatattaataaatgacagagagaatgcagaacgtcctcttccactagcacctggtaaatacatacacacagacacagatgcacacacacacactcacacgcttcaataagaaactttaaataggagtgtacaaacctaaagagagaacaaaagtccaagataaacctcttggcaagagtaacagaacaccacagacacaatgaatgagctcaagttgagaaaatagttacaggactggagatgaaaaaacaagttggatttttaaaggtggctatcagtggggaaaattccttacaagccagtaagtgtgcttactttcctcaggaaggtaacataaagggttattaaacaaagtttagaagtacttagaaaacagagcttgttctaaaataaaaaactgaattactaataaggtcatgtcaagataacctcttttcactttctgattattagactggcaataacatatgacaatagtatatggcaaagtaaatgatgctttttgcgaagacagaaaattctgaatgttgataagatttttaactggatgaattgtagccaataaagtattgttgaatgaataaattctaacctggaataaggattctaataccaatgagcctatcatgaggctttctgtacccatacagctcttgatgatttcataattattttcaattatacaaaaaagctaaaaggatttggaatctaatcaatcacgttttatattaagacactgtaagcacagatatggcctagggcaagtggtttaatctcactggacctatttcctcatctaataagtggacgaaatcagtgacattcaaactttctggcagtccctcatattaatagtaagaaaaatgatccagtgcaactaacatgtatgtgtttggtgtatgtaactaaaacaaaagtttcataaaacagaatgctcttatgacataatgtgcctaatattttctagtctatttcattatttttaatgtaagttacaaccccccaaattgatatcataaccaaaaatgggacatgaatagagattttgtttatttttctgaaacagggtcttgttctgttgcccaggctggagtgcagtagcatgatcacagctcactgcagcctcaacctccctggctcaagtggcccttctgcctcagcctcctgagtactgaaactagtgggcaccaccatacttgtctaattttttttccgtttttttagtagagatgaagtctcgctatgttgcccaggctggtcttgaactcatggcctcaagcaatcctcccacttcagcctcccaaagtgttgagattacaggcatgagctaccatgcctgatcatgaatacaggtttgaaaaaataatggacaagacttctaaagtcatctatatacagctgtacaatttaataaatagttctccaatttagatatcaaacaaaatccatgatatccaaccagtagatgatgtatactatatcaacataaatagtaatgatgatctcacagtgacagaactcagaattataccaaacaactgaacactgggttgaaaacaaaatgaatctacacaggtaaggctctgcatttaggttcagaaatcctctcaacagagcctggcagcaggtgaaatgaacaagacctgcaggctttagttaacttcaagcctattatgtgatctcagtgtaattcaccaatttattgttatctataaataatactgtttttaataaatatgtgtgatataaataaatattttggtactatgcagatcaaaggtaatctgagatcaaatttaatctggatcagagtgatcagttgtagtccccatccatgtaacataaaagaacaaaatattgatattatatgcgttgatattaatatacattttactgagtataatttccccaatatagtatgctaagtatttttctttatctcatttaatactcaaacaattctatgagatatgtggtgctatagtttgaatgtgtcccccaaaaagcacatgttagaaacttaatccccaatgcaacaacgttcagaagtgggacctttaagatgtgatgaggccaggagggctctatttcattaatgccattatcacagaagtgggttcttcatctaaggacaagttcagcctcctattgctctctctctcttgtcctctctttgctcttctgccatgggatgatggggcaagaaggtcctatcaaatgccagccccttcatcttgggacttcccagcctccaaacccataagcaatatatttttgttcattaaaaattacccagtctttggtactgtgttatagcagcacacaacagactaagatagtattatctccatttaaaaataaagaaacaatcttagaaaagttaaatatcctacccaggtcacacatgttgttagtgggtaaatgctcaaatcaggaactgaacgcaggtctttctgaagagaaactatgaccttttaactcttttttaaaaaaatttgggccgggtgtggtggctcacgcctgtaatcccagccgaggtgggcggatcacgaggtcaggagatggataccatcctggctaacacagtgaaaccccgtctctactaaaaatacaaaaaattagccaggtgtggtggcgggcacctgtagtcccagctactcgggagggtgaggcaggagaatggcttgaacccgggaggcggaagttgtgagctgagatcgcgccactgcactccagcctgggtgacagagtgagactctgtctcaaaaaacaaaaatcaaacaaacaaaaaaaattatttctctttactgagattcccaaaaagctggaagtctgtgtttattaaactcctatttcttatcaaacttttattaaaaagttcattaaaggatctatggctataacaactatttaacatatatgtggaccactaaattcaggtaaattaatagaaaatatattaaaatgtttaataaaatgtaaacatattttaattaataataacaatgatcgttttctaccacaatattttaccagtgtctctttaccttattagtgatggctcactactataagcactcagaagttaattcagtgaaccctaaaaaagctgacagccaaatgcttcaattcaggaaatagtaataaactgattcctaatacagtcttttttttttttttaagatggagtctcactctgttgtccaggctagagtacagagttcagtggcgtgatcttagctcactgcaacctctgcctcccaggttcaagcaattctcctgcctcagcctcctgggtagctgggattacaggcatccaccaccacgcccggctaatttttttgtctttttagtagagatggggtttcaccatgttggccaggctggtcttgaactcctgacctcaagtgatccatccacctcagcctcccaaagtgctaggatcacaggcatgagccactgcgcccggcccctaatacattctttagttgcatttggacttggaaaatatttcttcaaatcctatttcaatgcacaaaaatacacatttttcttaccatatccactagcatatcattaatttctttctctaaacaagtgatcaaaattatccaatgctgggaaggagttaaacttcaccatcacagttcaatctttagaaatcctattatctactcaggcacagtggtgtagtcccagctacttgggaggctgaggcacgagaactccttgaaccctggaagtggaggcggatgcagtgagccaaggttgtgccactgcactccagcctggacaacagagcaagaccctgtctcaaaaaaaaaaaaaaaaaaagaaaaaaagaaaaaaaaaaagaaaagaaaccctattatcttatcctcaacattcaacattaaaaatcctattttggctctattccggaaactaaaaagtcacagaagtaactttttattgacatcgtattatgaataaatgttttcatctcatcctatatttcaaaaacttacatgagcaccttttgtttttataatatacttcagaaatggaaaccaaagccttgactcaagatattttcaggaagatgaaacaattttcacttgattattatagttttaattatattcataatttgtattacattcaacaattaatcatgattaggaagcaaaatgttgactaccaactcttttttctgaataaaacaatgtcagcaattacattacagtacaagttattttattctactatcacttaaaacttagtttttccttgatgctcaaagctagtactgtgtcagcgctgacataatatatattttccagtctaaaaaaagtcacaaaagaatcattaaactaagaatttcttctcctggtttttctgtgataaaatagtaagttatcttgcagatctccctcatacatacaccatagaagtacaaatacctcatttctacaatgcacactgggagttgcattcaaacaaaaggaaatatatattcaagccagtatttaacagtactgactcttttacattgtataccatgaatacaggattatccataacgtcatacgataaaagaatattgtcaaatagcttattctgcctcttcttccagaacagtccagtcaatagcttcataagtgaatttcagtctttttggcaaatatttccctacttcctaaaacattcattaatgattaagtttttctcaatttaaaacttgactatcatttgcttctctgacatttgctatactaggatactgtgtatataaggtagtatttgattttatacaaaactttatttatttttaagttaaaaatatgtatttcatggtgttctctttatttcccagtttgtgaactcaattttagaaacaaaactgtgccagcagtgaggaagatcttggattaagaagactcaagacaccattttggagtcttaatattctaagcaagaaatgcagtgtacacaaatggaacagacttaaagctgttttagaggtggaaaccaataggatttttacatccaagaagaggaggaaacttcaaaaatggcactaagtttctagcttaggagctgagaggatacgctattaattaagaaataaatttggttttaaatattcttggttgagttgtcaattacctgacaaatagataaaaaggactggaactcaggagaattagggatttctaatatatgagttcttttgcttttgtttccctgcctcaccacttaaagctatgtttggggcaagtttttcaatgctgacatggagattaaagggaaagaaaatgcaacaggctagggggcaaatatgttacagggtaatctaggccatgtggtaaatgcaatatataacccagctgggtcatagtttttgtttttttgtttgttttttgagacagagtcttgctcttgttgcccaggctggagtgcagtggtgcgatctcggctcactgcaacctccgcctcctggattcaagtgattctcctgcctcagcctccagagtagctgggattacaggcatgcaccaccacgcccagctaatttttgtacttttagtagatacagggttttgccatgttggccaggctggtctcgaatccctgacctcatgtgatccacccgcctcagcctcccaaagtgctgggattaaggcatgagccactgcgtccagctgggtcatagttcttaatcagggctcattatattcatactggggttggggggacaggggtttgcaaaataaatctcctaagcgccaccctggatattacttctttgatagatctggggtagaaactgagagtatacttatttttttttaagttccctgaatggattgactcaaaaagggttatgagagaactttctgtaattatagaaatattctattacgaccgggatggaatactattcgacctttaaaaagcagaaaattctgtcatttgtgatgtgaatgcatgtagagacactatgctaagtgaaataaactaggcaaagagagacaatatccagaatacataaagaactctcaaaactcagtaataagaaaataatcaacccaataaaaaattagcaaaagattagagtaacacacttcaccaaagatatatagatggaaaataagtacattaaaacagacaacaacaaaatgcaaattaaaaccacaatgagatgccgccacatacttattagaatgggaaagaacaaacctgacaaaaccaaatgttgacaaggatgaggagcagctggtctcatatatagtcagtgagaatgcaaaatggtatagctactttggaaaacagtttggcagtcttcaataaagttaaaacagaagacaaaaatcatcaacagtggaagcacataaaaagaccacaaagctaacaaaactgaaaatcaaaatacagaataacttagaaatagaaatgggcagaatccacacaatatcgccaaataactatgacatgtaggtgtttctaggagatcacaataatttgaaagaaaaacagtgaaatgacagaaaccacaaaaagacaggagagtcaaaaccaatctaacttaattagtaaacttcaaacagtaaacacaacaaatggaatagaaaaagtattcacaaatatgttagaagaaaaataattccaccagattatcatgctaatggagcaacagacattctctaactaaaagaacttgagggaggggcaaaagctggacaatgatatcaagccaaacaacagataaatggagataaaaggactgctgataagttctgaatttatttaggagtaaaaatgggctgggcatggtggctcacaccattttcccagcactttgggaggccaagaggggtggatcacttgaggtcaggagttcaagaccagcctaactaaaatggtgaaaccccatctctactaaaaatacaaaaatcagtcaggcatggtggcacgcgtctgcaattccagctactcaggaatgaggcatgggaattgcttgaactcaggaggcagaggttgcagttagctgagatcatgccactgcactccaagcctgggcgacagagtgagactctgtctgaaaaaaaaggagtaaaggccgggcgcggtggctcacatctgtaatcccagcactttgggaagccaaggcgggcggataacctgaggtcaggagtttgaggccagcctggctaacacggtgaaaccttgtttctactaaaaatacaaaaaaattaaccaagcgtggtggtgcacgcctgtaatcccagctactcgggagactgaggcaggagaatcacttgaacactggaggttgaggttgcagtgagctgagattgcgccattgcactccagcctgggtgacaagagcgaaactctgtttcaaaaaaaaaagagtaaaaataactgggaattttggtgtatagaacaaaataaaacagaactattataaacttcaacaaagtaagaataatctggcactggtggtagaaagaaatacagtatgttaaatgatccataccatgaaagataaggaaattggacgttgcccaaaatgagacacttattcctaacatttcatattttcataaatggaagcaatttctacttcacaaccaagatgaaaaagtaaaaggaacatcttcaatttatctctgcctctgcattaaaaaacaaggaagtacacatgctcaacccagccctataggatgtagtttctattctcccatgcagtaaaattatagaggcattatccactcctgctgtggttgacaagcacagtctatgactatgttgctaaataagtctaattcaaaaataaagtatcataaggctcattctgactacacagtcgtacaacctagtttttactaggaataaagtgaatattatttctgacagtacaaccctcctttgtgtgtgtgcatctctcctttgattagtccgaaactgggaaagtgaagattattgcccatcccccaacaccaactttacagttcagtaaaatcataattctaaaataatttttaaaagtttatcctaagtttagctattcttacattttacttccttgttatattcaagtaaatttacttctttttattttaaaatggtgtacataatatgatcccatcttcatttctctatatccattcatccttttatctttaaatgtacatagagagacccagaatgatttacataatgtttaagatggttatttctagatggtagattaagttttgttttttgttttttttttaagacagggtctcactttgacacccaggctggagtgcagtggcacgatctcggctcactgcagcctcgacctcccaggtccaagtgatccccctgcctcagctccccaagtaacagagactacatgggactacagacatgtgccaacacatctggctaatttttgtattttttgttgagatggggtttcaccatattgcccaggctggtctcgaactcctgagctcaacatccacccgcctcggcctcccaaattgttaggattacaggcatgcaacactgtgcctggcttagattaattttgttgttgttgctgttgtttgttttgtttttgctttttcaagacagagccttgctctgttgcccaggctggagtacagtggcactggagatcatggctcaccacaccctcgacctcacatgctcaagtgatcctcccacctcagcttcctgagtagctgcgactacaagcacatgtcaccacacccagctaattttatttatgtatttgtttgtttgaagagactgagtctcactatgttgcccaggctggtcttgaactcctgggctcaagcaatcctcccaccttggtctctcaaaaggactcaataaaacaaataggaaatagtctacagaagtgtttgcaaactatggcccatgggacaaatctgacctgtggcctgtttttgtatagcccacaagttaagaaaggcttttaatttttaaagggctgcataaaaaaaagaagaatatgagaaagagaccctatgtgtggctcacaaagctgaaaatattaactgtctaactcttcaagaaagttgccagcccttacttagtctatactatcgactctatattgacaaaaggtacaatctactggaactcataattcactgatacacaagagaattttatatattaaggaaatcaaattttatctcacagactcccttttatcccttgggatgttgtctttagatgctgacatggtgatatcggcatgcacaacttttatgattatctaaagttcccaatcttttctttttgattttaggactgcatgttaggaagacttttctcttttcaaaggcaaaaaaaaaaaacttccttagttttcttctactacttttatagttttgtttttcacattttaaatctgtgacatctggaaaagaggcccttccatgactaggagtaaataacagtctatacagaaagataccagactgcagattaatggggggaagaaggtgttggaaaagtgtaggggacaggagaaggaagacaatgaacaggagtctgtgacaaggctggaatcttgaaactgactgaatgataatttataggtttccttctgacagatgttctcaaccgaggatgttccatgggccataaggcagtcagttcctaactattccataagaacaagagcttcagtagagaacaagatccaatcatcattctctttgtatctgaatttatctctagattgttgtatttctctttgttgctattatacacagaatttttcttcctgttatatttgctaactggttgcttatatgtagcaaggggccagccaactatgggtcaagccagctcactgccttctttgtaaataaagtgttactggaacacagacatcctaattagtttcatgctacaataggagaggtgggtagctgagagagagatcatatggcctgaaaaacctaaaatatttatcatctggccctttacattaaaagtttgccaatctctgatatatagggaaactatttgattacaattttttgaggtaaaattgtaatacatataatacaaaactaataattttttctttgagacagcgtctcactcttttgcccaggctggagtgcagtgccatgatcttggctaactgcaacctccgcctccttggtttaagcaattcctgcctcagcctcctgagtagctgggactacaggtatgtgccaccatgccccgctaatttttgtattttttttggagagacagggtttcaccatgttggtcaggctggtctcaaactcctgacctcaagtgatccacccttgtcagcctcccaaagtgctgagattataagcatgagcaaccgcactcagcccaaaattaataatgttaaaatgtacaattcagtggcatatgagtacattgataatgctctgtgactatcacctctatctagttccaaaacatttgtatcacaaatgaaaaccctgtactgattaccttgtacccattaaggaatcactctctatttttccccctgccccgagctaccactaatttgctttctgtttctatgaattcacctgttctggatgtttcatataaacggaatcatataatatgtgatctttggtgtctggtttctttcacttagaatgtgtctgacatccatgttgtagtatctcatttctttttatggttccatcatgtgaagagaccatattttgtttatccattcatcagtggacagacatttaggttgtttccacattttggtgattgtgaatagtgctgctatggacattcatgtataagtttttgttagaatgcctgctttaaattcttttggaattctgtgagtgatattgctggtaattctatgtttaactttttgtggaaatggcaaatttttctacagcagctgtactattttattctctcaccagcaatgtacaagggttccaatttctccacaccctcgccaacaattactttccgtttaaattttttttttttttttgagatggagtcttgctctgtcatccaggctggagtgcagtggtgcaatcttggctcactgcaagctgcacctcccaggttcacaccattctcctgcctcagcctcccgagtagctgggactacaggcgcccgccaccacgcccagctaattttttgtataaaattttttcaataatagtcattttggtgcatatgaagtggtattgcactgtggttttgttttgcattttcctaatgactaatggtgttgaacatcttttcaggtgcctgtagccattgtttgttatatatatattatatatataaagtatatatataatatatatataaagtatatatataaagtatatatatataaagtatatatataaaaagtatatatatataaagtatatatataaaaagtatataaagtatatataaagtatatatatataaagtatatatataaagtgtatatatagtgtatatatataaagtatatatgtaatatatattaagtatatatataaagtatatatacatatatatactttaaacttcgacaaataaaactgaaaagacagcacatcaacagaaaaatgaacaagacaattaaaaggtaatttacagaaagaaaaacctccaaaactaatatgtataagaaatgctcaaacttagtaactagaaaagtacaaattaaaagaatcaaacatcagtttatgcttattagatcagtaaagtttataaagctggataatttttaaatgttgggacataaggatatgagaagactcatgcattgttagtgggaatatagacttgttcagctactgtgaatagcaatctggcatttcttagtcaaactacatatggggctaacctatgtcccagcaattctattgatttgtatatacactccaaacaaatacttaacacagagtcatgtgcaaggatgttcagtgcagaacaatttgtggtgtcaggaaactagaagtaaacaggtagctatcattaagataacagatataatatggtaaaggtctcacagagcattatacagctgttagaagcaatggattagcagtatcaacatgagtacatcttagacatttagtgcttgtgggaaaaaaacagaataagaaatacaacacaatagcatttatgtaagttaaaaataaatgcacataaaacaatatctgttttgcatgaacacacagttacaaaaagataaatatattagaatataaccacaatgtatactgtataacaaacaatgcatttatgtatgggagaagggaaattcaaataggaataaaggaggctaaagaaagaaaacaaggaagagaccttacataaacctgtaatgataatgtcttaaactaattctctgcacctaaggctaataaaaattgtatctagccacatcgctggattctcttatttttatttatttatttatttatttatttatttatttatttatttatttattttgagatggagtctcactctgtcgcccaggctggagtgtagtggcgcgaccttggctcactgcaagctctgcctcccgggttcacagcattctcctgcctcagcctcctgagtagctgggactacaggcacctgccaccatgcctggctaattttttttttttttttttagtagagacagggtttcaccgtgctaaccaggatgatctcgatctcctgacctggtgatccccctgcctcggcctcccaaagtgctgggattacaggcgtgagccacagcgcccggcctggattctcttattattaatagtaccttttcagttgattctcctagatattttgggatataataatattgtcctaaaaacagcaataaattttacttcctcttccatttttataccttttatactgcattagttagtacctctggcacaataagtaatagtgatgacagccagcatttgtatcttgctccagactttgtagaacttctaaattttacccattaagcatgatgctgacttttgagctgatttggtagccttctatttctggtttagtactaaattttattaggaataaatattgaactttatcaaaagtattttcagcatctatggaagtgatcatataattatactctgatctactaatataatgacatattaatatatttccaatactgaattattcctgcattttcaacatgaatgtaggatatacatttaaaatatgcttctgtatcctatttgataattctacacattgtttcctcttcttttatcatgttttagaacaatttatatatcactgaagtcacatgtttcttaaactttggtagaacccaactatgaaactatctaagcctgatgttttttgtggaggtaactctttgacaatattctttattccttccataggagttatgctttgaaaagatcaataaagtataaaaacatctagcaagtcgaagaaagaaaaagaagaaaaaaataaatatctattagtaatgtaagaaagggactatcatagcaattgtggtacttattaaataaaagatatggtatacaactttagcaatacatgtgagaatggaagactagatttaacggcaggtattttaggaaaatatgcattaatagcaaattcaattatcaaactgactgacaagaaacctagaataaccaataaacacaaatgaaataaaaagtatgtcaaagatgatctaagtcaggaattgtttcactgcaatgaacagaaatctactcaaactaggtcatacaaacaaaaaaaagcattggaagaatataggagtatttcatggaaacttgtgctcaagtagtatagtcaagtctaaggattctggaatgttagaacccaactcctttttggaattgaattctctcttgtttgttcctttctgcatatgtgttcattcttttgtctttctacaaccacctttctatgcaaagatatctattttttatgactactcagtgccaaggcccaataccaactgactacagtctctgcatcccttttccaaattccaaatgggcaaagcttagctcaggtatcaattattgactcaataaaccttccagaggagaaagaatgaaagtagattacagagtcaccagctactaaattagaggctaaattcatgtattaactaggggtttgatgtgggcagtttgatgtgtggactggacaggaatctcgaaattgctataaaaataatctgactcctctcaaaaacccctgacccaaattgctttataggtgaattctagcaaaggtttatggaacacagaagtcctatgttatttatactgttgggggcataaaaaggataggaagttactataaggctaacatgatctcattgttaaaattaacaaaattagctcccaaaagaaaaatatgaattaatcacacttgtgaatagagatgtcaaagtttccatgtaaacacacattcatattaacacatatgtgcatatatgcacatttatattttcatattttaaaactactaccagtgttgtatttcttatcttcttatgggtgatattacacagacactttcttcgtatcatttgaattctttactatgattgtatttttcatcagaaaaaatccacattttaaaaattaaatagcctagaaatgatcgtaaaatattaaaaatttacattaacacttatatttacttacctcactgaattggaaatgatccaataagtagtgttggaataactggccatcattttgtggaaaatgatcatcatttggggaaaaagaagttagagtgtaacctcagtgtcaatgtaaattctagatggaacaaagatttatatgtgtaaataaaactctaaatgtattacaaaaacattgtaaatatttatatcatctttgggtgggaaaggggcattgaggcttatcgctaatgatataaaccataaaagtttgaatacaaaaaagtttaacatgtaaaatatatttttttatttctctctctctctcttttttttttgagacgaagtgtcactttgtcacccaggctggagtgcagcggcgtgatctcggctcactgcattctgtctccctggttcaactgatcctcttgcctcagcctcctgagcagctgggatcacaggcatgagccactgtgcctggcctaaaatatactttttaaaaatcataatcataaagactgccattactggctgggcacggtgactcatgcctgtaatcccagcactttgggaggctgcagagggcagatcacttgaggtcaggagttcaagacaagcctggccaacatggtaaaatcctgtatctactaaaaacacaaaaaaattagctgggcatggtggtgcatgcctgtaatcccagctaccagggaggctgaggcagaagaattgcatgaacccgggagacagaggttgcagtgagccaagattgcaccattgcactccagcctgggcgaccaattgagacagagtccgtttcaaaaaaatagaaaagactgccattccttttgtcttgctatatgctcctctttcagtattctcacccattaccctaattttaattatcacctctcaaaagactgtttccaattaaaaatacacacctagtcccaacttctcttcctagcttcagtccctgctaaccaactgtatcgggatatcccactgttaccctaacctcaatacacctaaaacaaactttgatacacctaaaattaagcttatcctaatttctaaactagttccttttaactttgttatgtctctcttcatgggatctcaaaatataatcagtgactcctccttttccaaaaacctacatgtcactctactctgatggttattcttctttttaattatcttcctttcattcaatctttcctttctattcccacattaccccaaattatgcccctaattgcaaaaaatattaacactaagccagacaattaaaaagggtattttaacctcaaaattagaatctgaccccataccatacataataccaataaaaggcttggcagcacattctctaagacatatacactgtagcacagtaatttaatattaagtcattctattacagccttttaactcctgctggcctacatcacttaaaacaagaaaactaaataaaaatacgtgtcattaagatatttaatttgttgttgctgttgctattgagaagacagataggataagataaaaatggcaaaagtaaccagagtcaatagaattctcttttttttaaatagcattttttaatctctaggaaaccctaatatccaattatttaaaatatgcaacccaaaccaaataaaaatatttgagaatgaattttatgtcaaatttcaaaaacctatcgttatatcttttataatactaaaaattattttggtattaccatcacagaaatcatacaattctagaactagaagggaccttggcaattatgtagttaacatacattaaaactactaagctgggctcgatggctcacgcctgtaatcccagcaccttgggaggctgaggcgggtggattacctgagttcaggagttcaagaaaagcctggccaacatgatgaaaccccgtctctagtaaaaatacaaaaattagccgggtgtgatggcgcatgcctataatcccagctacttggaaggctgaggcaggagaatcgcttgaaccgaggaggtggaggttgcagtgagccaagatcgtgccactgcactctagcctgggcaacaagagtgaaactctgtctcaaaaaaaaaacaacaaaaaacaaaaaacaaaaactactagtgatctccaatttatcaattcacacaaataaccaaatgccttctataccctgtgcaaagcatacagaggccatgctgactgatggacatggctaatttcagtttgacaaaaataaaataggctactgctttctaataagtccaattcctattccaatcagttaaagttctagacatatgaagagtcagttgtgtttctcaaacacgttcatgccagctgaacttattttcatcacgtaatttaaattttatataaactgagaatataaaaagtaaagttttatagaaaatgaaactgaatgcttcaaaaagccttgataaaaggtgaatcaccaaaaaagtttgtctaattaactatctgtagataagacagctaaactagatgggaagaaaaaaatgtactaaaggaattctgtattcaagtttgcttcaccatggtcttgaaggttttaatcaactttaacgaataataggcaatatcagtctgcgggtgtaatttacacaggaaagtcaacttgaaattccatcagcaaaatcagcagaacaatactcatttatacattcaatacacaaggacatactgacacccaccctgtgccacgtattgagccaccagacctaactatggttttaaaaatattactctgaattccacatggaacagatgggaaaggtaggcacaaaaatggaagtggaaaacttaggaggcttttacagtaatcttgtaaaaaatgctggtggcctggatattatgatagcagtgggagggtgttatttgaatggatatgagatttaatttgaagggaaaagctctaacaattgttttaggactagatatgaagtttgagtacaaaaagaagaaagggtagctcctgggtttttgcagaactaggtgaatgttgacatttactgtgatatagagaagccatgggaggtagaggagatggagacaaaatcagcttaagatgcttattttgaatccaagtaaaaatactagataggcaaatctggaattcaagatagaggccagtgcaggtaatacacgataggaaattatcaggtattcaagtatgcaactagatgagatcacctaaagaataaatgtggataaagaagtgagcaaaagaactcagacctggaatcaagccttacatcaaaaactatcaaattaatgcacacttttctattttttttttaaatgatttcctttttcaagtaactgcaggttccaatggtgtcacataagagacgatttcttagaaactcccttttcaggctggacgcagtggtgcatgcctgtaatcccagcactttgggaggctgaggcaggcagattgcttgaagtcaggagttcaagactagcctggccaacatggtgaaactccatctctactaaaaatacaaaaattagccaggcatggtggcacacacctgtaattccactagctactcgggaggctgaggcaagagaatcaccttgaacccaggaggcagaggttgcagtgagctgaaatcatgccactacactccagcctgcgtgacaaaatgagaccctgcctcaaagaaaaaaaaaaaaaaaaacctctcttttcatgtaagtacactgactcatgtatcttcaagaagctgatctaatttggatatgtgtccctgcccaaatgtcatattgaaatgtaatccccagtgttggaggtggggcctactgggaggtgactggatcaaaagggcaggtttctcgaattatttagcatcatcccttttggtacatctttacaatggcgagttctcatgaaatctggtcatttaaaagtgtgtagcacctccccccgactctcttgcttctgcctttgctatgcaacatgcctgctccccctttgccttccaccatgattgtaaccttcctgaggctccccaaaagcagacgctgctatgcttcctgagcagcctgcagaaccatgagccaattagacctcttttctttatatataactcagtctcaggtatttccttatagcaatgcaagaacggcctactacagaagcattctagaattcctcctctctcagtctcatatctcacacccagcactccccaacacatacacacaaacacacacacacacacctctagaactcacactcatcacctttaccccttttcccacccctttaaagttgtctttcctttgtgctttcacaattgtatttgcagatttccacagaggtcctttttaacattgtatgttctaattgtcctttagtggtgtgaaagtttccttacaggcaagaaccataaccttcatctttgtatctccaatgacttgcacagtacctggtagataacaggctctcactgaatgttttcctgaatgactaaatgaagggagagagatttacccaaggtcagtcccacggccatttaataggaaagtaagaattataaagtaggtcttagtacagtcagatgttctaaacttacttcagtctgtcattcaaagaattacatattcaggcctcaccttatctatatattttatttcttatttatcatcctgtgaatacactatgctcagtcttgactaaaagttatctatatattttatttatttatcatcctgtgaatacactatgctcagtcttgactaaaagtctagttatctaaccaaaattcacttttcctcagcctgttcagaacctatgccttgagctaatttcttacctctctcataaaaaatccccctcacattccaacctgaatcatttcccccactcccctcccctcacctgctacacacacctttgttaacatcctatacaatctgatttctatccttacacctacattgaagtgttatctcaaagttcaccaaaagcctttgtaacagataaagtataattttcaaaacagtaaaattatgactctcatacaaacatgaaatgaagatctggcaaaaaatttacgtaattcattgattaaggaagaaagaaataagatgttaaaactgattcaaataagaatctgatttactatttctcaacttacaaaattcattttcatggcacaaacataatttgcattggtatgggcagaaaacatttgtactgctttcagttttctacaacttaacttttatccctttttacagagttgtgaaacagccttgtcaatcaaatacaaagatgcatatcccttaatcagaatcatataactcctggagggtcctctaaacaacatctagcattctagatatgcaataatttccttttcccacctctaagtctttgataatttttcctacataattgtcaaaactcatcctaacctgcctcctgtagtgcaaggtaaaatcactcttgccacattcagtttccataatatggcactctcctggatcctctttttacctctctggttctctttcgcctccttcaccagctcctattcatcttaaacatagtattcgctgagttttttcactgggcttttgactaacataactttttatggctgtatccaatctcatccaggcatgcttcatccattacttatacaggaattattcccatatgcacagatccaatgtctataattcccagagtgaaatttctattttctccatttctcatgttgatatcttagcagtgcttcaaattggtcaacaacctaaactcactcttttcctcacctacctatggtctatttctgtgtttcctaacttaatgtctaattgtcacagaggcacaaagtatgaggatcttacactctactttctccctcaccctcctcctctgtgaaactgtgttttccaggcagtcacctaagcttttcactgtacctctacaggcttcctcttatatcttccccttcctcatagcctttccccttgtttaagcctgtattatctttcacttgaactgttgataaagtctccaaactagtatcttgactctctcttctaacattcactcagctgctaaatttatatttccccaaacaagggcagcttttctgaactatacccacttatctgagttcttatataataggcaacaatgttgttttaggatatccacctacttcctactcattttacttcagttacttcagttcagtcaagctgattccaccagtgaagcacacttcagctaagacaatcataaactcatgatgactagttcagaaactggcccaaaagagccaatgaagtgccataagacttttgctgagacttctgggccaaaggtgtatgctttttgctgagataaatgccattgttattgctatattttgccaccagaggacagcctatttgagaagtcaaggcagaataagtgaagttcagagatgcaaagagaaatgtgatcctggtaacatcttctgagtcctggtatcaagcgatgtccaaagccagtttcccttaggttattcaattacatctaccaataaactttctttttgcttaagcctgtttgactcaggcaaccaactagcaaacaaaaaagtactaaacaacatctcctatcttttcatgcaccacatgactcagctacatcagcctcctcaccactatcagaatactgtgcctttccttaagctattctttcagtctggaatttgcttctctctgcttggaattcccttccctccatgccttgcttattaagatccactttacacttcaagtttcagtttaactgcctcagtgaaataatcaccagagactagaaagaagcagagggccagattacacaaggatttgaaaccatgctatggctttttgaactttaacctaagggtaaagaaatgtcattaaaaggttttaaagcataaatgacatgaccagatttgcaattttaaaaagatcactctacttgctgtgtagcgaatgaattagagaagggcaagggggacaatgatttgtaagctacccaaacaacctaggcaaagagaatggtgatatgggctaaagagacaatggagagggaagaatgtatttatgtaactattttatttctgaataaatcttcctctgtactataaactccctgagggcagagaaattacctgttgactatcatgctatccacagaaattagcaagtaattggcacacagtaaggactcaaatgggcaaatggaagtatcatttgtgaagacagaaaacacaggaaaactcagtttggggtttgtttgtttttgtgcaatagagaaggatgaagatgaactctgttttggacaagctgagtttgaggtaatgtcatatattcaagcaggcaaatgggtatatatgatacatacaaacacacacacacgtccggggatcaggaaagagatttgcgctgaagacactaacttgagaattctgggcatagacgagtaaatggtaacggactttatgagaggagataagattgcctagaaatatgtgaaatgaaaagagggtggagatcacagacctcaggggcatttaaaggttgaacagaaaaggagaagctaaggaagaacactaatagcgctggcaggaaagcacagaagagtcctttaataaagccaagggaagaagaggaaggtgtggtcaaatgtgtcaaacattgttaaaaaaaaataaaaaagaaaaaaagaaaaaagtcagggaatgggcagatttaaagtatcctttggataaaaatagttttggtagagtgggtgggagtgaagccggacatgccttagtttggattgggttcaagggtaagtagaatataaagaaatgaagtcagccactattagacatcttgctcaagaaattggctacaaagaaactgagatacatagttgcaggagtggaacacagttaatgctaagttctgttcctttgttgttacaggttgtgtatgttttacagaatttgatcttaagcatgtttaaatgttgattggaggcaacctaaaaagaagaaaaagtagaagaaaaggtaagaataaatataaaaaatgagcaaagtctttgaaatggagcacagaagaagaaactcgttttgaaaagagacagcagtatctcttccactgaagttgtatactagaaggaagaactagtaaggatgtaggcacatttatagatttggttactgaaaattaagagagcttacaagtcatagcttcaaatgtgtaatgaacatgttgaagtttaaattctaaaacaaatctgttcattgagaattttttttaagttatgagtttaagatagacattaacatataaattatataaagtagctgtcctatccctcaaccttagatttataagaaaaattaaaacaatatttaatgcctactatgtataagccactatgctgtggagaacacaaaaaggctctttccccagatacatgtatagcctgtttcctcttcctttaggtccctgttctcacattctgctttatttctctccattgaatttaccaccacctgatacattatttttgtcttactgtccgttttccccccactggaatagggcagcaactttttctgttttattcaatactgtatacccagcatcaataatactgcctataatggatagggacacaaaataaacttttgatttaagaggcaacttctcttcaggaaggtactatctgttaagtgagagagagattatatacagaatacatccctgctatggtctgaatgtctatgttcccccaaaattcatgttaaaacctaatcctcaatgctacagtattaagaggtggggcatttaggaagttatttggtcatatgcattgtactgtcatgagagggattagtgcctgatatagtttacatatttgtccccttcaaatcccatgttaaaacttgatctctaatactgcagatggagcctagcaagaggtatctgagtcatggggacagacaaacacaaaaaactggtaccaggaatggggtgttgctataaagatatctaaaaacataaaagcagctttaaaactaaagctgcttaggggttgcaatcctagtctctgataaaacagactttaaaccaaaaaagataaaaaaagacaaagaagggcattacacaatggtaaatggatcaatgtaacaagaagagcaaattatcttaaatatatatatgcacccaaaacaagagcacccagattcataaagcaagttctcggagacctacaaagagacttagactcccacacaataatagtgggagactttaacaccccactgtcaatattagatcaatgagacagaaaattaagaaggatattcaggacttgaactcaactccggaccaagcagacctagtagacatctacagaactctctaccccaaatcaacagaatatacattcttctcacaccacatagcacttattctaaaattgaccaataattggaagtaaaacactcctcagcaaatgcaaataacggaaatcataacaaacagtctctcagaccacagtgcaatcaaattcgaattcaggattaagaaactcactcaaaaccacacaactacatggaaactgaacaatctgctcctgagtgactactgggtaaataaagaaattaaggcagaagtaagtaagttctttgacaccaatgagaacaaagagataacataccagaatctctgggacacagctaaagcagtgttaagagggaaatttatagcactaaatgtccatatcagaaagcaagaaagatctaaaatcgacaccctaacatcacaattaaaagaactacagaagcaaaagcaaacaaattcaaaagctagcagaagacaagaaataactaagatcggagcaaaactgaaggagacagagacacgaaaaacccttcaaaaaaatcaatgaatccaggagctggttttttgaaaagattaacaaaattgatagactgctagacagactaataaataaaagagagaagaatcagatagacacaataaaaaatgataaagggatatcaccactgatccctcagaagtacaaactactatcagagaatactataaacacctctatgcaaataaactaaaaaatctagaagaaatggataaattcctggacacatacactctcccaagactaaaccaggaagaagtcacatccctgaatacaccaataacaagttctgaaattgaggcagtaattagtagcctaccaaccaaaaaaagcccaggactagatggattcacagccaaattctaccagaggtacaaagaggagctggtaccattccttctgaaattattccaaacaaaagaaaaagacggactgctccctaactcattttatatgaggccaacatcattctgataccaaaacctggcagacacaacaaaaaaagaaaatttcaggtcaatatccccaatgaacatcaatatgaaaatactcaataaaatactggcaaaccgaatctagcagcacatcaaaaagcttatccacacgatcaaggcagcttcatccctgggatgtaaggctggttcaccatatgcaaatcaataaatgtaatccatcatataaacagaaccaatgacaaaaaccacacaattatctcaatagatgcagaaaaggccttggacaaaattcaacaccgcttcatgctaaaaactctcaataaactaggtattgatggaacgttactcagaataataagagctatttatgacaaacccatagccaatatcatactgaatgggcaaaagctggaagcattcccattgaaaactggcacaaaacaaggatgccctctctcaccactcctattcaacatagtattggaaattctggccagggcaatcaggcaagagaaagaaataaagggtattcaaatagaaagaaagtcaaattgtctttgtttgcagatgacatgattgtatatttagaaaattccattgcctcagccccaaaactccttaagctgataagcaacttcagcaaagtctcgggatacaaaatcaatcagcaaaaatcacaagcattcctatacaccaataatagagagtcaagtcacgaatgaactcccattcacaactgctacaaagaaaataaaatacctaggaatccaacttacaagggatgtgaaggacctcttcaaggagaactacaaaccactgctcaaagaaataagagaggacacaaacaaatggaaaaacattccatgctcatggataggaagaatcagcatcatgaaaatggccatactgcccaaagtaattaatagattcaatgctattcccatcaagttaccattgactttcttcacagaactagaaacaactactttaaatttcatatggaaccaaaaaaagagcctgtatagccaagacaatcctaagcaaaaagaacaaagctggaagcatcatgctacctgacttcaaactatactacaaggctacagtaaccaaaatagcatggtactggtaccaaaacagatacatagaccagtggaacagaacagaggcctcagaaataacaccacacacctacaaccatctgatcttgacaaaaacaagaaatggggaaaggattccctatttaataaatggtgctgggaaaactggctagccatatgcagaaaactgaaactggaccccttccttacactgtatacaaaaattcactcaagacgaattaaagacttacatgtaaaacctaaaaccataaaaaccctagaagaaaacctaggcaataccattcaggacataggcatgggcaaagacttcatgactaaaacaccaaaagcaatggcaacaaaagccaaacttgacaaatgggatctaattaaactaaagagtttctgcacagtgaaagaaaccatcatcagagtgaacagacaacctatagaatgggagaaaatttttgcaatctatccatctgacaaaggtctaatatctaaaatctacaaggaacttaaacaaatttacaaaaaaaaaaaaacccatcaaaaagtgggtgaaggatatgaacagacacttctcaaaagacatttatgtggccaaaaaacatgaaaaaaaagctcatcatcactggtcattagagaaatgcaaatcaaaaccacaatgagataccatttcatgccagttagaacagcgattattaaaagtcaggaaacaacagatgctggagaggatgtgaagaaataggaacgcttttacactgttggtgggagtgtaaattaggtcaaccattatggaagacagtgtggtgattcctcaaggatctacaaacagaaatatcatttgacccagcaatcccattactgggtatatacccaaaggattataaatcattctactataatgacacaggcacatgtatgtttattgtggcactgttcacaatagcaaagacttggaaccaacccaaatgcccatcaatgatagactggataaagaaaatctggcacatatacactgtggaatatgaagcagccataaaaaagaatgagttcatgtcctttgcagggacatggatgaagctggaaagcatcattctcagcaaactaacataggaacagaaaaccaaacatcgcatgttctccataagtaggagttgaacaatgagaacacatggacacggggaggggaacagcacataccggggcctgccaggggttgaggggcaaggggatggagaccattaggacaaatacctaatgcatgtggggcttaaaacctagatgacaggttgatgggtgcagcaaaaccaccatggcacatgtatacctacgtaacaaacctgcaggttctgtacatgtatcccagaacttaaagtattaaaaaaaaagcaaaaactaaagctgcttacaagagcttagagaactcaaaacaaaacaaaacaaaaacaaaaaacctcatacacaagaaaaactttaaaactttttagagactggttaagaggttgtgataaaaatgctgattaaaatatagacagtaaaggccacgttcatgagatctcaaataaaatttttaaaaactaaaacaaaaaaatggccacattatatgttatgcttgttaacaaaaaacttggctacattgtatccatgcctaggactttgtaaaaggctgaacttaagagtaatgacttaagctacctggcaaaaaaaagtttctaaacaacaaagcgttcaaaaggtgacatggctgcttctaacagcctactatcagatatgggagttcaaaaaaaagacaaagttaaagctaataattaagagaaaaacagagcatacaaatttgaaaaatttacaacctaaccatgtggtagagggaagttttcaggagagaaatccaaactacctagccccaggtaccaggccctgacagaacaggttgttaaagcaattaacatgaataaaagagagccagttgttaacagtcaagacaatggggaaaagcccccaagacattccagaaatcaaggctaccccttccatcacaggctcagaggcctcctcgggcaaaatggtttgggaggccaggcccagggtgttgctgccttgtgcggtcttgagatgctactccccacgttctggctgctctggctgcagccagggctcaaaaggccccaggtactgtctggactgccactccagtgggtgcaaaccataggccttgatggtttccaagtggtgttaagtctgcaggtatacagaatacaagatccatggaggtttggcagcttccacctagatttcacaagatatgtcaagaagtctggctgtccaggcagaagcctgccacagcagagctcctacagagagattctactaggctggtgccaaggggaaatatggggttacagtccccacagagaactcactgtagagcagcgggaacaggggcactgccctccaggacccacagtggtggcagtctaactaaagccaagagaagaagagaaaggtgtggtcaaatgtgttaaatactgttaagaaaaagaaaaagaaagaaacaaagaaagaaagaaaaagaaagaaaggaaaagaaaagagaaaagaaaaaaagaaaaggaaaagaaaagtcagggagtggaaagattaaaagtatcctttggatgtaaacagcatacaccctcagcctggaaaagtgacagacattagactccaatccatgagagcagccatgtgggctatgcccaaccaagccatagagatgcagctgcccaaggttttgagagctcacctcttggaccagtgtgctcaggatgtgggagggagtggaaagtgaggaagtggaaagattaaaagaatcctttggatgaaaacagcacacaccctcagcctggagaagtgacagacattagactccaatccatgaaagaagccatgtggtctgtgcccaaccaagccatagagatggggctgcccaaggcttcaagagcccacctcttggaccagtgtgctcagttatgggacaagagtcaagcgagattattttacagctttaagatttaatgtctgcccttgtaggtttcagacttgggtgggtccctttttgttggtcaatttgtcccttttaaaatgaaaatatttacccaatgtctgttccaccattgtatcttaaaagtagataacttgtttttgatcttacaggttcatagctataaggaatctgccttgagtctcggataagattttagactttgagttgatgttgaaactagttaagatttctggggactttgaaagagatgattatatcttacaatagaaaaaagagggtgggcatggtggcttacacctataatcccagcactttcagaggctgaggcaggagaattgctttagcccgggagtatgagacagcttagtgagatctcacctctacaagtaataaaaaaaattacctggccatggtaatgcatgcctgtggtcccagctacttgggaggctgaggtgggacaactgcttgagcccaggtggttgaggctacagtgagccatgatcacgcctctgcactccagcctgggcaacagagtgataccccgtctcaaaaataaaaataaaaataataaataaataagacaagatatttggggggctagaagtggagtgatatagtttagatatttgtccttttcaaatctcatgttaaaatgttatccccaatgttggaggtgagaggtgtttggaacatgagataagatccctcatgaatggcttggtgctatcacgtaatgagtgacttctcactctattaattaacagaacaattaattattaaaaagagactggtatccctcccctctctctctcgccatgtgatatgtcagctccacttccccttccatcatgattaaaagctttctgaggtcctcaccagaaccagaggctgaagccatgcttctagtaaagcctgcaaaactatgaaccaagtaaacctcttttctttataaattacccaccctcaggtatccctttataataacacaaacagactaagggagtgctcttataaaaagggctgcaggaacttgtttaccccttctgccatgtgaggagacagagaaagcatcgtctattcagcagagacactgaatctgctggtgccttgattctggacatcttccaaaactgtgagaaataaattcctgttgtttataaactacctagtctaaaggtattttgttatagcagctcaaacaaactattaataaaacaatactaacattcacaaatgagggcagcaaatgctaagagtgatgtgaggagcaacagcaaaaagtggtgcaagagttcagaatactgctaatcatcccagacaagcacagagttgtacaatcatccatcaccttctagaacagtttcatcatctcaaaaagaaaccttgtgccccttagctatcacctcccaactccctagcttccccagtcctaaggagccactagtctgcttcctctctctatacatttgcccactgtggacattccatataaacagaatcatataacacatggaattttgtgactggcttctttcgtttagtttgtttttaaggttcattcatacatgtagcgtatatcagtacttcattcctttttatggccaaataatattccattatatggatataccatattttgtttacccattcatcaactgatggccatttgggttgttcccaccttttggctattatgaataatgcttctgtgaatgttagtgtataagtttttgtataggataatttttctaagagatgcaaattttcataaagcttgtaaatttacccaaatcaaaaacatgttattctgagacaatgtccttcaaattttttgttgttgttgtttgtttgtttgttttttaagagatagggtctctctgtgtacccaggctggagtgcagtagcccattcatagctcattgcagcttccaactcctgggctcaagtgattctcctgcctcagcctcctgagtagctgggattgcaggcatgagacattgagctctgccaaactttttttttttaaatataaaacatcctttttaaatgaaaggatggcaatatcaaaaagtggttttgttaatgtgcttattaggtagaatactatttaaaattttgcttttctgttaaatccaaaagtctaaaaagtgttgaccgaagaaaatacaagatagcttctaaagaaaactaagagggttttccccctggagttgaaatcacatattgtaaacagcagaaaatgaaatacataagccaaaaggtagatcttgccaggctaaggaatttgggcattatcccatagtcaataagtaaattaataaagctgtttaaatataaaattattgactccaagatatcactatattcaacaaacaataattgagctactactatataaaaagcactgaatttggtactatgagtgattccaaaaagacttttgcctctgacactaccaaaaccactccagataaaattccaaatgacctaaaattgctaaatccaatttttatttttcagttctcctcttgacctatcggtagcatctgacgtaagtaaaacactcttccttgaaatattttccttctttcttttttttctttttctttttttttttgagacagagtctggctctgttgcccaggctggagtgcagtggcacgatctcgcctcactgcaacctctgcctcctgggttcaatcgattctcctgcctcagcctcctcgagtagctgggattacaggcatgtgccatacgcctatctaatttttttgtgttttttactagagacggggttttgccatattggccaggctggtctcaaactccgggcctcaagtgatctgcctgcctcagcctcccaaagtgctgggattacatgcctgaccaaaatactttctttacttggcttctaagacaccatactcttctgggttttcttcttacattactagtggctccttcgcagtctcatatgctggttctttcacagctccacaatttataaacattaagagtattcaaggttcagcccttgcaccatttgcatctcttgtctatctcattttattaatgctgtcagtctcacggctccactagaatgtagctccaacagggtgagaattgggggctgttttgtttatactggatctctagcacctaaaacagtgcctggcatatagtaggtgcttgacaaatatttgttcaataaatggttggatgaataaatggctttatatattatctataaactaatgaattctccaatttatacttcctgcctggatctctgtcttgagctccagatacatccaactgcctatttgctatctccatttgaatgtgtaaaatacatctcaaacttaatgacttaatgaaagagaactccaatcaccctcccaatggcttctccagctggcttcactttcttagcaaagtgtagccccatccttccagtttctcaagccaaaaattttctcaaacagtaactaaactgctactatataaaaagcactgaattttggtgctttttatatagcaccaaactataagtccttttttttttttcttgcgacagagtactctgtcactcaggctggagtgcagtggcacgatctcagctcactgcaacctccgtctcctaggttcatgcgattctcgtgcctcagcctcctgagtggctgagataacaggcatgcgccaccatgctcacctaatttttatattttcagtattaatagagacagggttttgccacgatggccaggctggtctcgaactcctggcctcagcctcccaaagtgctgggattacagggatgagccaccgcgcccagcctaactccttttctttctctctcactacatatccaatctgccaacaaataccctgtattttgccttcagaatataaccagcatctgtttatttctcaccacgtccacgattattactatgattcaagccgttatcatctctcacctggatgaatgccaacagcttcttaattggacttcctgcttcttgtccacctccactccccaattcagaaccacaagcagaaaaattcttttccaaacttatgtcagatcacattacttctctgctcataatcctgcagttattcccatttcactaagtaaaaacccaaatcttgaaaactgcttataaggctctcttcaatctggccctaagtcaactctgacctcatcgtctactatttttccctcacttattctgctccagacatactggattcttctgctgttccttccaaaggtcaagcatatttctgccttttcccttactcttccctttgcctggaatggtcttcccttagatatctgcatcccaccacctccttcaggtctgctcaagtgtcaccttctctgtgacttttcccccgatcatacttaaaattgcaaccccatccctacccttgtattctttatccctttactctgctctatttttttccacaatacttatcaccacctaaaatactacatattttactttctgcttgaagacatgactttctgtctttcactcactgctatatccctagcatttaaatcagtgcctggcacatgctaagtgatcaagagtctatctgttgagctatgcttttatttccaccagggggcctaacaatcatgtagcctggtgtttcaggaaaagatcataaagcatctctaagatttctttcagtgctctgatccctagaaggactacaacttgcctagaaagaaaaactgtgctttgtctcggcaaccacaaggaggagttgagaaaaagaaccgagcagagaaaccagataatgctgtttcccttgcttttcccacagtaacctcaaggtggaagaacactggatctggagcctgctgtactgaatgaatgatttttctccatactatgagttacctagacacaaacgtaaacaggaaacatcacaatccttccgaatgccacaaaaaggccaagggaatccatatacaatggccactaaggacaggaaaggtgtttctttaactccagcactaagaattctccacaaattcaggggaggagctccagttagcacagaaagacacataactcactgatgaagaccgagtgtttcaggtcgtcagtactctttggccagagaagtattaagtcaattctatttaatacttagggcacctaaaattcgtaagcggtataagcaagacagtcccacgtctaaattcacagatttggcggatcgcatggaattcattaacatcagactcattaaacacccaaatccatttcccacgggcttgtgactcaccgccacctgttgatgcccacattggaggagccggcgaaccaggggtccaggatgtagacgcagcggatggtgtcggcgccctgaatgcactccttcagggcggggttgtcgtggagccggagcccctttcggaaccagtgcacggcgttcacccccatgccggggggcgcggcgggtcctccacggagaaattcaaggaaggaggctccggctcatagccgacaccttcgcttccaagagaattgcctcacccggggcgtgaggaaagggcggcagagggggaacaggaaaaaatgactccgaggaggggaccggagaaggcgggggcgccggaggcgcagtggaaagatgaatggaggttgcctagtcggcggagtccgggtgtgacgccctttaggagcccgcgcccgccgcaaccgcctggaggcgacgcataacttcgagggcctcggacctccggagcctgagcaagttccaggagctcgagccgccacgacggcccgagccggcacggacggccccaggagattcgtcacggaaacctcgccccaccaaggcggcccctaaagacaaaacggcccgcccgaggtgagtcaccgaggagaaccggaggggaatgagcccctgtcggcgacgctgtctctcggcccgggagaaaggaccgggaacggaggctagaggcggtggtcgaggccgctggacggttgccggccggtgaccggtcccgaggctgcccgggtgactctgccgccgccgccgcgtcagcggcctcggccccgcccccggctcctcattggagggcgcgctcccctcgtgaccaccggcacctcacgtttctgaagtgtgtttactacactggctcggaggggtaatctgctcgcgcttcggtcgcttttggaggagcggcagccgcttgatcccaaacttgttgaccctcgtccacacgctgaactcactgcctctgcccctttcctgtgccgactggtggccgtcccttggaagcaaatcgcgttgaccacaggccccttgtgagggaaggcttagccccgccccc

SEQ ID NO: 772 - DNA, 468068 bp, Homo sapiens
cctcggtggcggcggcggcggccggctccaggccgggttttggcgccgcccgcctgctgcctcctggcggctcctgaactccagccccctctctatcagccgctcactccgtctcaatatgtctcaagatggcggccaatgtgggatcgatgtttcaatattggaagcgctttgatttacagcagctgcaggtcaggctcctccgcgctcggcctcgcgcccgggggtgggggctgcgggcggtcgcggcctccgccgggggccccgggctggcccagccgccggggggcccgcggcggcggggaggaggggggtgccgggcaccgcggggccgagtcggggccgagtccctcccgctccccggcccccattgatcactcgcttgatcggaaattgatcctctttgttcaattcatcgatcagcccaagatggcgccgggagccgccgccgccaccactgcccccggtgtctgcccccaccccgggcgcccccccgggccccgcgccgccgccgccgccagcgccgccgccgccgttgccgccgcgggaccggggagggggcggccccggcggcccgcggggtgcgcgcgcgagcggggagcggggagcgggcggcggggggcgggcggcggcgggcgccgggagggggccgcggcccggcggtggcgcccgcccgcccgctcgccccgcgcccccggcccgccgtattcccggggaaagtttgtggggagttgctgcggggggtgaagcgcctgcctctccaggaggagccgccgccactgccgccggcgcggcggagctggggctggtggcgctgtggtgccgccggctcgggggagggtcagagcggccaccggcggcggcggcggcggcgcggcccggctccggccaggcgggcgggtggccgggcaggcgcccgcgctcgctacccccggccggccccggccgccgcccccggctgtcaccggcccgggccgcgccgccgctccggcaccccgcgtgtggctcccggcgcggacccccgggtttgtttacgtcccggggagcgccccggggccacccgcgcacctcgcggccgccgcgctcttttgtgtgcctgtgtcggtgacgcggacctgttcctccgtggcggacccccgcgggggctctttggggaaacttggcgaggggcggcgggggtgccccgcgcgcagtgtcgctgggtcccggtgtcccggaccgccgggtgcgggcgcgggaggaggaggctgcaactttcccctaggcaggccccaagctgttcccccgggtgcccgggcagtgtacgctgcctccccgccgccggtccgagccgcgatcgccgcgcgcctgggggctccggcggcccccggtgacctgcggcgccgggtcccttccttgcgtcccctcggggcttctgccctctctgcagggcccgccatggagcgcgcggcgggtgcgctcggagatgccttctcgggccgggttctcgaaagcagagccccgggggcccgttgggaccgtggcatgccgggcggtggtccgcgcgcggagtccccggcgccgcggggggaccgtgccggggctccccggcccgcgcccgagtcgccgccgtgcccaaggggcgagtgcctgcctgccaccccccgcccggaggagcggcgcacccttagggtccgccccgcacgtgccagctcggcgcccgcggcgccgggacagccccgggactctgccaggtggatgttgtgcgtagccggagccaggttgaaggtgagcggcgtgtgggccagaagtcccgaggttgcaggcgcggagggaaccggggatgtcggggggtgcccgggtcccgcggcttagaatgctctagggcggcctggtgctctgggaggggataggagggttcctcagggcccctggggaactgcagctactcccaactgctaaggtgtgcgtgaagataaacttggctgaactttcctaacctggaggactggtgacagtgacctaccgcaatacctttgggagcaaagctcgagatgcaggcttgtatcaaacgaagcgggttggattaaaacatatttaaatggaatctgacaactttaattgtatatgcttgttttctgctcttgcctactaagaacgataaagccgagtcatagtcgttatgaaatttcctgaaatttctcgcttaactaggaagaagactatgcgaaatatgtatttccgataagattaaaacttaaaggagtttaagtatttattgactaaaatagattactccaaagtgtctattgtgtaaattagattcctggatgtaatgaacacagccgaatggcatttttgataaattggtctaccctgttttagtaaaaatagctcccttttaccataatttaattcctgtgcttactgtaaaacccgttgtggagttttaaggacaaacattattattatttttctctcttgtcttcctaaatgtgacatcctagcttaatatcaatgaagtgtcttttttaaagcatcctggcaaaattgcctggaaaatggatttggtttctagagttactagattttaagaactctaaaccttcctgtcccccatattagctacttcttcaggggatcagggctccagggttccatcgaaagtttccatgtcagtttacttgcactttatgtggatattaagaagaaatcaaaaccaaaccccaaaacaaagtcccttatttgaacttcattcctctttactcctttgcttttggtggttgctaacgatttggccttagatgatttcctatgggtttgcaaactttagtcgaatacggaatgtcaaagttcaagtctcaggccaatctggttctttctctgggcggtgaggaggcctttggagttggtgtctggttaattcccaccgatagtcagtgagtcaatagaacgagtttgggagagaattcattagttccagatttttctcatttttccagacctctttatactgagattgggttgccacctgggggtaaagaggctgatcggtctttgcagagagaaatccaggttggagacgtcagcgggtccaggtgaggttgggccgttccgcagttctgcaaccctggctcactgggttcttgtccctcggcttcctgggtcttgaagctgctgccttggcacaggagtgtgtgctcaggaagagaatttctgaagattgtgttttattccgtttcctttttagtcccaaaggcttgtggtatggaagtttcagtgctttggtattgctaagactagttggacaagttttttatcctatctcagacttgtaaaaaccaggttttcttttctttttaaataagaaaagcactgttgtataaatttgtcttttaaatacatatttgaaaggaggacactttctaagacaaagctcatggcactctgtatgttagtggagctttgaactctttgggacggggcccgccaatgactgccttccctttgggacattattcccacatggtgaccagccttcccctttaagcagcttctgcaaaagtaaacttgaaaagttgccttctttttcagaatcaaaaaacaatttcagttttgctgaaagtccattttctgatggctttttttccccctgttgtggaagtgtgtatgttactggctgtccagtactgtttgccataataagtatattattttaattaaaatgtcccatctagtaccctttataaaagagcagttcaagaaattacaccactgctgctcctgcttttgttttcttggttcttttaatatgggtgtctttgaggttggatgtgggaaggggtcattggcagttgatttaagttttttcctatgtgaaactctttttttccttaaaggtgcaagtggtgagttaatgcaacaactcctggtacagttgagtccacagagagccctttgactacatcctcggcttcgtgtatcttctgtcggtagttagccaacctaagaaagctgaaagggccaaatagtccaataccttcaggaatgattctctcctaaatccactgagctaaccttaaaaatgcagtctggtgaactgtgctgagcctgaaacctttaatggctatttaaaaagtctcctgtttttgtacaattaagacaaacccatcagggtttatatgggagctgtgaaggaacagtagtttgtgctctctgattcccttctgggtctacctgtagcagtaaacaatcaaaaccactcctgaggctgtactcactttctgtgtcttaggagagaacacaagactagaagtagaaaatccacatttgtttcagctcctctgtaatgccccaggaacgtctgtttttagtgaaatgaaggaaggacacgtttgttaggggaaaactcatacatttcgtaagcagagaaattcatcatatgaagaatcctacagaggtaggttaaattcctacccgtgcttccatttcaaatagtttacacatttgtcacatgtaaatttcacagacaggtatatctgacgaattgtaacacaaatggtatgtaaaaggcaactctaaccattattcaaatatacaggatccaggatcgtgagttattgtagaaattacttaagacctatttaaaattattgaatacataactttaaaaaatgtaattgctctatgaaaagtgacttttattataattgtcaaagacagaaatttgtctgtcttgtccttttgttttgtctgaagccccgcgttatcgctgcagagagagagttttggtttccaccgaaatttccctgcctccgattgtttaaaccagacccttaatcttattttaacatatttaaaatgttcacaaaacccggaagaattgttttgtgtaagtagcaagcgagtgtagcttaaacactcaagcaattctggtatctaattggaaacaggtggaattcttggaatcccatgtttgagtctttttatagcaaagcccagggacacttttcacttatagccattcgttttgtcgaagctatttgaagaggggccccacagcctctccttatgtcccactgttgcttacctggacaaagcagtcgtgctgggcgctttaggaactggatacctgtgaatgcctggatgccgagagaagtgtgtgtgtgtgccgataatggagtgaaaaaggaatctaatggtatagttagacaagcaatttaatatctgcattgttatatgactttagagcaaagaatttgtgaattcatttgtgatttctgacttgatgaaccttgactgaccagagcatgtaggtacattttattataccccaataatgatatagaattcagagagaagatactcccccccgcccccaaaaaaattctacatttagagaatataagctccaccagcaaccataaaagtattaacttggtgagggggatattttctttctttttttttttttttgagacagagtctcgctctttcgcccaggccggagtgcagaggcactatctcagctcactgcaaactccgcctcccgggttcacaccattctcctgcctcagcctcccgagtagctgggactacaggcgctggccaccaggcctggctaattttttgtatttttagtagagacggggtttcaccgtgttagcccggatggtctcgatctcctcacttagtgatccgcccgccttggcctcccgaagtgctgggattacaggcgtgagccaccgtgcccggcccctattttcttttcttttctttttttcttttttcttttttttttttttttttttttttttgagacgtggttctgtcgcccaggctggagtgcagtggtgcgatctcggctcactgcaagctccgcctccagggttcaggccattctccttccttagtctcccgagtagctgggacgataggcgcccgccaccatgcctggctagtttttttgtttttttgtttttttttttttttgagatgtagtctggttctgtggcccaggctggagtgcagtggcgcgatctcggctcactgcaagctgagcctcccgggttcacgccattctcctgcctcagcctccggagtagctgggactacaggcgcccgccaccacgcccggctaattttttctatttttagttgagacgaggtttcactgtgttagccaggatggtctcgatctcctgacctcgtgatctgcccgcctcggcctcccaaagtgctgggattacaggcgtgagccaccgtgcccggccgatgttttcttaaatattaatggcagggccctctggattgactgtgttatttgacccattccagttttcaaggcgtggtcttgaaaagctgtcgatcaccctggttttgggatgtgtttcagaaccaagtttcgatggtgtgtcagtgttggattttcctgctgaggacagctaaggtttggtatggagcagttttggatttgctgagctgtaatcagtccagcttctctgctgtcttctgagaaggttgatggaggagagtggtctttggcggggatggaggtttccctgcaggaaatgaaccaggactgaggggaacctgtgccgttcccctcatttgtcctgcgcctgaaacagctttgaagcacctggcttgtgacttaaaagatttttaaaaagcatttgtgctgccctattcgggtattacacagtgagggtgaaccattcttttcgaaagacgtctaaggccgggcacggtggctcatgcctgtaatcccagcactttgggaggccaaggcaggcagatcacttgaggtcagaagttcgagaccagcctggccaacatggcaaaacctcatctctactaaaaatacaaaaattagcctggcgtggtggcgcatatccataatcccagatactcggcaggctgaggcatgagaattgcttgagcccaggaggtggaggttgcagtgagctgagatcgtgtgactgctctgcatgcagcctgggtgacagagcgagactctgtctcagaaaaaaaaaaaaaaaagacatctaatttgttgtaaaacctgtcaagaaccttccctttaaaaagctaatgcctctctaataaaaataattttaattttgttgtaattaaattcagagaggatgatgttagtgcacaaaataaagattgtcaatttctttattttaatccaacggcatttcctaactgcaggaggcccaggaccgttggcagaaattttgtgttgattagagcctcgggccatgggaagtgcaggtactgtggccacaaagttcgtcgcccaatccctggctgaccccacaagcaggactggtacagatcccaccctcaggggtcttcctacacagagaaacataatcacacaggtgactggaacggagccaaggatggtggtgttcctcctagggatttactaacactgccagcaactcaagaactagccagccgggagtttcctagtaagtgaaactgacttggttctgcttcctttcatgaaaacctttgtgaaaatgagcccaataaggggtccgaacctttataaagcacacgaccccccagagtggaccgggccctggccgactccatcagccgaagcttgagatcttggatggtctggatggtcttgaccgtgtgtgattgatgcagttaacaaagcaggaaattaacagagcttactctgagacaccagggaagtggcttgttctttcttggggttactttgagtggatgctggcacactgcttgttttcttatagatacctttctattgggctgtgtttattcaataaggaaatgcagttaacatttttttaacaagtaaaccatgggttatgaggtgttccgagtttggttaagggaaaaacaaattgacaaattagctctttcttaagtgagtattgcgaaacagtgagaaatagaatgcctgtcgtaccgtcattaaaaatttatctgggtgttgacagctttttgttaaatgtaagacattcagatcctgtccacccagcatatgaaaaaaccaaaccaaaccaaaccgaaaaacaaaatgcaacacaaaagcttctttccatttccccccaaaagcaagacaatttttcttaaactggggctttctccctaatgaattgccatgattttgttttctctaacatagtttaatatctttaagacagaacgaatatcaactctttttattttattttttgagacggagtctcactctgtcgcccagcctggagtgcagtggcacaaactccgctcaccgcaacctccacctcccaggttcaagtgattctcgtgcctcagcccccccgagtagctgtgattacaggtgtgcaccaccacgcccagctaatttttgtgtttttagtagagacagggtttcaccatgttggccaggctggtttcaaactcctgacctcaagcaatccacccccttcggcctcccaaagtggtgggattacaggtgtgagccgccgtgcctggcctccactctttttagacacctttgttgagttgttgttttgggcctgtaagtttctctggcttattaccactttcccctcctgtttctagggaagaaatgattatttagataaaaaataatttgataaaaggtagcagatgataccaaaggtaaatctttgtcttgaagagcctgaagctgtgagcattggtaaagccgtgggctgcagtgagggaagggccggcttggagccgccctcagcctagcctccgggtgttacctggagcccttgctgtcaggacggcctgtcacttctcgcccttctcctgccctgccaagcctgtcccttcctgtgttgtgacaacttttttttttaaacaagtatttctacagctccattattttgagattcttggaagaaagatactatgtaaatgaaaattaaaaataaaattctcgctggagggaatcgtatacatgtaacgtttttgatgaggtttggaaaagactttcgttctccctctggaactgggaacattctgtggctcccgtcaccatttctgtgtcactctgaaaggtgtggcagataatggtgaaacatattattttctgtttttcaccaagtagttgacccagaacttgaacccatgcagtcctgggtccagtgaattatttctgctgcatacagttctgctgtgtcctcgccgagagcgtagtcagcaaccgcccggagaataccaacctttcaaaagaaaaagggctggagtccccaacatacagagattacagctaaaattacgaccagagctgttaatcaaatcccatcttcccttcctattcacacagtagagatgttataagtcatacaggtttgagacagaaaattgagagcagaggagcatgtgtttaaaccagcatagaaacattcatttaccagaattgctttatttcagccgtatctcaactcgttgcttacacagtaacgcatgctgtctcgtcactcagccaagtgggagacaagttcaggtttctgctccatgggatccaggagcctgcagtcaccgatgagcctggaggaccacaaggtggccagggcccttggagagctgtgctgcggaatcgtaaagctaccatccggagctggccgtcccagagggaaggcttggtcatctcttcccctccacctggtcctcagccctggtcccgcagtttgtcatcccgcagtttgtcagcatcgatgtgggactgggagaggaaggatattgccagttatggttgaatgtcattgtcaggggagtaagaagtagtttgtgattgttttacgtggctctgtgttggtatataattatgctgtcatcttaaaacgccctgataccttaatgaaatctgtgtgtgtgtgtgtgtgtgtgtgtgtgtgtgtgtgtgtgtgtgtgcgcgcgcgcgcgcagttagtcttcggggctgcttattgtgtgtgagagccaagtctttctaacacacgagctgagtgcgtcgtcttttacttgtttcaaaactgcccattcgaaacaggtcgcaatccattataaatgcagctgccagattaatcttcccgaaccattgatttcatcatgccattcctctccttaaacatccatggtggcccacttaggcacagagtggagaccacatttcttagggtagcagacagagttcctgatagtcctttctgccccacctaaaccttttccatcccagctagaatgactccagaatcttgcttatttgggggagctccctcctcctccctctgtacatctgagcttcaagcctacttcagaatttttttgtttttttttgtttttgattttttgaggcagggtcttgctctgttgccggctggagtgcagtggtgagatcatagttcactgaagccttgacctcccgggctcaagcaatccttccacctcagcctcccgggtagctgggactataggcatgcaccaccacgcctggctgatttttccatttttttttttagagacagggttttgccctgttccccaggctggtcttgagctcctgggctccagtaatcctccctccttggtctcctaaagtactgggattatagaggtgaaccactgcgcccggccttcaagcctatttcatgcattcctttttcttttgcccctgtgtgcccggcagtagtgatggagacttaaaatagcagtggcttcccgcctagagggcggacaggactggcaggacgaggctgggatggatggagcagtgtgtctgagcctctgggaaggctgcaggaagggcttggaaggcgggtcggggagtgggcagggggcgcccactgagttctgtgtgcttggggaggtgtgggagacagggctttccagcagaacagtcgtggggtggccggggatctctagggctcccctctgagcttgggttccctccctctgccctgattatcccttgggtacccaccacaccatcgccacacaggcccccactctctgccttgtgtgtccgatttaggactcattcagctggttaagaatgcaaaattaattcttttttttaatatagtgaaagcaggtagattatattaaaatggctgtgttttgaaagctactgataggtacacctatggaatagatgtttctttttcagtcccattaattatctttctgtgcaaagtaacataagtgttactttttcagtcccattaattatctttctttgcaaagtaacataagtgttggttaaaatacagttgacccttgaacaacatggggattaggggctgatcccttctgctgttccccctaccccacctgcacagtcaaaaatccacgtataactttttttctcccctcccctccttctcttctcttctcttctcttctcttctcttctcttctcttctcttcttttcttttcttttcctttcccttccttttcagacggggtctcattctgtcacccaggttagagtgcagtgacataatcatagctgactgcagcctggacatccggggctcaagcagtcctcccacatcagcctcccagtagctggaactacagacactcaccagcatgcctggctaatttttaatttttttctttttttagagacagggtcttgctttgttgcccaggctggtcttgagctcctgggttcaagtaatcttcctgtcccagcctcctaaagagctgagattataggcatgagccaccaggcccacataaaacttttcattccccaaaaacttaattactaatagcctaccgctgatgggaagccttaccgataacataaacagttgcttaacatgtattttgtatgttaatatgtgtgatatactgtattcttagaatgaagtaagctaaagaaaatgttattaagaaagttgtaaggaagagagaatatatttactaatcagaatatagaatggatcatcataaaggtcctcattctctttgccttcatgttgaggagtctgaggaggaagaggaggcgttggtcttgttgtttcaaggtggtggagatggaagggctggagcaggtggagggggagtcgggagaagcaggcccaattggtataacttgttttttttttttttttttttgagatgggagttttaccctgtcacccaggctggagtgcggtggcggatctcgactcactgcaaccttcgcctcccaggttcaagtgattctcctgcctcagcctcctgagtagctgggactacaggcacccactactacacccagctaatttttatagtagagatgggtttcaccgtgttggccaggttggtctcagaattcctgacctcagatgatctgtccgcttcggcctcccaaagtgctgggatgacgggtgggagccaccatacccagccccactcaatgtcacttttattatggaaaaaaaaaaatctgcgtgtaagtggccccacacagttcaaacctgtgttgttcaagagtcagctatatgtataattgtacctgtggcacatagaacacaaaaagatccacatttttaaaaacagcattgggcagaacaattttttgacagaggtctgtttgactctgctgacagcctgagtgggaggaaacttccccatatgaacgaacggggaaagtgcatgttgtagttctcaaaacccaaaaaaatctaagagaaacccagcagcaagaaacacagaggtttgggtgtcagcatcggaggaatgtctcacgtctgccttgtcccccagaccccgtccctgtgtctgggcaaaggcacgccccgctccaggtcggccccatttcagagcagtggccctcataggctttgtgcctcttcatttagtctaagaaactacctaggatatttttgtagaggtgacatcactgtctggctgcagaagcatttgcttggatttggggaagtgagggctgggagaggagggcttagagaggcaggatgcccaggcccattgcgggtggctgatggggggtgggcttagcatctgcagggacagggtggagggagaggagccaccccaggcagggggaaggggtgtgccccctttgggatatggaggttttggggggctggtgggagggaattccaggggtcgagcccctggggaaaaggaggctttaaggtcagtggaaaagtgggtgccaaagtctggaagatgagttgaaacctggagtttgaagcccggggaggattttgttggagtgttggctggtgctggagagttttgcatcacttggggtggggtggggtgaagaattaacttgaactggcacagcacccctttgtcttgactttccctgttctggagtgaggacggcttgatgtttcagcaaaaggagtagtggagagggagaatatttgcttgtaggattgggttccacataccatatctacagttttacatccactggtgacaagacaggagcttttctatttttgttttgtatttttatgtttttgtgcactaacagtaatggtttcatgggaacagatggcggacggacacgggcttaggctcttggtttatttcatgttacttgcatgacagccctatggagctgcgtacctgccataggtgagaagccgggagttggggttacatcccggactttgctgagctccaggagtgtttttcctcccgacctgcgctgttccctagacaaccctcagccgaagcagtggggtcatcgggtgactcagaagggacctcttctcaggggccgcccaagatgagcttggctgggtctgggtcacttagcagtgagcagcaggggatggaaatggggccggggtgggtgggcttgaggggagcactttctcagggacgcctggctggagccttgccctggcaagacttcaaactcagccccgcagagaagggtcatctgatgatagaatcacggctgccccatcattcccattagcaaacttcatctgatagttggggtacggttgtggctcaggctgtaaggagcccccctgttgcattactcactatcctcagatgccccatccttgcctgaagcaagtttgttgggacagttttggggaactgttaggagagaggcctggtcatggggccggaggggcccagaggagcggcctgccctatctgtgggcggttcggtgagtgctagatggggtgtctctttacaagactttcctctgagatgctggggctatgcccctgggtgctggggagtgaattgcccgtagatactgatacctgtacttaaccctgtgacggtcaagaccagatccccactctccaagcccctgggaaactggttgatgtagcccctgcagtgataccgcactcaaatccatgcagatcccctgacatggtcggggcagcacccaccacgcaggcttctgttctgagctacatgggatgttgggcgtgtgttttctaagagactgatttcataagacatgtaccagtggccgactggcctgaaacagcctggtcacagcgacatccctgagatcttagcttcttttcctcggggaattatcattggactggaaaactgaggttttgggccactctggattcagatgcttttgttgttgttgttttgagacagggtcttgatctgttgtggactgcagtggtgggatcatagctctctgcaaccgcgaactcccaggctcaagtgatcctcctgcctcagcctcctttgtagctgggaccacaggtgtgccccaccatgcctggctaattttttttacatatttttatacaaacagggtcttagtatgttggccaggctggtctcaaactcctaggctcaagtgatcctcctgcctcagcctcccaaagtgccgggattatataagcgtgagccaccacgcctggcccagataactcttgcctgcctgatttttttataatgatgcactttgttttgttaaaaatttataaatttaaagacaaaatatgcaaaaatgtgccctggtctcagaaataacacagcacattcgagtgaagttgttggcagttccgtgtgttttggggtgattcatttttttcataggttgttggggccgtgcatccattcgtgttctgagcacactccatggtacctgatgactcgaatggatcctgttcaagcccctgggttacccaaagaaatatacttctggcctgctggttggtcagagaatgcaggacacattggggtatcgcgaggtgtccaatggcagcgggttgggtgtgtctgctgtgtgaacagggcaggggtttgggaagatggactctggctgtcttgctccaaagacttccttaggctgttgttgagcatttattgagtgtctcctgtgtgccgggcagcattctagcatagggattgagtgaccagacagtagggaatccttgcccttaaggaactgacattcttttttttttttcgagatggagtcttgctttgtcgtccaggctaaagtgcagtggtgcaatctcggctcactgcaacctctgcttcctgggttcaagtgattctcctgtctcagcctcctgaatggttgggattacaggtgtgcaccaccacgccgggctaattttctgtatttttagtagaggcggggttttgccatgttggcctggctggtctcgaactcctgacctcaggtgatccacccacgtcagcctcccaaagtgctgggattacagccgtgagccaccatgcctggccggaactgacattcttgcaagggggatggaagacaaaggcaaggaataagtgagtgcccagtggcctgggaacagacggagcaggactgatacacaaagccccacagagtcacttctgtcttctgaaggccctgagaaataactttattattattattattattatttagagacagagtctcgctctgtcgcccaggctccagtacagtggtgtgattatagctcactgcagctttgacctcccgggctcaagctatcctcccacctcaggttcccgagtagctggaattacaggcatgcgccaccatgccaggctaacttttttgtattttttgtagagatgggggggtctcactgtgttgcccaggctggtcttgaactcctggcctcaggcgatcctcctgccttagcctccgaaagtgctgggattccaggcctgagctgccatgcctagccccgatttttaaactgaagagggatggttcagttgttggggtgtgtcttagaggatccttctggaagccccacatggaaggcgggctagagtgaggagggaggggtgataatggaaccaggagggtgtggtggtcatggcccagtgagaggatgccaggctgtggccgtgccagactcagtgtgcctggccctggcatttcaggcagggaccactgaggggtgatgggagagatggggctgggtgagtggcatttccacaggcatccagaggggtgcgaaaaactgaggttggggaacagcaggggcagggaacagcctgtggagggtgtggtcatcagtgtcccccaccgacatggcacatccagcgagcccactgtgtccccagcacctgcggtgcagggggctggcaccttcaggggcgggcttcgtgcagacgtccacccagtcagtccccacaggtttatcaaacacaagtggggcgacaggacccacacttcggcgttggacgtgactcacgcggggagttggcttggagttcctttattcatccctatttgctttctgtctgtaatcctttgtaattccctggtttcatgatgtaattctaatggaaataaacccgaacctttcaaaattatgtaattaattgcattcagcttcaatgacaatgactaattatagtgatacctggtggcaaggcaggtacctactgctggggggctcctgtctgcttggtactaggactgccacttctgggcgcgtcggagcggctgcacagggggtcagctggctgtcctgtggcctgctccggtgcctctggtccccatcttaccaggagcagcgccatggccatgcagggaggggccggagagggaggtggtgtgcagggaggagctgcttaggggtgggagggcttggacttgtctgcaggttaaagagaagtcttgctgggaaagtaacttcggggctggttccctgagagcattcttatctgattcatgtattttcctgagaaaaagggaggagggtgcgttcgactgaacgtgaagcgttcaaggatcggaaaggcaagccaggtacagtggcttacacctgtaataccaacactttgggaggctgaggcaggaggatcacttgagagcccaggagttcaagaccagcctgggcagcacagtgagaccccatctctacagaaaaaaaaaaagaaaagaaaagaaattagcccagcatggtggctcacacctgtgataccaatactttaggaggtcaaggcggaaggattgcttgagcccagttgttcaagaccagcatgggcaacagtgagaccctgtctctacagaaaaaaaaaaaagaaagaaattagctgagcgtgatggtgcacacctgtgatcctggctgctcaggaggctgaggcaggaggatcgcttgagcccaggagttggaagctgcagtgacgtatgacagtgccattccactccagcctgggtgacagagcaagaggaagactctgtctcttaaaaaaaaaaaaaaaaaaaaaaaagaatccaaaagcaagcttatggagaagggagaaagtgcgacagtcacctcggggcgtgggagagcagaagatggatgtcaggttaaaaaccattactgtgctgtagtatttccaggaggccaagtccagggctctgggacctgtacactgcggcatcagaccctaaaacagagctctcaggttttcgccttcccaggaagtctgcatcctttttgcagactggttttattctgtgttaggaggaggcgattttgctaagaaatcttcactgcaattttcccccccaaatcagggcacttggcatctccttctaacggggggtgcagagtctgtcctagaatgggacgcacagtgttcacacgagtaccgagtaggtggggtgctgggccggcccctctgatcctgtcctaccctgtgcagccacgtgcctttccttatccccagacttctgttgtcacgattcttccagggaagaatctggaagtggaatccacagggcggtgcccagggatggcctttagtgcctagtgttctgtttcagagagaggcctcttatttatttgaaaagctgattgtttcttttttttttttttttttttttttttgagatggagtctccctctgttgcccaggctggagtgcagtggcactatctcagcccactgcaacctccgcctcctgggttcaagcgattctcccgcctcagcctcccgagtagctgggactacagacacccgccaccacgcccagctaatttttgtatttttagtagagatggggtttcgccatgttgcccaggctggtctggaactcctgacctcaggtgatctacctgccttggcctcccaaatgctgggattacaggcatgagccaccacgcccagccttattttctatttttaaagaaagagcaagactgaaaacatttgcatgcacagtgagttttaaaaagttcctttttttagagaggaccaagaaggtgcagagtactcttgaaaagaaattttttttctgttctaaacgtgccgcttgttgccctggtgcagagagcagttcttttgatacaatacctccgtcccgtaacttttttttaaagctaaaattcatataatgtaacatttacctttccaaagtttaaaattctggccaggcctgtaatcccagcactttgggatgctgaagcgggcagaccacttgaagccagaagtttgagatcagcctggccaacatggcaaaaccctgtccctactaaaaatacaaaaattagccaggtgtggtgagcgcttgtaatcccagctactcaggaggctgaggcaggagaatctcttgaacccgggaggcagaggttgcggtgagccaagatctcgccactgcactccagcctgggtgacagagcgagactctgtgtcataaataaataaataaataaataaataaataaataaagtttaaaatccataggtgtttggtatactcacaatgtcgtgcagccatcaccacgatctagttccaaaacgtttccaacaccccgacaagaaactcccatacctgtcagcagttaccatttgtcctccctcctgtacccccggcaccccgtaaccattcatctattctctgcatctattctctgcctccatgcgtctcgggaatcatggattacgtgaccttcgtgctgtggcttctctcacgtagcacagtgtttgcggggctcacccacattgactcatgcacctgtctgggccgcattcttttttatggctgaataatattccctggtatgggcataccaggttttgtgtatcctttcatcagctagtaaacattcgagctgtttccacttttttggccattgtgaataacgctgctgtgaacattcgtgtacaaatgtttgtatgaatgcagttttccattttcttaggtgcaattgccaggtcatatgtagtcactctgggctttgctttttgagtctgttgtattttatttatttatttttttatttttgtgggtgcgtatatttatggggtacatgagatgttttgatacaggcatgcaattcataataatcacattgtggagaatggggtatccatccatcacagatttattctttgtgttgccaacagtccaattatacacttttagttattttatttgtttgtttattttgagttggagtttcactgttgttgcccaggctggagtgcaatggcgcgatcttggctcactgcaatctccatctcccgggttcaagcgattctcctgcctcagcctcctgagtagctgggactacagctgccatgcctggctaatttttgtatttttagtagagacgaggtttcaccatgttggccaagctggtctcgaattcctgacctcaggtgacccacccacctggcctcccaaagtgctgggattacaggcgcgagccaccgcgcccagttgcttttagttactttaaaatgtacgattaaattatgatcgactatagtcaccctgttgtgctgtcaaatactaggccttattcattgattctatttttttgtagccattagccgtcgctacctccctgcattgttgcattttggcctcttatgtgtaagtcccgtttgttctccagaatgctgcttttaacacccagcccgttccatctctctctcttctgccttgggtgtcatgctgtctcttcctcagatttctcctggggtgcaggtgctcccctgcgaaccactgctgtgcacaaagtgattttgtgctcaggcaggtggatcgcttgagcccaggagtttgaaaccaccctgggcaatacagtgagaccccatctctacaaaaaaaatggctgttgtgcagtttgggatgagagttggttgcccccgcggtcctcccttcccccaaccccacctgccctccttgctcagcaacaagggacccccttcactggactatgaagcctgagggttgtctaaatcaatccttggccaggcgcagtggctcatgcctgtaatcccaacactttgggaggccaaggcgggtgcatcacctgaggtcaggagttcgagaccagcctggccaaggctctgagagcagcgagactccttctcaaaaaaaaaaaaaaaaaaaaaagaatcctggctgttccttccccacggccagtgggcattacactttgttttggctggagaaaccgggagtgcccgttgtctgcctggagacatgcctgtgggagaagaggctgcccccacctgctaccatcatcccagcatgggtgcggtggggggcaggggagacagagtaaaaatcgcagaggacatggggcagaaagatggaaggaacctgggccctcgatggctctgagtgagtcagtcctgcagtgccccgtccccatttttctgtggcctgggaaagtcaaatttcctcatcctttgtagttggccattgtgttatttggagatggaagagcattctgaaacaagccactataatgaaaatccaggtcgtagcaacttgccgtgcacggctttggcttggcatggacttacagtgacatctttgagatgcacttgtccggggtgcaggtatatttgagagtgtgaggaggacatatgtcctctaagctctgttttctaaaggcagcagaattccatttgccaagccagatgtccctcaatacgttagatcccaccaataaaacattaagcaattacaatggttaatattcactaaagtataattagaagctggcgtaaattgtgaatgaaattggcgggttccatacgttacagtgaaataccaaatctttttttagttgtgtatgtgtatctcagtgagtctgtcaactcagatgagtgaatcttacctcctctgtggatagaaacgagctcaatttcaactcagttcactataattttaaatgtttaagaacatcttgccagttgttctatcatgttaaagttactgaaatctggctgggtggagtggctcatgcctgtaatcccaggactttgggaggctgaggcgggtggattgcttgagcccaggagttcaagaccagcctgggcaacatagtgagaccctctctacaaaaaaaatccaaaagtagctgggcatcatggtgacgcacacctgtgttcccagctactcaggaggctgaggtgggaggatcacttgaagccgggaggtcgaaggtgcagggagccatgatcgtgacactgcattccagcctgggtgacagaacgagaccctgtcaaaaaaaaaaaaaaaaaaaaaaaaaaaaaaggataccaaaattctcaagtcaaattataagggttttaacattcccatttctacaccacgtgcaagaaaaacaaaatccttgttttctgcctgcctttatggtccgttctcattttcagccccctttcctcattctactctattaattatgcctttatatggatgcaaacttgtaaaatatgtggcctattttgtgtgtatacgtggttttaattcataagtgtggcactgtgccctaaatctttttctccttccttttcactcgtcacatttttttttttttttaaatgacacagagtctcgctctgtcgcccaggctggagtgcagtggcacaatctcggctcactgcaacctacgcctcctggatttaagtgattctcttgccccagcctcctgagtagctgggactacaggcgcctgccaccatgcccggctaatttttatatgtttagtagagacgggctttcaccatgttggctaggctggtcttgaactcctgatctcaggtgatcaacccacctcagcctcccaaagtgctgggattacaggcgtgagccacctcacctgggctcactcaccacaatttttgagatcttgttgtctatgtcattccctgtgaattttgtttgttatgacagccgtattgaaatccatcttcagggccaggcgcggtagctcacgcctgttatcccagcaccttgggaggccgaggtgggtggatcacctgagatcaggagttcaagaccagcctgaccaacatggtgaaacccccgtctctactaaaatacaaaaaattagcagggcttggtggcgcatgcctgtagtcctagttacttggaaggctgagacaggagaatcgcttgaacctgggaggtagaggttgcagtgagccgagattgtgccattgcactccagctttggcaacaaaagtaaaacgctgtctcaaaaaaaaaaaatccaccttcagaattgacctgtgttaatctgtccagactgccgtaacagaataccatagatggggtggcttcacatatttacacaacacatatttatctctcatagttctggaggctggaaagtccatgatccgggtacgggccaacgtggttcctggtgcgggcccttttcctggcttgcagatggcctcgtttttgctgtgttgccacatagcagagagtgtgcgcaggcaggcaagccagctctctggtatctcttgttttaagtacactaatcccatcatgagggctttaccctagtgacctcatctcatccttacgaccttccaaaggccacacctccaagtaccatcatattggaggctggggcttcaatgtatgaatttgaggggggtggacaacacagttcagtccgtagcagcaccctagctcacacgtccatttccctggggctggtcaccctcggtggtatctgacccccctcccccaagcccctccatgcacagcactgctaggaacgttcttacacacgtcccttaccagtatccaggaaaagccttgctggatccagccagatagtggtccttctttcacgaagcacctccagatcgcttcccagcgtggctgccccacttactcccccacccacagtcgtgagagtttctttcccccacaatctcatccgtgctttgtggagatattttttgccagtgagatggttttaaagtggtacttcagtgttgtgtcattttctctgatcaccagggaagtcgatctttgcgataagcctcattttatacttgtcagcttttcagatttcgccttttgtaaattgtctggtcatatattttgtcctctttttttttttctaaatggtttaccatctttttgttgatttgcaagagctccttgtatgtttcacatgcgaataatttgtcaattttctttcttttttttgttttttgagacagagtttgctcttgttgcccaggctggagtacaatggcgcggtcttggctcacttcagcctctgccacctgggttcaagcgattctcctggctcagcctccccagtagctgggattacaggcatgcgccaccacacctggctaatttttgtatttttagtacagatggggtttcaccatgttggtcaggctgatctcaaactcctgacctcaggtgatccgtctgcctcggcctctcaaagtgctgggattagaggcgtaagccaccacgctggccgttatagttttttaaattaaaaaaatttaaaattctaatagattattgtggtatagaggaaacaattggtttttgttgatttcgaagctgggaagcttgctgttaatatttttactaattaacttgattctgttgcattttctctggaaataatatatgcaaaataatgcaagtttttatttgttcctttccttctgattcttacagtggagtgacttgctggctagaatctgaagtactcaattacatggtggtggtgatagaggctgcccttttctttctctttctaccaaaggagatttttggtagaaggtttaaccaggtgaaggaactaccttaactcccctttccatagtttttagagaattttttttggtataaataggcgttatcctcttgcaaatacttttccttaaaacctattcatgtccatgcagtttttatcctttagtttatgaatgtggtaaattacattgattgactatatgatgttgaatcatttattgctttctgggataaactcttcttcctcttgtattttaaaaatattgttggatttgatatacagttttcaaatctgtgttattaagtgaaattggcctataattttcttattcagttggaattgaggtttactagtctcatgaaatgggtaaacattgtgttggaacaatttatataacatgaggattatctgtatcttaaaatttgatagctcacctttgaaaccatcagggcctgagactttagaatggtggctgggaggcatttaacatttcactttttttgtttttggtctattgaggttttctattctttattttattttattattattattatttttttttgagacggagtcttgctctatcgcccaggctggagtgcagtggcgcgatctcagctcactgcaacctctgcctcccgggttcacaccattttcctgccttagcctctcgagtagctgggactacaggtgcccgccaccacgcctggctaattttttgtatttttaatagagacggggtttcaccgtgttaggcaggatggtctcgatctcctgactttgtgatccgcccgcctcggcctcccaaagtgctgggattacaggcgtgagccaccacgcccggcaggttttctattcttatgccaattttggcattttataattttctaaaaatgttttcattttatcttggttttaaaacttaactgttctgtgatcatagtattttttttttgtaaatctgttttgaactctagctgtctcccatttctacattctgtatttctgaatttatttacaactcttctctttatttttagttgtacatagaggtttgtttatcttactgatcttgaaaaaacagcttttggtcttgttaatcttgccttttttttatgtggcttatttctcaccattattttactttctgagtgcattttttttctaacttatttttttgaatactcagctttttatttcattttatttatttatttatttatttatttttgagacagcctcactctgtcacccaggctggaaggcagtggtgtgatcttggctcactgcagcctctgcctcccgggttcaagtgatcctcccacctcagtctcctgagtagctgggagtataggcgtccctgccaccacgcccagctgagttttgtatttttagtagagacagggtttcaccttgttggacaggctggtcttgaactcctgaccttgcatgagccacccacctcagcctcccaaagtgctgggattacaggcatgagccaccactcctggccttgaatactcagctttttaaattggggttctttcttgttttggataaatctattcaaaactgtaacatttctgctaagtattattttagctgtgttccacaaattttgacatgtagtgctttcatttttattcattttgtaattttctattcattttgtaatttcccttataattttctctttaacctaagggttatttaatactgtatattttttagatttttgacacttttctttaatggcttttaaaaatgttgttgctgtcatttttatcacatatggtcagagaacatagttcacataatcctggttctttggaatctatgaggtcttctttttggtgtcttgcacatggtggatttttgtgaattttccatatgtgctcaaaaagaatgtgttttttgagtagaaaaaaacgttatatatgcagtatacaagtgacatataccatatagtcatacagtttgtttggtatatggaatacattcatgtcactgtttctttgataattttcttcccatagttttttttcttctttctttctttgagacagagtctcgctgcatcacccaggctggcacgcagtggcgtgatctctgctcactgcaacctctgcctcccaggatcaagcaattcttgtgcctcagcctcccaagaagcgagaattacaggagcacatcaccatgcccagctaattttcctagttttagtagactgggtttcattatgttgctcaggctggtctttaactcccggactcaagtgatcctcttgcctcagcctcccaaagtgttgggattacaggtgtgagccaccatgctgggccttcctacagtttttgacagttgttacattatattaggttaaggctgtactgttacattgcatgtatgatcatgatcatgatctttagattttcctgatgtattggttttttttttttgatgtctgtatagactcttattatgtttttcatgttaaattctattcgttttgacattaaaattattctattttttttttttttttttgagacagagtctctctctgtcgcccaggctggagtgcagtggcgcgatctcggctcactccacctcccgggttcacaccattctcctgcctcagcctcctgagtagctgggactacaggcgcccaccaccacacccagctaattttttgtattttttagtacagacggagtttcaccgtgttagccaggatggtctcgatctcctgacctcatgatccgcccatctcagcctcccaaagtgctgggattacaggcgtgagccaccgtgcctggcctattctcctattttttttgtttgtttttggtttccatttgtttgatgttgctttttctctttaattatttccaatccatatcattttgctttcattgcatttgttgcagatctgtgatgtaagatcttgtttttaaaacccaggttgagaatctttgataagtgaatttagctgagacacatttctggtagttgtgttatattaggatttctgccatcttattttgtgttttctgcttaccattacttatttttaaaaaagcttttcttgtaatgctttgtagggttgaactttcttctgctggattttaaagttgtgcaatctattttattcttctagagctcagaattgtgattattcttaaaattattaagagccacttatgtgattagtttttcctatccatttcttttttttttcttttagaatataattgatttttaaattcacttacttgtttcaactgcctggagtagggattcctgtcagtttctaaaggctattaatatctttgtctttctgtcaaacaagttaagtgatagggacctcgtttcctcccttcagcctgttgagatcgtttagattctaggataatggtgccatataggactgtggccctcgggtgtgcagaatcagcgtcaccaggtattagactttcagtattaatgttctctccttgctagaatatgtgaacaaatgtgaaccttttgaaagagccaatccttcaggatggatccagaatggctaaccaggcctaaatctaaaatagagccagacggccatttgcagattggaagtcacacacttagtctgagttccctgaaaacctgcacctttcttaagtttgggactttcagagctcacctgacccaactagtctgagttcaccagccctggccaatcagggctcagctgtgtcaaccaatcagccctaagcacgtttgaatcattcataaagaaatctgactgggaacctgggtgggcactgttgctattaacaaacaccgtccccctccccgcccccgcccccgcccccaaccccagcagcttctgtttacacggaaggctgcatctccctggtttgcacgttgtccacgggaataaagtctctttcctccagattccttttcagagcacttttgttaagtattttaaatgatagtgcatttaaagaagtctttctgtgataaacttcctgagactttaaagtctgagtctatacttattccaccctcatatttaagtgatacattagctggatgtaaaattgtaggtcaaaattctttttcttcaacacccagattattcccctgttttctttttgcacagagagtcacggttgagaaatatgaggacagtgtgattcttactgctttggagggaagtctggtttttctttttatccctgtcttcattcttttttctttttatccttgtcatcgttcttcttttttctttttgtttttccgagacagtctctctctctgtcgcccaggctggagtgcagcagcacgatcttggctcactgcaacctccgcctcccgggttcaagtgattcttgtgcctcagccttttgagtagctgggattacaggcgcctgcccccatgcccggctaatttttgtatttttagtagagacagggtttcaccacgttggccaggctggtctcgaactcctgacctcaagttatccacccactttggcctcccaaagtgctgggattacaggcgtgagccactgcgcctggcctgtctttattctttaatgtcaccaaaatgtatctaaataatgatttcttccacctacctatcttatttggcactttactgaccctttgattctgatgtcttatttttttcttttattctagggagttctcatacatttatctctccaaatattttctctcctctctttattttttcttctttctaggacacccactgtacaggtgtcaacccttcttctgttgtccatctctctctctctctctttttgaaatggagatggggtctcactatgttgcccactctggtctcaaactcctgggctcaagcagtcctcctgcctcagccttccataatgctggaattacatgtgcgagcccccatgcctgacctgttctctgtatctcttaacattagcctcattctcaaacatgaagagagtagccttggtgtagactggccacgaattggcgattgttgagatgggcgattggtagtgagggtacccatgaattggcgattgttgagacaggcgatgggtggtgaggtactgtttgtatgtatttgaaatactgtctgtgtatagctccagttgaattacctcctactgagacccactggccttagcctgtggtgtggggatgaaagtggggagggaatagaggaggaggctggctagataggcttggggctggctgccaggacagttaacatgacttacatggcacatcgtacatttctatggaacagtgctgttccgatttagccccttgctaggcaaagtgattcatgaaccagcaacagtggtatcacctgggagctcgttagaaatgcaggatctggccgagcacagaggcttatgcctataatccccgcactttgggaggctgaggccggaggaccacttgagttcaagaccagcctggccaacgtggtaaaaccccatctctactaaaaatacaaaattagccagatgcagtggcacatgcatgtaatcccagctacttgggaggctgaggcaggggaatcgcttgaccccaggagtcggagatttcagtgagccgagattgcaccactgcactccagcctgggtgacaaagggagactccatctaaaaaaaaaaaagaaaaaatgcaggctctcaggccccaccccaggcctcctgagacagaatctgcatttttatgagattgtcaggtgaatcatatgcacatgaatgtttgcacattaaatgagcactggtctggatcctttaaaaaggaatgattggttttatttaattcatattttaatagagtgactcctcccttatcttccaagttgagctctcccagcatagatggcccagctgccagggctgatgcccatagtctgtgcataaacaggggagttcccgagcccttttccaagccgcttttaaatgcaactcctttttttttttttgagataggctgttgctccattgcccaggcaggagtgcagtggtgcaatcctagctcactgcagcctcgacctcctgggatcaagcgatcctcccaccacagcctcccacctaagccccctgagtagctgggactacaggtgtgtgccaccacacccagctgattttattttttgtattttttgtaaaggcgatgttgttcaggctggtcttgaactctttggcctcagcgattctcccacctcagcttcccaaagtgctaggattgccagcgggagccaccctacccagccgaactcctttcttacacgtagttctgacagtatcgatcatccactcttcaaggtgctaatacattaaaacagcaaattggaagtaggccaaggaggtgctagtggcagccccacggacagtagcaattaagaccagttgctagcttgatagtgggagaccagaaagactaaaaataattgcaggctgtgttggtctggtatggatgctgacttcctgacatgtagctaggtggagtggctcatgctgtaatcccagcactttgggaatccaaagtgagacgataacttgaggccaggaattcaagagcagcctgggcaacatagcaagaccctgtctctacaaaaaaatttaaaaaattaaaaaaaattagctgacatggtggcacgcacctgtaagtctcagctactgaggaggccgagatgggaggatcgctggagcccaggagttcgcggctgcagcaagctgtcattctaccactgcactctaggttgggcaacagagcaaggtcctatccctaaagaaatgacaaaataaacagtcaaccacctggtggagaaggtagtattttcaccaacgctgtagcaaatgtcaaggccaagacaaacacttgtttggaaaatttagttttggggaaactcctctcctctagtgtgctggattcatgatatattgttacctggaaatggcagccctcagtggataagaacctggggttttggagatgacccatgtttggcggcacctgatccctatcagcagccatgcgtcccactgtctaggcagtggccaagggtgctctgtcttggacggcagacagcacatctgatttggaatttttgttccagcacttcttagctgtgtgactttgggcactgctgaacctgcttcctccgtgaaacagccagtgataaaactatttactgtgtagaggattctgtgagactcaacgtatggcagtgcctgatgtactattctaaatttatttttatttttattttagagatggggtcttgctgtgttgcccaggctggtcttgaacccctggcctcaggtgatcctctggcctcagcctcccaaagtgctttttcattttctcctcaaaatgagaaagtaaagtgttatggtgttggcagctcacccatagaaactgctttaaaggccaggcatggtggctcatgcctgtaatcccagcactttgggaggccaaggcaggcagatcacctgagatcaggagttcaagaccagcctggccaacgtggtgaaacccatctctacaaaaataagctgggcatgatggcgggtgcctgtaatcccagctactcaggaggctgaggcgggagaatcacttgaacccgggagccagaggttgcagtgagccaagatcacgccattgcactccagcctgggcaacagagcaagactcaaaaaaaaaaaaaaaaaaaaaaaagaaaagaaaaaataaactgctttatattaaaagaaaaataatggtcataatctggccttaggggctatagcatcaatggtgaggcctagatcgcccaggtcactgggtgtgtattgacgttgtttacatgttttatttcttttatgctttttcccagagattgatttttttttctcccttatgtgattcaaaatatctgcttacacgttaaacccagctcagttggcataatgtctttttaaggcacaagccagcttcctgggtgtgagcagcttccacatcaaatgttcagtgggcaaatgaaacatgtgagtcacacaacacttggcacctctgtggcttttaatatttggtggcaaacttcctaccgcgaggagaaaattttcaaagtggaagtcctttcagatccagatggcaaaagaatttgttgggcgagggatcttgattcttaatgttgaggggactaggaatgtttgaattttctcccccttgtattttcccagcctggtaggcctccatgggggccaaatttagttgcgaatttgcccacttttgtgcagagtgaggctccatctatggaatgtgcttaaccataaggatcagaaaaatttctagtagctttgttaagtgcacagcaaacagaagacaaagtgtggccgggtgcggtggtttatgcctgtagtgcaagcacttagggaggcagagatgggaggattgttgagcccaggatttcaagacccagcctgggcaacatagcaagacccccttctccaggaaacggaaaaaaaaaaagagtttgaaaaaagtgtgtagactaactgaacacttgcaaggcaattttttttttttttgactgtctggagagcttgggttccatgaacacaatacagctcttgttccacgtgacttacaagttgggccccgggttttgttttcttggccgagatcttgaagactgtctccaagtaggtgtttcttccttggcagcaggtttggccagttatgtagtcagccctgtccttctctgaagggtgggtagttgagttgggggtatgagaggggtgacagtggatcatcttagctttttttctatttcacgtcattgttcatggatacaagtgcaggtttgtgacataggtaaacttttgtcatgggggtttgttgtacagattacgtcatcacccaggtattaagcccagtatccattagtttttttttttttttagttatttctcctgatcctctccctctttccacccttcactctccaaaaggccccagtgtgtttttcccccctctctgtgtccatgtgttctcattgtttagctcccacttataagtgagaacatgcagtatttggttttctattcctgagttagtttgcaaaggataatggcctccagctccatccatgtccctgcaaaggacgtgacctctttcttttttctggctgcatagtattctgtggtgtgtatgcgccatgttttctttatccagtccattattgatgggcatttacattgattctatgtctttgctattgtgaatagtgctgcagtgaacatacatatgcatttatctttatgatagaatgattgatattcttctgggcctatactcagtcatgagattgctggatcgaatggtatttctgtcttcaggtctttgaggaatcatcacactgtcttctataatggctgaactaatttacactcccaccaaccgtgtatataagtgttcccttttctccacaaccttgccagcatctgttactttttgactttttaataatagctattctgaccggtatgagacagtatctcattgtctcatgcaattttttttttttttttttttttttttgacagggtctcactctgtcgcccaggctggagtgcagtggcgcgatctagatcttggctcactgcaacctccgcttctgggttcaagctattcttctgcctcagcatccctagtagctgggattataggaatgtgccaccatgcttgtctaatttttgtatttttagtagagatggggtttcaccatcttggccaggctggtctcaaactcctgacctcaggtgatccgcctgccttggcctcccaaagtgctgggattacaagtgtgagccaccatgcctggtttatttcattttaaaatgcaatttttctgaaggtagtcattgtttttgcatgttttcttttcttcaaaacatttttcatttgttaatcaacattttataaggcttaatattaaaaaagaaccaaccccaccccacttctccccactctcatttcctacacccaagagcagccctggttttctttttctttctttctttcttttttttttttttttttttgagacagggtctctctttgttgtccaggctggaattgccgtggtgcgatcatggctcgctgcagccttgaccaggtataggaaatgagagcactgtgcccggctaattgttgtattttttgtagagatggcatctcaccatgttacccaggtggtctcgaactcctgggctcaagcaatcctcccgcctccgcctcccaaaaagctgggattacaggcatgagccattgtgcccagccagcccctggttttctaagtagcaggcttataccacttgtctttgatatttcagtgttaggtgttgacttactgatgtgttttatgagacatggatgaggattctggcctcagaaaaggctgcctacgcctctctctttctcagaatagtcacatttcacctgtaattccagtgctttggaaggccgagacaaaaggatcaccggaggccaggagctcttgactagcctcggcaacattgcaaaactctgtctctaccaaaataattaaaaataaaaaaattatccaggtgtggtggtgtgcacctgtaagtcccagctacatgggtagctggggtgggaggattgcttaagctggggaggtcaaggatgcagtgagctatgaccacacccctgtactccagcctgggtgacagagcgagagtctgtctcttagaaaataacaaataaatacatttttaaaagcatagtcatacttctctttttggctcaatcaattttcaaatatacagtgtttccatagctatgactttgtaaatattagtattctttgtacactacttaatgtatgcctaaactctcctccagcaacatagatctcttaaaatatggaaggccatcagtgaggtagggtttcatctttcttggtgacagcccttcttggcccccctattctgcccagctgggtctcccattcctcatcatctcgggggcttcctcccatctctctccagctttggatctcctgactcgtgtacgccatggctttgttcttcctggttaacctctcatttgctgcggggatgttctccgattgcttcctgatagatggtgaccatatctgcgatccgacaagatcttctttattctgtcctcaaatcccaggttggaaaacacttcctgcagaatgggaaagatttggctccccgttttctagcatccgtcaagggcgttctgcatttttgtcctttgttctaacaccttgtagagttgtctttttcttcttcttctcagatttcatgaacacgcaccttggcgtggttcttatggcctggtctctgttttctgtcttccagagttgcgttagtcagatgttgcactttgtggcctgatctgctaatttttcttacttttcatttgtctttcttctctcttttttttttttcttttgagacagcgtctcactctgtcacccaggccagagtgtggtggcaccatcatggctctctgcaacctccactgcttgggctcaagggatcctcctgcctcagcctccccagtagctaggactacaggtgcacaccaccacgcctggctaattttttaagtattttatagagatagggtctcactatgttgcccggactggccttgaactcctggtctcaagcagtcctcccaccttggcctcccaaagtgctgtgattacaggcgtgagccaccgcacccagccttacctttcactttcatgcctctgtcttttttgatgtgttttctgcaggaatttctcaaccttccagtctttctaaacttttatgcatcttattttagatttccaagttttcttattctttgaacatttttatggtctgttctttcatggaagcatcatcttttatattcctggctacattcatcacagttttttaaaaagtttttggccaggcaaggtggctcatgcctgtaatcccagcactttgggaggccaaggtgggctgattgcttgagcccaggagtttgagaccaacctgggcaacatggcaaaaccctgtctctactaaaaagacaacaattagctgggcatcgtggcacacacctgtagtcccagctacttgggtagccgaggtgggaggatggcttgaacactgaaggtggaggttgcagtgagccgagatcacaccactgtactccagcctgggcgacagagcaagaacctgttgcaacaaataaaaaaattttaaaaaagttttcttctgttctctgcgttggaattttttttttttttttttttttttttgagatgaggtttcactcttgttgcccatgctggagtgcaatggagtgatcttggttcactgcaacctccacctcctgggttcaagcatttctcctgtctctgcctcccaagtagctgggattataggcacatgccaccatgcctggctagttttttgtatttttagtagggacagggtttcatcatgttgcccaggctggtcttgaactcctgacctcaggtgatccacctgcctcgtcctcccaaagtgctgggattacaggcatgagccactgtgcttggcctctgcattgaattcttactgtctttactttgtaaaatgttttttaaaaatatataaacagttgcataccatgcattttggttgcaaaatataatacagtgaacacccaggaaccctccacccaaccctaagaatcagagctttgccagtcaattgcatccacctgtatattcctcccacctcctattccctgccccctctctgggacaggtgacccatcctaagtagtgtatttattatgctcttgcctaaaataatgtattttctgcacccatgaatagatgcttaagtagtatatgattactcttccctgagtttgagctctataaaaatggtattattctgcaatagacttgcaggatttgccttttgaacttgagttactgcaacattatctgtgaggttgtctgttataactgtggtccatttattttctctgatgcttaaacccagttgtgcggctagacccaaatttctttagcctttgtcctgtcgctttgtctgttttcctcgtttccctctttgttttggtcccagttagaggtttcctcaaatgcctagtgacgtgttgttgtttgttcatatatcagagcatggcaatagaaagggtgtgtgtgtgtgtgtgtgtgtgtgtgtgtgtgtgtgtcggggtaaagagcagttttggtggcccccaccgtaagtaattaacccaggtgtctagttgcggggagcccccaggcatgggtatcagtggctcattctcttggactggtcagtttctctagcaaggagccctcagtgttcctgctgggtggtgcagttgggaactgttagtctgaccacctgtcttctaggcaccaggctggggcatgtgctgggatattcactcagccccctgcccatggtcatgagaaaccccagtcttctgcccacagtgcaggagggacctgaccgcagtggcattttgcacacctgcccggcctccaagtcctgcagctcgaatgagcttgcttgctgcaggcggcctgctccatcttgaggcttgtctggaaaggcggcttcggctttccagtgctttccagcgctttccagcttctgagattttgggggcttttcatttgttcttgctttcctgtcctctttgtcaggtgagtttatacctttctgttccaaagcaaacaggatcgtctgccatgttgaactggatgtcggacaattctgaaatgtgtgcatggggcaaggctgtgtgtgatgataccagtttcataggaaacacttcggttttggttttgtctttcaaagtcatcttttgtgagcgccttctagccgggctgccagcgggtaacatatgattaacacaagtttggagtctgtctgcagagcaactttatgaaatgctcagaaagccagtctcctaagcataggagcctgtttggtggtgatgggatgaggaagcagtgggggctttggcaccagaggcctgggctcaaatcctgcctccatcatttaggggttgggcatctccattcccttatctctgggtggcgagaacttcctaagttcttagtgtttggaagggaccccctccataaagtgaggtgcctcttggccactgctcagccagtgggggctgttcctaacagttgcctcctccgattgctggagtaagaaatgacaccctgtctcccatttctgtggcaccccattctcaacagtgatggttctgcctgtttttagtcacacacacctgcacacttcaaaggactaaaaatggactcagttttctttctttttttttctttttgagatgaagtctcactctatcacccaggctggagtgcagtggcatcatcttggctcactgcaacctccgcctcctgggttcaagcgattcttgtgcctcagcctcccaagtagctgggactacaggcatgtgccaccacacccagctaattttgtatttttagtagaggtggggtttcaccaggctggtctcaaactcctgacctcaagtgatcctcccacctcagcctcccgaagtgctgggatgacaggtgtgagccacctcgcccggcctggactcaatttggattgcaatgccccacaatggtgacctccctcttctctgttaatgcatcctcttccctcttgcttaaaaatttccccagtgccgtggcatcttacctcctgctgaagtgtgtgctgatgctttgctgggggctggaccccgtcccttggagcctggcccaggccctgcctcccagtgaaaccctggccgcctttccaacctcagaggctctatctcctcccaaaccctgtagcccttccagttgctggtcactgacttccattaattggcccggtggccttgcctgccagggggaccatgaggtgaggggccgtgtcctccgagtggtctctttctccagggtgctggggacccaagaaatgcctggtcgtttctcataggttgataaggaaaatgaggcctaggtagggacaggcaggatttcacctgaatttacaagatgatgcaatggaagagtcttcagtatattttcacgtattttagaattgagttacaacattcattttggtactttctctgtgttctccccatgtgttaaaaagcagcttaaggccgggcgcggtggctcatgcctgtaatcccagcactttgggaggtcaaggcgggtggatcacgaggtcaggaattccagaccagcctggccaacatggtgaaaccccgtctctactaaaaatacaaaaattagctgggcgcagtggcagacgcctgtaatcccagctactcgggaggctgaggcaggggaatcgcttgaacccgagaggcggaggttgcagtgagccaagattgtgccattgcactccagcctgggcggtagaaggagtttccagctcaaaaaaaaaaaaaaaaatgcagcttaagtgctggtttagcgcctgtaatcccagcacgttgggaggctgaggcgggaggatcacttgagcccaggagtttgtgactagcctgggcaacatagcaagaacccgtctgtacaaaaaataagaaaaattggccaggtgtggtggcgtgcatctgtagtctcagctccttgggggctgaggctgaaggatcgcttgagtccagcaggaggtcaaggctgcagtgagctatgatcaagccattgcactccagtctgggtgacagagtgagaccctgtctcaaaaaaaaaaaaaaaaaaaaaaaaggaaacaagaaagaaaaaagcagctaaattctgctggaagtgtgcagtaaagcacaagttttcagccatcaacgcagggagccgttaatcacgacccataataaccagaatgttattccacggttgcggtttgtttatttcatcagagttgcgtcttcacctatttccctccctactcttaattgtttatccaagttagtgttttccattctttcactgaaggctctaaaaatggtcccatcaagaagtctggtagataatggaagacgaagtggactttacagaaagatgaattttcttccctagagctggaaaacccttcagcgtgtcatgcgttccccagccaggacagacaaagccacgcaatctgtttcctgcaggcccagaggggaaggcttcctccttgtggttagtgacttcaaaagctgtcctcactagagcaagtccaactcttcctctagttctgatgacttcacggcagccaactgagctgctgaacgctgtttttttctacgcagaaaccctcccgactttcacgaggagttgacaggttttcctcttcactcgggctcccttgtcatcgttaaactgaaactgctttcttgtagccaaattctgtggtcccttttcggcctcggcctccttgacctctctgtgtccccaccttggctctcccacgcctgccagccgtaccacaggccccgggtgtgaaccctccctccgcggtcatgcagccacgcctctgctcaagctgtgcctcctcctgggcgcaccctccctctcccatccttcagcctctgaagtcctgcccagctccggttcctgtttctgttaggacgaggcccttcagatcctctccagcaggtggactctgtcctgccccgtaccacccgccgcgggccacttttgggcctgcgccatgttcctgcccttaccccgcccggtgttagcgtcacgtgggtcctgatgtcctccctctcccaggcctctgcttatctgattgggggctgtgcttgactctgaaacccgggcacctcctacagggcattttgcctgtcacaggcctagcattcaatacctatcatatttttgaaatatctgcagaaataaaaagaaataactattttcttcttcaggagttaagatgcgtggccaccaagtacttttcaatacataaaatatgttttcagcacagaaaggcctttcaccgctcttacttacatagtctgcttttggtatgatggggacggatgaaaaatgaggactgtaggcctccgaagtcagctgttttgaattaaagcagcgcacgctttgagtcaggtgaagcgaggatggggtttcacccgttgaggatgaatttgctgggttactttaaactggaactgttcttttcagaaatgagtgaagcaggaagggaaagacggagcttgtctggctgggtcggatgaccccctttgccaggccgtcacccctctaggttgagttagctcagaataacttagctgtgctatagctttgcataattgcaaggagctttgtttcgttttattttgcagggaatttttttccccccttagctcttcctcctggtgtatttgtagaaatcagcttcatcatggtcatttaacagtaagggctgggggtggtggctcacgcctgtaatcccagcactttgggaggccgaagtgggaggatcacttgaggtcaggagttcaagaccagcctggccaacatggtgaaaccccgtctctactaaaaatacaaaaattagccgaatgtggtggcacgcacctgtactcccagctcctcgggaggctgaggcaggagaatcacttgaacccaggaggcggaggttacagtgagccaagatggtgccactgcactccaacctgggcaacagagcgagactctgtctcaaaaaaagagaaaacagaacatactatttttgttgtttctgaggagtagggtttcttaccagggaacctgctttaaaaaaatgcagtatgtagattccttaagaataaagttaagcagcagctaaccaagcacatggctaaaaacccggccaagagcattgtagtatctggttttggggttggtggtggggatcccattttagaggccgactttggtttgtgatggttaggttttactttcttaggtctcagctcacatgtccccttctcagaggagccatcctcacccatcccttcttggtccctcccgccttccctgactttttcttcttcaatgacttatctgcacatgatcccctacttataaaacctgtgtcttccactcctctcacccgaaagaatgtttgaattctgaaaacaatgactttgttcttagcacccacaacagcaaatgctcagtgagccctatgttgagtgagttagttgtgagctgtggtggtttagtgagggtatactttggcccttagaatgcgaatgccttttttttttttttttttttttgagatggcgtcttgctctgtggcccaggctggagtgcagtggcacgatcttagctcactgcaacctccgcctcccaggttcgagagattctcctgcttcagcctcctgagtagctgggattacacacactcgctaccatgctcggctaatttttatatttttagtagagactaggtttcgccatgttggccaggctggactcaaactcctgacctcaggtgatccgcttccctcggtctcccagggaatggctgtttaatcacaagaaagtcttcccttcatgcgttgtgaaaaccagcagtattttaattgaagaaatccggtattgtttggctttctagatttggaagtaggtcaggtggctaatgattgaaaatggaccggcaaccagagggcctttggaaactctagctcgacttcaggctatagttttgtttatgcccttgtcactaaaggcactgcccatgagagctgggtttgcagtccctgctgagcctggggttgagagcagagccctagagtaactcagcaaaggcatccctccctgcacctgagctgggggagaggcggcttatgattaactcagcgatgtctcaaatgccatttctagaggctgaacacattaacttttaaaaaatgatttaaaaattaccaattgaccgtatccggggctgaacctgcgtgattcagcttcttttaaaaatatcttttctcaacaaattgcttccttaacattttaatttgttgatcatcaaggaagcttgccaaatattagctgttcttttccatttcctaccgcctcaagcttcccgtatttggcctatttcagtggagctgtaaggtcactccctatttttcttcccaaataactgtatttattactgtcaggtattggcgggtttgatccagctgtcatcagaacgtttggaaataccgttttttgccagaatgctgatttaatgatctcatactgacatggcttgttctctctgcagacttgataacttgttgaatatgttccctcttcttattgagcaatggtgctttttgaaaatttttcccagccagaaggcttcatgggtagtatctttaagatcctagcagaaggttgcttttctctctctctctctctcagtcctttctttttctcttttctttgcttctttccttctttcctttttctttcttttctttcttctctttctttctcttttcttggcttatttccttctttcctttgtctttctttgctccttccttccttccttttcttccttcccctttctttttccttccctccctccctccctaccttcctcccttccttccttcctctctctttctgtctctctgtctctgcctgctttttcctctctctctctgtctctccccccttctcccctctcctatcctcttcttccttttttctttttttggaaggcccagattagtagcagagactctccttgaaggggatagatgcattgtcgctgtttggtattttgaacagattcttaagaaaatgttttcctggtggaagatttcagacacacatgaggtgagaataatgaaccctgtgtgctgcccccagcatgatcagttccaaactattggcctgtctagtttcatctccgcccctgcctactcctggaattttgaaaaggacatcatattattttctccataaatatttcagtatgtatctctaaaagataatgtcacttcgaaaaaaatacctaataccacgatcacacctaaaacataaatgaacaatatgaaggatgagtttctgctgtgtggcatggcagaatgatgctctgtggggtcccaggggagaggtgagctaagttcagtgtgtcacctgctgtcacctgccatcacctgtcccagggcctggggctagccactgctcttttgtgagcctcagtttcttcatctataaaactagaggattgtactagtctgtctgtctttccttcctttcctccctttcctgtcctgtcctgtcctttcctttcctttatcctctctctcttttatctccccttcctcccttccttccttccttccttccttccttccttccttccttccttccttccctccttcccctctcttcttctctctttcctttttttaaagagacagagtcttgttgtgtcacccaggctggagtgcagtggtgcagccatagctcactgcagccttgacctggtagtctcaagtgatcctcccacctcagcctgtgaggttccgggaacacaggtgggcaacaccatgcctggctaatttttaaattttttgtagagacaggctagtcttgaactggcctcaagcgatcctcttgcctcaggcccccaaagtgccgggtttataggctgagccactgcacccggcctgcactagttttttttgtctctagaaatctgcatctctgaatgtgttaggtcctgacctgctttagaacggatctcagccaccctgctccttcgaacccacatttctgccccgtgtctgctggtcgcaggaattggcacattttcctttagctgcgcccaccagtccttgcacgcatactcctggtcacttttttaatgtctggcagatggtttcaagtgcaatggcgtctctgcgtaatagttgattctctaaagaacagagtctactaagtggaagctgcgtttccacatttagcagttagctgttaagagccagtaacaggtgcaaatttgcaacccgttttttccccaatcttttggaatggaaatggttcagtcatttgaatttaacaaactgcctgcccggcatgcactgcagatgctgggctgcaaagctggttttggtgctggttggccccctgggtgcccctgtctactgagggtgggacaggcggaggactgggggctcagtgctgcagaggcacatgtagggtggggtggggtggggtggagaagaagtcctgaccagtcctgatttggtggtgctggtgcttatgggctagtgagatttctgcatgcccaggctggctggtagccatgtgtcagtcactcataatcccagtaccagagttatcatcacccctaacttttttttttttttgagacggagcctcactctgtggcccaggctggagtgcggtggcacgatctcggcttactgcaacctccacctcccggagtctccctctgtggcccaggctggagtgcagtggcacaatctcggctcactacaacctccacctcccgggttcaagcgattctcctgcctcagcctcccacgtagctgggattacaggcgcctgccaccatgcccggcaaatttttatatttttaatagagatggggtttcaccatgttggccaggctggtctcaaactcctgacctcatatgattcgcccaccttggcctcccaaagtgttggggttacaggcatgagccactgtgcccggccacccctaatgttttgatttatttcctttgaatttttttttctctgaataaatggattgatgatatctattgacatagtcagaaactcaagaaacatctatggagcatctagccatggagcagacactcctgttggtctcgggggtgtgtggcgggaaggtcagagtccttctagtcctccaagagcttccagtctggtgggtccctagaatataatacattgtgtgttgtcgtaggcgggacttgcacgctgtgcagttggctttacggttgacaccaggccaccagtggcctcctccgcctgcccttccagcctgcggttgtccttcagctgctgcctgtgaaatgtgatcctttccataagtccccagcacagagactgggaaggcagtttctaagaaggcccttctgttgggctggctcagaacctgccccctttcctctgacttgcctataaaaaggtgggtttttcctcctgcctataaaaaggtgggatttcacactgacataatttacatcgagggacatattaaacctggtgtaatttgcaagtgtgccctgaacacgtttcatcatcaggctcgttgtggagaccacggtgtccctttccttcccatcgtaagtccccggtgtgtgtgtgtgtgtggaaagtttagagctcccaaagtttagagctcagagaggataaagacccgtattactaaacttatcaggaaaatgtggcttcagattattttttttcacagcaataattgcatttcatgtattttttttttttacttattacagaaaatttcaaatatatacccaaacagaagaagatcatgaatgcttttgtgtccatgactcagcttcaataataattatttacttgtcgctggccttgtcttatctgtaactttctcatcgctcacccgacttaaattttgaaacaaatcccagacatcatatcttttgccatccacagatacatcagtgtgtatctctaaaagagaaggactttgcaaaaagtacaaccacaataccattagcacaccctcgaaaaatgacaaagattcatcaatatcagctatccaatatcaaactgccactttcccacaaatgtcataattaaaaaaaaatttgtttcaatcagaacaagaaaatccaagtgagattcaagagtcccgctgggactggttcatgtgtctttgtcttttgagagttcttttttttttttttcttcttttttttttgagatggagtctccttctgtcgcccaggctggagtgcagtggcatgatcttggctcactgcaacctctgcctcttgagttaaagcgattctcctgcctcagcctcccgagtagctgggattataggcatgtgccaccatacccagctaatttttatatttttagtagagacgaggtttcgccatgttggccaggcttgtctcaaactcctggccttaagtgatccacccgcctcggcctcccacagtgtggggattacaggtgtgagccactgcgcccagccagggctctttttatattgcaaaactgaaactctgcacccattaaacaataacactccatttcttccccaccatgccctggcaaccatgattccactttgtctctatgcctttgaccactctaggtccctcgtctaagtggaatcatacagtattgtctttctgtgactggctcagttcacttagcacagtgtcaaagttcctccatgtcgtagcttgtgtcagaatttcctttctttctaaggctgaacaatattccgtggtgtgtgtataccccattttgtgtattcattcatcaatcagtggatgcttgcgttgcttctaccatttggctgtggtgacactgtgtgaactctggtgtgtatatatctcttcaagacccagttttcgtttcttttgagtttatacccaaaagtggaattctgtttgggttgcaccattttaaattcccaccaatggtgcacaagggttccaatttctccacagcctcgccagcatttgtcattttctggattgtttttttttttttggagacaggatctcactgtgttgcccaggctggagtgcagtggcacaatcatggctcactggatccttgacctcctaggctcaatcaatccatccacctcagcctcctgagtagctgggactataggtgtgcaccaccacaccccgctaatttttatatttttttgtagagatggcgtcttgctgtgttgcccaggttggtcttgaactcctgagctcaagcgatcctgctgccttggtctcccaaagtgctggggttataggggtgagccaccatgcctagcctggatttttttcttttttaatggtagacatcttagtgggtttaaggtggtatctcattgtggttttgatttgcatttccctaatagatagttatttttatttttatttaaagggagtctcgctctgtcgcccaggctggggtgcaggggtgctatcttggctcactgcaacctctgcctcctaggttcaagcaattctcctgtctcagcctcccgagtagctgggactacaggcgcacaccaccatgcccagctaatttttatatttttagtagagatgaggtttcaccatattggtcagactggtctcgaactcctgacctcaggtgatccacctgccttggcctcccaaagggctgggattacaggcatgagccactgtgcccagcctaatagatagttatttttaatacttatttaagcttcatgtttcaactgggggtgcttcatgatatattaatatttaatgagccaccttaattatttctaaaaaagtaaaaaagggaaatactatctcccacatggtattattcatgatgtatatcttttttttaaatgttttgtagaatcggaccaaaatcagaccaatcctctcagtttatcacaaagataccaaaacccagagagaatgaggctttgccttagcctcggccctgggagatagaagaggagcctggggcctgggttccccctgccgtggctgcccagtccttccgctgacaccatttcgaggtccccttgtggaacttctgtgggaggccaggtgcacaaagtccggtttgttgagctacagatgcccgccagcagttgctgttattatagactggttgttctgatttgtcaagaaacccagaacaactgtttttcttctttgcagtggatgtgtgtgcacatgaccttttgagaacatatttcctgatgtggtggaggcactgatgttcgtgcagactagctaagttaaatcttcatttctttcagctgaaattgcctggctgctcctttaagaagtgcactgtgtggagttatcatgtttctcatgctgttaaatgtttactggcaatcctgtctactttagcgtattgttgtcaaatgacaagggagtcccctgtcagagagcaatgacacagcctgtacttttgggggcagccagcgtccgagcgtttccacattcattcttacgcagttggtaggctcaggatgtttgtgaacgccgaagggtgtgcgtgcaccctggagtgtggagatactagcatgctatttaatgatggccaccacgggacgtgcgcactcattcattaagctaacgttttatggtttgttgagtgaaagcaggcacaatggtaggtagtgggtactggagcaaatgactgcaccggccctcatgggacttccatttcagtggattcaggggaaagcagcacgtgtttttgagagaccttggcaacgcaggcgaccttgacgtcgaccaaaagaagagagatttggaatgcttgttttacagcctccggtcaaaaaaaatcatatgggaccctttattgcagactggaacatttatttcaaggtctcaaattaaactagaggaggccaggcatggtggctcacacctgtaatcccagcatgttgggaggctgaggtgggaggattgcttgagcccaggaatttgagacctgtttgggcaacatagtgagaccccaatctctactaaaaaaataaaaattaggctgggcatggtggctcacgcctgtaattgctgcactttgggaggctgaggtgggtggatcacttgaggccaggggttcgagaccagcttggccaacatggcgacaccccatctctacttaaaaaaaaaacaaaacaaaaattagctgagtgtggtagtgcacgcctgtatttccagctacttgggaggctgaggaactagaatctcgaacctgggaggtaaaggttgcggtgagccgggattgcaccactgcactccagcctgggtgactgagtgagacgctgtctcaacaagaacaaaaactaaccagttgtggtagcacttgcctgtagtaccagctatttgggaggctgaggtgggaggatcacttgagcacaggagttggaggctgcagtgagtcatgatcataccgtggcattccagcctgggtgacagagcaagaccctgtctcttaaaaaaaagttaaactagagtagataaatgagcaggcatagttgtttgctgatcattcaccgttgagacaatgaacagctcgttaaataaattgttggtaacaatgaaatcaggagaatttcaatcctgagtcagtgtacacaatacaaggcacaaaacgttgagttaaaggtggttctactttgccctctaagcattttattgacttcaaaacctacaaaggcggcgccatggcatataggaatataggaataaggcatataggaataagaagtttcaaaaagtttcataaaagttgtatttggggctgggcatggtggctcacgcctgtaatccctgcgctttgggaggccaaggtgggtggatcacttgaggtcaggagttcgagaccagcctggccaacatggcgaaacgccatctctactaaaaatacaaaaactagccgggcgtggtggtgcctgtaatcccacctacccgggaggctgaggcaggagaatggcttgaacctcggaggcggaggctgcagtgagctgagattgtgccactgcactccagcctgggagacagagcaagactctgtcttgaaaaaatagaagtaaaaaaagagagagagaaaagcaaattacctgaaatccagaaagatcagagaagggaaggaatggctggagtaagtgttgatcagcggacacactcaagggtttcgtaatgtgctcgccctgccccaggcatcaagggaggtgctcactctgtgcactctgaatcccaccaggggcccacctgccaccctgttctcacctgtgaccactcacggcagccacaagaggcacaggtgttaggtctgccccagccacaacacctcagcacgtggtgtgtggcttcaaccaggtcaccgtgggcacactgggaggggagggcttctgtgcggccacgcttaataaacagtctgcctgggaaactgagcatccaaagtgccctctgaaggagcgggatgctgctgcccgtggtggctccgtcacacgcattctggaaggtacctcccggtaagcaacctgatgtttcatctgtcactgttgatgcatctccatgttagagaattaagcatatggaagcaaaacacctcaggaatacagaacgcattcatgatcaccacggaaaatcaaatcaactcaaagtccaaatgcaactttttttttttttctgagacagggtcttgctgtgttgcccaggctggagtgcagtggcacgatctcagctcttagtagagatggggtttcaccatgttggccaggctggtcttgaactcctgacttcaagtgatctgcccgccttggcctcctaaagtgctgggattacaagtatgagccactgtgcctggcctctcttttttaaaaaaaatagagatgaggtctcgctatgttacccaggctggtctcaaactcccggcctcaagcgatcctcttgccttcacctcccaaagtgctttgattacaggcgagcttttctctttttaagccaacttgtgagtagaatcattcacttgtgcctttagctgttgtctctgtgttgaggaatccagagtccagtccttctagacttatctggggacccgagtttccttctgtagagttaaaacctgttgcatccatccccagtccctttacggcacctgtgtaggcctgtagtggagctggcttttgtcctttgctgtccctggctgagccttggcctcatcttgggccagcgcctcctcccctgggctgctgtgatgtgttggcatttcctgggtagagtcttgtacttgctgttttctcctgtctcagtcttttcccccagggacctggcatgtctgtgtgttggggaccctttgctcatcttacacactgaggacaggcaccttagcgcttggtgccctgggatggaacagccactggacagccagccctgtgccctgtgtccactgcaaacctgatcctgttttttggagcccttcacttggcaatgagaccttcatgggtggggttactgaagcaggagttggtttaagttaaataccatcagccgcaaagctcagaatggatgatgaagtgctttaggggttgacagggcagagctggctgtagggagtgatggagagaggctcccaggaggggaaccctctgacgtgggagttaaaggactggggccatttgtcgtggggggatgggagcagtggcttgggaagggacagaacgggagcaagagggccttgcgcactgatgcttttgaggactgaatctgaacgggagagtggggagagggctggaaacctgggcgagaacaggagaggagaggcccctggatgccagcagagctgtaggcatgatctgggccatgccctgggagacgcttccgcaggagatggtgcggctggggtggagacttcctggcttccgagggcgggcgagggggcaaagggcctggggcatggacttgggcaggtagcaaaggccagaaggagtgggagtcattccacctgggatgtgggaatggctggtgggggcaggtagggggagaccaggatgagccccatgtgcgcgtgacctgtggcagaggggctgtgtcagagccccggctggcgagaggagcatcactgtgtccagaggacgcggtgcctttcagaccccttgagtaagagacagagtgggtctgtcctgtctaggctgagttttcattgcccagcacagtgcctggcacacagtaggtgcttaataaacacgtggactgaacacaagaggttgaggggaaaggtcggaattggccacaggtctcctaatgcctggcatgtgcgtcaacgcatctctgaggatggaatttaaaggcaagagctggaggcccagggctgaggctgtggggtgagcacagcatttgcggggcgcgggaagggagtggctggtggggcgggggagggaaaccagcacgttagaaggtcagccaaggtcaggcggccagcagggcgggaggaggcgttggtgtgcacacgcggggagcctccgtgtcctcaggacaccatggaagacggcaggacacacgtgcgagccacagcaggtgggcgggagctcacaggctgcagaggaagcgcaggggaggcgcaggggaggccaggctctggcatttcccaggaatgtaaaccccggtttcagctttccccgtggctcccctccgccaaatcttaaatcctcttgttaagacgcgctccgcccctgtgtccttatttcccaccgtggtgggcagcttgtctgccatccccttccaggtgccccgcagaaccaccacccttgggaaggcggctcctcgtgccccccctcttgtgccttccctccccagtgccttttctgaccccctcctgagaccgcctccctgtgggccatttgagcacctgtagctttccatccggtgtcttcacccctttgctctttgtagctgtctcaccccgctgcagcttgtgaggccatgcaggccctgatgtttagtgttttttttgtttttttttttttttttaaagacagcatctccctttgtcacccagaccgttgtacagtggcaccatcctagctcactgcagcctcaaccttctgggcataagcaatcctcccacctcagactcctgagtatctaggactacaggctcttgcacccaccacaccgggctaatttttgtattttgttgttgttgttgttttgtggagacagtgtttcaccatgttgctcagtctggtttcgaactcctggcctcaagcaattcacccgccttggcctcttaagtaccgggattacaggcatgagacattccctaatgtttagttttaaagagggggtggtgctatttatctccaggctcaaagcagggcattctttccttaggatctgcgatactccagtcaaggctgtttcttttctgccttttgtaaaactcttgtctagaaattaatggatgagggaagctagggactcttctcagattatttcttgtgaaaacctcaagagtctgaatttacagggaaatcttacaattagctcgatgtggattacagagcggcaaacaaccttaagtggtagagctggttctgcaagatttttccaaccctttgtggtctagttttcatttttccccttttaaagttgttttcagctaaagctgtgaggacagtatagagttttgccttgtaaaattggtagtgagtaattttagaatagatgcttatgaagtctgtaaataaatagtaaggcgcctcgcctagttccacgcacatgtcagtttcgtaactatctccccaagctgagctcacctgccagtgccttggatggacctagccaccaggggctgcagatgagtaggagagcgggtgttgcccagagcagggcggacacccctgttccctgtcatgttttcttctcaaaacctgctgcaggccattggagagcattcctgttgctctctgcacccctctttctgaagcattttactgtgtgatcctagcatccgtggttcaggagatcctgctacattttcctgactgccttgctctgcccgggaatacctggcttatcagcagaatacaggcctctgcttaactgaatttggtcctgtagtgaggactaagaagtgatgtactcagttacatgataattctaaaaaataaaaaaaagcctttttttttttttgttaacacccatcatagtggcagaatcttaagtctgcatgtagagggggttggcagggcagtagaagcagggggccctgtgtcctgttggtagaagagtgagcagaatggccactggagagccacttggtggaggtgcctgcagcacagcgagcagcctccttcccagatgaagcatgcatcttagaggcgaccttgggcacgtgcacagtgagacaggtacaggagtgtctgttgtcatatattccatgggagtgcaagagccggaaggatgcagatgtgcatgggtggtgctggcccccatcaggtggcatctagtagaagtaagtaagggtggtggtggcatgtgtggtcaccttgccagcgtcgcctcgcacaggaaagggctgttgaaaatttgtgggccgggtgccgtggctctcgcctgtaatcccagttctttgggaggccaaggcgggtggatcacctgaggtcaggagttcaagaccaccctggccaagttggtgaaaccccgtctctactaaaaattaaaaaattgactgggcatggcagtgtgtgcctgtaatcccagctacttgggaggctgaggcaggagaatcgcttgaaccccggaagtggaggttgcagtgagccaagattgcaccactgcactccagccttggcgacagagcgagactccatccccccaaaaaaaaaaaaagaaaagaaagttgtgtgcagcgtgattctgtgagttcaagatgcaaagcaatgactttacattattaaagatctagcagacatagaaggatattttatttatttgtttatttatttttgagacagagtctctctctgttgcccagtttggagtgcagtggcatgatcttggctcactgcaacctctgcctcttgggttcaagtgattctcatgctgcagtctcccgagtagctgggattacaggcgcccatcaccacgcccggctaatttttgtatttttagtagagacggggtttcaccatgttggccaggttggtcttgaattcctgacctcaaatgatccacccaccttggcctcccaaagtgttgggattacaggcatgagccaccgcgcccggcccatagaaggatttttttggggggaaagaatctgtaaagtgattattttggaggtggagaggagaaaatgagactaaagaagatagagtgggggcttctatgattttttttttttttttaaatagatatgacaaaatgataaaatttggtaaagctatgtgttaggtacataggaatttatacttttctgtatgcgtgaaatattacgaaaaaataaagccacatacactatctgtttttgtgtgtgtatgtgtcaataggatttaggccttttttgcacttctaggttaaagttttcaagatgagggtattttttccccctctctgttagagaatactaaagttatgttggttttattttttattttatttatttacttagtttttacaatgtaccattttaatcatttgggtatcctttttaaaatctctgagcttttttattttttattttttttgagacggagtctcgctctgtcacccgggctggagtgcagtggcccgatctcagctcgctgcaacctccgcctcccaggttcaagtgattctcctgcctcagcctcccgagtagctgggattacaggcatgcactgtcatggccagttaatttttgtatttttagtagagacggggtttcaccatgttggccaggatggtcttgatctcctgaccttgtgatcctcccatctaggtctcccaaagtgctaggattacaggcgtgagccaccgcgcctggcctcagcttcttttttttttttttttttttaatttttattttaagttccatagtacatgtgcaggatgtacaggtttgttacataggtaaacgtgtgtaccatggtggtttgctgcacctaggtattaagcccagcatgcattagctatttttcctaatgctatccctccccccaccccatatgttttattttattttttatagagacagggcctcactatgttgcccaggctgatctcaaattcctggcctaaagcgatcctcccacctcagcctcccaaaatgttgggattaccaagtgtgagccaccatgcctggtattatgttggctttaattatatttgtggaagaacttctatgttctctttccttattttaaatattgggagatagatgaaacattttaggtttctctacatttgaagaagaggtatattttcttaggttcttctttttgtgagacagagtgcagtggcacgatcttggctcactgcaacctccacttcccgagttcaagcgattctcctgcctcagcctccggagtagctgggattacaggcgtgcactaccacactcggctaattttttgtatttttagtagagacagggttttgccatattggtcaggttggtctcgaactcctggcctcaggtgatccgcctgcctcagcctcccaaagtgctgggaatacaggcatgagctaccgcgtcctgccaggttctccttttgatagaataatataggtacttgcctctgtttctattcagtatcagtgaattatctacaggaaaatgaacacaggaagactgctgaagtaaagaggcccacagtgcctgcattcccttgcctcatgtagtcttagactattcaggatgctttgaaaagagtaaactgtaaatcatatttcatattctttgggccaggagtctggaatggtttcatattgcctgtgaaacaagagatgcttctcagaatgagatttctggcttaattgaattcggattattgcaggcaggatgggagtgaaatggtacattcctttcatgccagttgtggagaggatctccgtgcaggccgttgatagaataatatcctgtgcttccttggtgtctctctctgaggaaataagggcttaatatgtcctattcaattaatcctcaccgcatccttaaaggtgactggaaggcagatagtattaactccattttacttaaaaagcagcggaaacatggtgatttggaactccctgggagccctcgaacttttctctaaactccaccggtagctgaggagcaggacacacgcacagaggaaggacatatttatggcgcatcgccttggtgccaggcaccgttgggaactttttaggatcgtgatgtctttgaattctcaggacgtttctgcgaggtggtgggcggtatcatcctggtttttcagggagaagtcaagtcactggcccaggtcctcaagctggccagtgtggcccggtctgaccccgaggttctgcccgggtttctgtccctccagcctggcatcgtgaactcaggggaaacagatggggaatctgttgttgtaacaaagattctaaggatttgaagcaaaatcaacacactcagttgtagagggtaccacgtggttgataccattgaagacaattgcacctaaatgaaataatttgatggcgtggagtccagtttcagagcgtttgcatcacaccttctgacaccaggctggggggccgcctgtcccagagcatcgaggacagacaccgctgctgttagacctcattccacccctttagtggggacccaccgcgcgctggccgcaagcctattttaatttgtaacaattctgcttgatgacaggaagacgtcaaaaaggagaaatcaggctaactggggctccttgtccacttggggggcatgtctcagtgtcttgcctggggccttgtacacaccctctcttaccgggagtaaagtgaggtttagaaagattacctttgtcctgggtcattcttccttaaatcacagctaggatgcaaacccagacctctctgatgtcagtttgcaagctctttcaggtaccgtcagccacatgccaggccttcagtggggtgatgttttttgttgtttttagaaaatactgctattcactcatgggaaatagggacgagggcttagatttcagctgctttgcattagacaatgatttctcttattataagcagagctctctattaaccaaaaacacttggctgttagacatggtgtttaattgctgttagaatgtatttttgtcacactgccctataataagccaaagaactgtttgtgccaaacagtgaagggaagctaggggaggatgaaaactgtgcctgctactccacctcccttctttcgaggtcgtggtgttttgtttgctgttttagctgtggtgtgtgtgtaccactcgtacctttcacaggaggacacctcatctgaataccagtcaggacctgagacgcgttgagcccctccccacagtgcccacgggtaggtgcgccgctctctgccccttccgggagctctgctttttctacctttagagatttctttcatcctctattacgtaggcctgactttttgcctaataaaggaaaaacaaccatctatttagcactctttttttttttcccaaaatggaaatgactttctctctgatttttacaaagcaaaaaatgagagtaaagattaagaaactacaagaaattatggtgaagggagtaaagatggccatgaatcctatgactgccgatggtttggtcccaggatgcattattcagatattttctccctgtgggcttatgtaaacagaaagctaggtgagtggaagtaacacgtcaaatactgatttgtggctgggtgcggtggctcacgcctgtaatcccagcactttgggaggccgaagtgggtggatcacctgaggccaggagttcgagactagcctggccaacatggcgaaaccccatctctactaaaaataaaaaattaaccaggtgtggtggcacacgcttgtagtcccagctactctggaggctgaggcaggagagtcgcttgatcctaggaggcggaggttgcagtgagccgagatggtgccactgcgttccagcctgggcgacagattaaaaaaaaaacaaaaaaaaaacctgatttgcaacaattttgtgtcctagcctagagtttaccgtgctattgaaaatatctttcggctgggcgcgctggctcatgcctgtaatcccagcagtttgggaggccaaggcaggcggatcacgagatcaggagatcgagaccatcctggccaacatggtgaaaccctgtctccactaaaatagaaaaaattagccaggcgtggtggcacgcacctgtagtcccagctactcaggaggctgaggcaggggaatcgtttgaacctgggaggtggaggttgcagtgagttgagatcgggccactgtgctctgacctggcaacatagcaaaactccgtctaaaaaaaaaaagaaaaatgaaaaagaaaatatctttcaatgatagttaatatatatatacacacacacactgtatttgaagtgacatgttacatggttttccactatatgatttctcatatttcatcaaattgatcctcttgaactcctgacctcaagtgatctgcctgcctcggcctcccaaagtgctgagattccaggcgtgagccaccgcacccggcctctgatctttttttcatctttttcctagtttctgacctcactaccactctgcaccacgttgggatgggtatccttgtacatccgtgcagcttttctatgatttttaatgtctgattattttcttaggttaaatttctaaaagtagaagtgaacagcgtgtgcacatttttatgactttgggtacatttcattacattactttccagaaaagttggaacaattcatagcagtaactgcactgaatttcttgtattacttacctatttttaagcaagtaatataatctcttggttccaaaaacaaagcataaagaaaagtctcctatctgcctacctccccacccactgttgttgattttttggtgtgtatccttccagagtttcattatatacacagaaacaaataccagtgtcaccctcctttgtatgcacatagtctagcatgccatgcacactcttgtgcaagtggctttttattttttaaaattaacaggccaggtacagtggctcatgcctgtaaacccagcactttgggaggccaaggaaggcggatcacttgaggtcaggagtttgagatcagcctggccaacatggcaaaaccccgtctctactaaaaatacaaaaattagctgggcatggtggcgggcacgtgtaatcccagctactggggaggctgaggcaggagaatcgcttgagcccaggaggtggaggtttcagtgagccgagaccgtcccactgcactccagcctgggtgacagaacgagactctgtttccaaaataaataaataaaaattaacagtgtttcttacacttttcaaatcagtacattaaaatccctccaattgtgtgtgtgtgtgtgtgtgtgtgtgtgtgtgtgtgtgtgtgtgtgtttattaaagcgacaccattgttcaatgatatgaataggtatattttatatacttggttccattttgatagatatttgggttgcttccttgaagaatgttgtgcgtacaccgtttgacacaggtgcaagcttatctgcagggggaagccgatttgcaggactcattcctatagggagaggggccaggcccagggacttaagtgtttgtgaatttgtaggaactgccagattacccacacttagcagtttacaccccttccctccagcactggctgcagagagccctgtcctccagggccctaatgctaattctttcatgattgcactaattatatgcacaaaaggaatgcaacagaacaaaacaaaccacctggttttgtaggtgtggaagtgcacattgcagtaaggagtcaatgaaatcggttactgtgggacaggaccctcccctccccttggttattttactaacttggaataacgccacttccttgtaggaaacaggcagtgactgtcagtgagtgtgcctaggagaggggtgggtccttttagagaccaacctcgcagttagccagcaacaggctgcagcttagctagatgaaaagttagtttgagaaactgaagtcattgccgctaaggctggcaaggtgtggctggggccaagttgggggaatgtcgtagtagccggccctgtgcgcctgagcccacaattactgcgtcgctgctggggtctggcaaagctcaccttgatgcagttttgttcaaagcagtgcaatttccaagcctcaaaacagatccttttcaatacaatgtgattgtaaaaattctattaataaagagaaaaaaaagacgcaccagcggcttacaagatctttttttgtttttttttttaagagacagagtttcactgtcgccgaggctgaagtgcagtggtatgatctcggctcactgcaacctccgcctcccaggctcacacaattctcctgcctgagcctcctgagtagctgggattacaggcgcgcaccaccatgccgggccaattttgtatttttagtagagatggggtttcgccatgttggccaggctggtctcaaactcctgacctcaggtgatcctcctgcctgggcctcccaaagtgctgggattacaggcatgagccactgcacccagtcacgagatcttaaagtagaagtaactatggtatttttttcgagaattctgttagggcgagaagcccattcgtactgtgctggaaccatcctgaccctgtctgttctttgcaggaactcaaaccaatatgcctaagtagctgaaactgttgcatttcaaagccttttcaagcatatcttgaggacactgttccctgcagctgaactgaagtcttgatctgagcccaggaggagtccctggggttgtcttgttgggggtggggaagtgggaatgcttgcattcagctttgggggaccttaaccctttgccccctcccctgtccccccttcacatagctttaacatgaaagtctttctgtctgtcagatctcccctgtacaaagagtggtctactctaaaaattgctttgaaattggaatggacccctccctctcttctattttagttctagtttctagctctttaaaataatgcaacttttcgctttattgttctaaatcaatgcattctagccgttggctgtcccagttgcttccctgtggctgggagcccctctctgtggttgaggctggtcttaccattgctccagttgtcttcggccttctggggcttacttcccctgccctggaggcctgaggccagccagccagtgtggtgtgacccccctgacagtgggctctcccggctggcccagttgagggtggtcagttccttttgtggccttgccttcttgggagataaaagtggccccctgggtgccgtgcggcccgcccgcagggtccttggtggagctccagcattgattcctgcaggttcagctcctgccccaaggcagcgtccagctggctgagtggggttctcccagggtctctaagcacaggacagcctgcttctgcatgggggcgcacaggggaccgcagagtcacactcagacccttctaccacctcctgacttgtggactttggtggtgggtggcgacaaactggagtccactgggtctgtggcagagaaaggtggctttgctgggggctgggggagaggaggcgtttttggatcgcagcatataccttgtctagaattgtataaaaacctacaggaaaaggctgatttttttttaaaaaggctgtttttttaaaaacaactaaaggcacaaaaactccaagtgtgagaatatccagaatgcgtttatataatgtgcaccgttgaaaggaacattgaaaaaacaaaaaactccgaggaacaggtcattgggtttggagaagtttccttcagaaagttctcttcctgctcgttcactgtggattaaagctcgttggcaatttcggaagttcacgttcttgagactcggtgcctttggaacaatggctcacaatgaggacggtgtgcgttcccggcaagaatgagtgttgggggcttttctccttatcacccgttccccagacccctctcatcggcctcataaagaaacagatggttcatcaggaatagctcagaaatcacgttggctcctggctgtataaagagtgggaactgggatcataaacatttgaaatctcctaggaaaggacaatgattccctcaatgaaatattgatgtaaagggagcattttaaaaggcagaaatgatgaacctgattcaggttgaagctggtagtgtactttaacctttttgagaattgttaatttaaaagcaaatagaatgaaatatagactataaaagcagattaaatcatttttatgcatcctgggttttttggtgtcacgtgacaggaagagttactacaaagaagaccaggttttggaaagacggtggggttcacgtgatgaaacacaggccatgacccctttaggaattggatggaagccagccaggccaggccccccacccccaggtcctgggttggggctctgtgggcccaaggagtcctccagaaccaaattctccactaagagcaatttttaaaagagcagctgctcatcccatgtccaattagagtgagcagatgtgtaagaaacatgtctttgattgattttgggggagccccccgcagtttgatgttttgcttggaggtaggggaaacgggggctgagttacaagtattacctgtaggaataaacaattcttttgaaacatcagtagggaagaaagaaaaaaaaaggcagcttaagatttatctaaaaaggaagtggaaagttaaagttgctggagatctcattactgtctgtctcgctcaccgtaattaaaaaatgcctgaatgatcttaataacacatgattcagctgacaagcactaattgccctgtatcaggccaagagaagatgaatgttgtcaagaaaaccacaagtcagacaagctgattctctgtgagtctgacaccgtgttcccatgtacagaccagtttttactggagttcttccagcatcaaaagcagcttcttaccttcccattaattttcatcgctggcaggcccgagttgtttgcgatacactgactacctcccttgattcctcctcgctggctcaggagcttgggtctgcagacaaaatgtaaatatgtttcttgctcttatctttgtcctttttcagggaagaaatctgttcccgtccaatatgaatgccctggtgggcttgtcagtaaattacatggtatttgggaattgattttctgacgccaccgatttgtcaagaacttatcctgccttttcagcgatttgacagcacctgttaggctgtagggccatgtgattgggcagttctcctgccgagaaaaaggggactgatgactttctgtcacttgggcatccagaaacctccttgaaggtggaggttattgagggaggaggcaggagtggaaaaatgctattggtttattcctgtgcttttatagaacagccgaaccattctatggcaataaaacagaatcacagggcaaggtgcagtggctcacacctgtcatcccagtattttgggaggctgaggcaggaggatcgcttgagcccaggagtttgagaccaaccttggcaacatagtgagaccttgtctctacccaaaaataaaaaaaaaaaatcagctgggcttggtggtgcacgcctgtagtcccatctcctcgggaggctgaggtgggaggatcgcttgaggctgggaggtgggagcttgcagtgagccatgatcacaccactgcactccagcctgggcaacagagtgagatcctatctcaaaaacaaacaaacaaaaaaggaacttgtttcctagcaagaagcagatgaggctggtgaataagcataccacataagtaagtaatccactaacttagggaatttcgtgaccagtcactcagcacgccctgttgcgaaggggacggctgaccaataggatcatctcagagtcaccctcacacaacttggcttagcctagttggcaaaagtgtctcttcagagacctaccctcctggaattgaaataaaatgaaaatttgtgatgacgatcagctactgtcagtgtgacttaggtgtagaaattaaaaaagaaaaaaagaccactctaaaggcatttgtgcatgaagacacctacagaaataaagccggggtgctgttcttggtcttcattcaggctagcacctctcgtcaccttttcactttggagctcagggcctggttcactcagcaagtgagcggctcacacagtagatgctctgcacatagtagtaggtactcagaatatagcagctgttgatgtacatgtttccagaggggccaacacaggaatctgcacgtgggtccttgctttaagcccagcccctctctgtgggcgtgggatggagtcttcctttcttggtgaccggcgccctctggggtcactggaggcctggacttccccactggcccagtgaccttgtttccttgttccctgtctcgcccagccttggctgtcctgggatttgaaaatctgggataaagcctttttcgggcctctaaggccctgctggttctgcgtgttccagagagctgcacctctgggtggtgagctggcctttttggcatttgatttatgtatagccctgagtcactgggagcggatctagagtccaggccagtgactgatttcaaacgctaacactcttggctcgggctcaggtttcaagtcagcctccaaaggggatgtttgctcatttcgtcatcttcctatcacagcaattttcgtcatatggaggggtggcactcatgtaccttgatgattattattcttttaaaaaatgaagttatttatgttatggggtgagttcgtcacacagtccgaatgtggaatgttgccatccttttcatcccaatcctgccagtgatttctgtttacaatagaactattgacattgtatggggatgaaactagcatgagatagtaattgttggcttgcctgagattttcatcatatgtacacatagacaaaacctggctttagttcctaaagctattgctgtttattgtacttttattagccaatgttacagatccccgtagcatgccagaggctattaagaaatacaggggtcgggggcaggaacgaagtccctggccatggatcatgcaattgatctatagttatttttttttctttttctttaatttttttttgaaattttaaattattattattactgttttttgcgatggagtttcactcttgttgcccaggctggagtgcaatggcatgatctccccctcccaggttcaagcgattttcctgcctcagcttccggagtagctgggattataggcgcctgctaccatacctggctaatttttgtatttttagtagagatggggtttcaccatgttggccaggctggtcttgaactcttgacctcaagtgatccaccgacctcgacctcccaaagtgctgggattacaggtgtgagccaccatgcccggcccaaattattattattttttataagataggatcttatcacacaggctggactgcagtggtgcaatcatagctcactacaacttccaacttttgggctcaggtgatcctcccacctcagcctcctgagtagctgggacagcaggtacatgccaccatgccaggctaagttttaaaattttattttgctagggggtctcgctgacttgcccaggctggtcgtgaactcctggccacaagtgatcttcctgccttggcctcccaaagtgctgggattataggtgtgagccatgcttttggccaatttttagttattgtggatacataatagttgtacatattcatggagtacttgtgatgttttggtgtaagcatacaatgtgtaatgatcaagtcaaggtaattgggatatatacttatagttagcctacagtcttattgataatgttctcagaaatttctgattccagagctccttgctcctctcccataattagataacgtgtttttctgtccggtaattgctgtagtactcatttttagatggggtagggaaggccatgtgccatgttggggcctcatcccaaagaccttgtgctgtttgggacaggtaattatttaaagccccgtgtgaggtgggtgggtgttaaactcatgctctccacaccttcccagagtgcctgggaaagcaggcttctctaagaaagtggaatagcgaataggcagtgatccctgagagagatacataatgattgtcagtttcatggattacagataattccgtttaatgtcctctgtttttcctttttgcaaatttctatgcattatatagaacattgactttagcatagaaagtgctaattcttgatttggcactttaatggatatttacacagtgacaccataaacattggataaacagaggatttgttttaatgagatcttcagtgatttgaagccgtttcccccttgccttctggaatccccggctccagttctgcctggttttggtgatgctgtcacagtggagggctgactgcaggcctcgactgtgagccctcactcggccaccttttcatttcctcgctgggttccaggctctttgaagcactcgcctcctcccctccctgcatgtcctctgtagtgcctatttctgtgatttgcatatagcggaaatatttgttgaactgaattatttttacacacaagcctttcatgtggccaacattttgaggtctgtctcctttggcgggagtctgggaggaatcttccagttcactaagaagtgtttgatagcttcagggcaggcgtgccctgattggggctggatgccctgcctccatccagaggctctctggccaggaggggaatgaaccaagtgcccagattcccccctacaatgtttatgcagaggtgactgtcacctgccaatggtgacagtccaccagggaagtccagaaggcctttggattaaagctacaggagaggcaggtccccttgcagggtcagaaggggaagagagaagagagagagaaccaaaggtgggaggttcagctactcgggaggctgaggtgggaggatccctcaagcccaggaggtcaagtctgcagtgagctatgattgcaccactgctctccagcctgggcgacagagcgagaccctgtcccaaaaaataaaaaataaagatggaaagatgggaggattctccccaggaaggcccaggccgcagggtccccttgtccttaaaggccagctcagtgaggctacaggtccccttgccccagttccccgagcacagagcaggcatggcctcggacgacttcctctttgtgtctcgtggactactcaataaatattaatgttttccaaagatatcttgcccagctctccctgacgaggctgttggcttgaaggaataacaacactcgttgcactcacggaatattaagtctgtgccagggcctgttctgagctcatgacttgtgctactcggtctctccccacaagctcacagggcggatgctattttcaccgccgtttataggagaggaaactgaggcacagggtccttcagtgactggcccccatgagcaggcagcacatctggaattccagcctgtgcagcctggccccaggatccccatgcctctgtgggggacactctggaagtgacaggtgaggcacttctctggcctctctggatctcctgctggccctgaatgtgggtggttacccttttggggtgctgtcggtgcctcttagatgtctcagtgaccctacagggtctgccttccataggactgcctttttctttttttttgagacaggttctcactctcctgccaaggctggagtgcagtggcacaatctcacctcattgcaacctctgtctcctgggctcaagtgatcttcctaccccagcctcctgaatagctgggactataggtgtgcgccgccatgcccaactaatttttttttgtagtttttttggtagagatggggcttcactgtgttgcccaggctggtctcaatcttctgggttcaagtgatctgtccaccatggcttcccaaagtattgggattacaggtgtgagccactatgctcggccggcacccacctttttgtggacttttctttgttgacttggcattcggcaaggtgtaggcttttgccaccaacacgatacccgtggggagaagccccctggcccccgtgcctgccagaagaaaggcttagggtcccctgcgaggacccacacgtgcactgcatgcctggatagcccatgccagcctcactgaggctggatttagttcctgagtatgttatggagaagtgcccagagcagggaccgcaggcacaaggtgggcctggcctttggaggaggctgggcacggccacctgctcctcctctctcccatgggcaggttggccttgttgccattggaaactcttgagagcccacgggtgttttctggccatgtgacctaaatgggaggcttgctgaagggtagatgctgcttcaccagcaacaagaggagcccccagacctcagccacaggatggcccccaccctgctgagcccccactcttcgctccctgctcagcagagcaacacataccattgcccaaaggatggaccaggcacagcgtggggcccaatagcaaatgttctgacgaaggaggtcagtgccggacactgctgggcgttgttgagtcctgggctggcagggacagttttgcagggacggtttggaaggggctttgctggggagggggtctctaggaggggcagcccctgaatagggcagccgagttgctgtgactgcatcttcctttctttccgatgggggcaaaactcactcttctttttaaccattctctgttatctgtttttcttttcttttgaaactttttttttctttctttttttttagaaagaggatcttgctctgttgccaggctacagtgcagtggtgtgattatagttcactgaagtcttgatctcctgggctcaagcagtcctcctacctcagcctcctgagtagctgggactacaagtgtgagccaccatgcctggataatttttattttatttttttagagatagggtcttgctatgttgcccaggctggtcttgaactcctggcctcaggtgatcctcctgcctcggcctcccaaagtgctgggattacagacatgagccactgcacccggccatgtcctctttttctgattcgggaggataagggctccccatgacactggcatcagcattgggagcatttccgtgaccccagggctgctgatacaccctgtggacagggcaggacccacagctaagtcagtaaagcaccatcctctgggagtggctgtcatacgacatttcttgcttttaggaccattggactgaaaaaccaaatcctgccactggatctggtgatgacggtgacatttttttttttttttttttttgtttagaagcttatgattcatcggatctcttttggtttacggaaagcccagatgtcgtggtccctctgcgtgcccactccaggagaacgcattcaatgtcaaggaaccctgtagtgtgcaaagttggatttagggatttcccgaataaagctcactgagggtcaatgagttccataaacattattgaggccgggtgtggtggctcacgcctgtaatctcagcactttgtgaggctgaggtggggggatcacctgaggtcagaagttccagaccagccctgccaacatggcgaaaccccgtctctactaaaaatacaaaaatctgggtgtggtggcacattcctgtaattccagctactcgggaggctgaggcaggagaatctcttgaacccaggagacggaggttgtagtgagccgagatcgtgccactgcactccagcctgggtgacagagtgaggctccgtctccaaaaaaaaagaaaaaaaaattattgaatgtcttccttgtacctgacactgtgctttatcccatttaattccactggataatatgttaaattcagacttgttcgtagatttatatacatgtacatatccctcttaatacattggtttattctgtttctccatgttcataccgccagcctgatgcctcatttgcacaaatgaatggatgagtgaatccagcttattcttttatttctccctgggatctggtatacaagagatggttattttttaatttgagacagagtctcactctgtcacctaggctggagtgcggtggtgcaatctcagctcactgcagcccctgcctcctgggttcatgtgattctcatgccttagcctcctgagtagctgagattacaggtgcacaccactatacccagctaatttttgtatttttggtagagtcagcatttcaccatgatggccaggctggtcttgaactcttgacctcaagtgatccacctgcctcggcctcccaaagtgccggaattataggggtgagccaccacaccttgccaagagatggtcattaaagttgaattttggcactccttgcagaaaccctacaaagttggtatcacctctattttgcatatcagaaaactgatgctggccaggtgcagtgactcatgcctgtaatcttagcactttgggaagctgaggcaggaggattgcttgaggtcaagggttcaagaccagcctgggcaacataaccagaccccgtctctacaagaaaattaaaaaatgagttggatgtgtacctgtgatcccagatacttaggaggctgaggtgggaggattggttgagtcctggagtttaaggctgcagtgagctatgattgcaccactaaattccaacctgggcaatggagcaagaccctgtctcaaaaaaaaaaaaaaaaaaagtgctgagagagatcgtttcccgagggtctttggatagtttgtagaaaaacagtactgttccttctaaagccctgtggctttttccctattccaggtgcacattggcctttgaggctggaaaacacttttacttacttccagctttatgggattcataaaatggccttgagaaaagtaaaccgatttttctccttctaaaaacatccagtgggccgggtgcagtggttcacacctgtcatcccaacactttgggaggccgaggccggcggatcacttgaggtcaggggtttgagaccagcctggccagcatggtggaaccccatttctactaaaaatacaaaaaattagctgggcctggtggtgagcacctgtaatcccagctactcaggaggctgaggcaggagaattgcttgaacctgggaggtggaggttgcagtcaggcgagatcacaccgctgcactccagcctgggcgacagagcaagactatatctcaaaaaataaataaacaaataaatacatctggtgcaggtaaagtgttcaggaagtaatttcctggaagagggaactctgcagttgcaaatgcggccttcttacaagtcgcttgtagggtgttgaaactctctcgcgatcccagtgacttgagatgctctgttttctggataactaagcttttccaccttcactacggggtaccagggtctttgtagcagagaggcagctgtcttgatggtggaaccactcccgccagtgtgtggtggggtgcccccggggatttagggagagagaaggccagtggcagggactggctggaggaagagggtgcgaggaaaaacactggctgacatttgaaggaacgtgcttcagtatcagggaaggccagcgtgggataatcggtgtcttggcagatggggttgacggggagccctgaagccggcagtgtttagagattcaaagaataggggggctgtggggagtcttttggttcacagcagtgtcccccaaaccggcacagtgggatgagagtgggctggccagggaaggggacagggtgttaggtccagaggtgctaaaatccccaaccatggtcaaaatggggacatgagagactcggggttcagagctcacatgaaggacagctgtccccccctccacccccgccttgggtcagagctggctaggagagcccaccctgcagcctgtccttcgtgggaatcagcatgaggggtgcaaagtgctcagcaaggcccggcaccaggtttgttcttgggatcagagtgatacacgcgccttacattttttttaagctgctggttttgcgggtcagtacggggaaaaacggtgagtcccttttataaaatatatagagaggttggtgcgaaaatagcagcttgtttctgcttgcgtatttctactcactgctgggacacaaatctacccttccattttctgaattgtattcattcaaactctgatttaacctctatttagttaatgaattgggcaagttaacctcgaactcttccaggctgtggctgttaccgtcaccatctcctgcttctcactttacacactcatatgagaccttttttatttctgaagtgtggcctgacattgtttaggctgttgtttggtgcttatttttaactcttcttttgtcacttaagtaggatgtcttaattcttgtttagtgttagatcacttagcaggattttttttttgagcgggggcggggggaatatgattttgtgtcacattttgaatacttctctatggcagtatcttttagagttattatggaccctgtaattctgttctcaaagacgtttaaccactagaggtagacaccaaaaatgttttatttgtctcatttgggactctaattcagtgaagttggctgtttggagtctgagactggatctgtttttttattttgttttgttgttgttttgtttgttttcagacagggtcttgctcttctgcccaggctggagtgcagtggtttgatcacaagtcactgtggcctctaacttacatgcttaagcaatcctcacgcctcagactcccgagtagctgggaccacaggtgctcaccaccaggcccagctgacttttgtattttttctagagacaaggcctcataagtagttgtttcccaggctggtctcaaactcctgggctcaagtgatcctcctgcctcagcctccccaaagtgctaggattataggcataagccctcacacccagccaggactggatcccttgactcacttaatgatcggggtttacttctgacctgcatggggtgctgtggggaacccagagatcaataagacagcccgtaccttcttggagctgtatttagcagggtcatagaagacgcactcataatcagaaaccatccagaatgtgacttctggccagggagaatagggaagggttcatggagatggtggcatttgattgaattctgaatttggggttgtaggtttcaaatattagtttggggacagtcatccttttattttcttctctaaatttaaagaaattgttatttttaaaaaccaattggaatgggtattgaatttctgtgtggagaatgtctaccagtttttcatcattttctccactgtatagtgtcaataagtgttaaatgcaatggtctgtaagactttgttgataattttcttttctttgacatagacttgtaaactggaaaccctgtgtgggtaatgggcagtgcctatttcagcatcttgtccccagaaatccactccctaaaaggcttgttgaatgaatcagatctaggagcatctcttttgtgttggagcggagagtcagtccggactttgagcctctccttgcactgaccagcggcaggctgaagacagttggacttaagaaaacttaatctagaagcaatatgctggtcagattctttcaatgctaggtttagtatcgttcctttttctcccatttggtgaagtggtgtaatgctttagcacattttaaataagattacacaagcggctgttagttggcatcaagaatcttttaatctggaaagaaaatgttacctccttcatttgcaaaacagagtgtttctggcaccgtatcccaaagtgtcttctggttgttccgtttttcagaagttactgtgggcttctaattaccctcatttagacatccaggacagaaattgccacttcaacaagaaaattttgtaatgagccggaggaaatggtctcatcattactacgttatacgcagtctgagagtctgcgtggatttttatttcacaagaatgtgactgtttaattgaaaaatgttgttaaaatgtgctttctgttcctatcagtatgttgttagtgcttatatagccatgctcgagtcagtgaaaattggtgccctttgccaaaatactttttttcatttttgtgtataattttgtgagctaggtctatttttgtttaattaggccctgcaagagaatgagggagagctgtatttaaatttttagaccattaaagggcctaaaactatcctagatgaaaggcccccaaaattagctttaatatttattatatgaataaaaccaatagggaaaacgtttccagaaaccctttctctttttccttcttcagacagctggctaagattaattgcaggcctgaacgtgggcatgtttgctagtttctcttgttctattactagaaaataactcttaagagaggagagaaataccgtcttcttgtatttggggggcaggctgtacattttataactcactaatataatgaaatgtttgttgataacatcatattttgctttctgatagaaaagtcctaatttctattttctttttactttttatttttattactttttttttttttttttttttttttttaaaatagagatgagggcttgctgtgttgcccaggctggtctcgaactcctgggcttaagcaaccctcctacctcagcctcccaaagtgctgggattacaggcatgagcaactgcgcctggcaagtttgttttactttttatttttattactttttgtttctaatttctactttcgacaggattccttttaaaattttaatctaggaaacaaaactgcacgtgaaagatttgccttgtagacggaaagttctggaaacatcagctccaggctgtggtgtgaagctgtcgggctgatttgcctggtaagaagcgcgtttggggcacggagggtcaccttgccccctgcgagcgttctttcatcatttgagcagccaagcatcccttttgggccaagtttgccaaagactctaacgtagagaagtggacagacccagttgcatgctgatgttaggggcagagagaaagaaggaaagatccttgcctagcttaagcccttgtgcttcttccccacatttatttgacttcccaaattggattggctgttgtgattgaaaagattgtcagcactatgtaaatgagaatgagaagtaaaagtgcatctcatgcagataatttctatgtagataatttgccataaaaatttatattgcagtccttaaaaccttcggagatttagtctgtctagggaaaggtgatttatacggcattaaaacactttttatgtcccagtcctttagatttaatgtttattgcctataaaaatgaaatcttcttgtggatatttaaaagttttggtactgtgtgaaatatatattcaagttagaaatgctttggagatgttgtaaataagtggcaaatctcttgctccaaagtccactgtgttgtctgggcccgcatcttggctttgcacgcctgaaaagctgcctcgggtaccggtgtctgatcatcaccatagtgggtcgccaagtaggagaatgtcttatgtagggatttggtggtttttcaaaaaacttaaattagctaacaaggatgggactattataattcctcagaaagttatgcaaggtctgaccagaatttcattccaatctgcagaaagactgaattatggtgcagtttttttggttttttgtttgtttgttttttgagacggagtctcgctctgtcgcccaggctggagtgcagcggcacgatctcggctcactgcaagctccgcctcctgggttcacgctattctgcctcagcctcccaagacgctgggattacaggcgcccaccaccacacttggataattttttgtatttttagtagagatgggatttcgccgtgttggccaggctggtctcaaactcctgacctcaggtgatccacccgcctcggcctcccaaagtgctgggattacaggcgtgagcccctgcgcccggcctatggcgcaggttttaaagagtggaagtgctttgacaatggaatgcccagtacaaagcagtttttaggcttttgcagccactcagattcataacagcacgcttcaattctggtcttaaataaaactctcatggagtaaataaatcatatggtggggacagcactgctgtggaggagggtactgtttaagcattttgggggttcctgaaagatgtttctcaaagtgagcgctggagaggagtacctggtttgattgttgaactaaagtgtggtttctgtaaccctagggagttcttccctaggtatgattgagctccctgagtgctgggatggtgacctccccagcctgtctccaagtctgagtactggtcggcttcctagactccttaaaacgctgggtattttatttaattaatttatttatttttgagatggagtcttgctgtgtcgcccaggctggagtgcagtggtgcgatcttggctcactgcaacctctgcctcctgggttcaagcagttctcccgtctcagcctcctgagtagctgggattacaggcatgcaccaccacgcctggctaatttttgtatttttagtagagacggggtttcgccattttggccaggctggtcttgaactcctgacctcaaacactgggtattttggaaatcatgtgggaagtgcttttcctagagttttgtagctcctcaaaaaggcagaactaatcaaccaggcttccccattgtagccacagttggatcccaatggtaagggccattgggaaaccaatggtctgggtgagtctggcctgggaccctggcatggggaagagactggacttgaaggctttggatgggcagcttggtctggacagtattggaaataaaggaacttgagactttgaaattgctgtgatgggggtgttctcacctgtccataggggtgggatgtcagtaagctttgccggtgtctgtcccatagatagactcagctctgcattgcagccccaaaaggagcctgcattcttaaaagaattttaggggaagaaagatttaagagagcacctgaagtcctgaatcccttcagaaggaattcatggctgcctgtagtcagctgccagtccaaccttgccctccaaaagaagtcacagagattgagttttcagcgaggcagggagaagttgtcacatttgcctaattcttgtagaggtgagagtgggagtaaactggaagggggcggattattggtgatttgggggccacgtttccttgtatcacctgtaaagttttttttttgtttttgttttttttttttttttttggagacagggtcttactctgtcatgcaggctggagtgcagcggcacaatcacggctaattgcggcctcaacctccccagactcccaagtagctgggactataggcatgcaccactgcacttggcgtatttatttatttatttattattttttcgaagagacagggtctccttatgttgcccaggctgttctcaaactcctgaagcaatccgcccacctcagcctcccaaagtgctgggattacaggtgtgagccaccatgcctggctcacccataaaattaaaatgaaaagagcagaccacagccagcagtcttccgacctccagctcttgcaggtcgtgggcagccttgccccaggtgcagcaggtaggccaggaagcaggtgtgggaacagagcaacagcaggcaccgtggggacatgcacagtaagcgtcgaatcggtgtgcgtttgcagaaacgtgaatgggtgaatgaaggggtgtatgaaggtatacacaggaacgccacagtcagctttgtgtaaagtagaccagtgaacagattgctggtattgcttctgacagctctgctcctcaggggaaaatggtgaactcactttagaactcgcctttgtcagctccaactagactctggaaggaacacaaatgctcagactttcccatgacagactgtgaagcaaagccagttacacagctaccgtcactaatatttttggtataaagcagttgctaaaattaattccagtctgaaacttgatgaattctcagtcatggaattaacaggtcttaaatgggaaaaataaaaaattagcttgattaaaaataaatgtttgtgctgaaatgtggagcctgtctgtccctaacaaactaaatatgaagtttttcatcttagaggatttgtttgcctttgagtattcatagggaaagtgcacgtttgtaccagaaatttagagacgcactcccagtaagttcttacgagcagtcagtattatcctttttgtataaggcaagcagtcagtccctatgaagagtaagatacaagcctggctcagcagtggcccccctgagcctatctgatgtgcagaaaagtcacgcacacacaactgtcttgaagggcagcctcctttcagccagcacccatttactccctcttattaggccttcctctgaatttatatcaagcaaactatttaggacgcatctgcgaagcaggaagtgtgtttcattttgtttttaatgaggtttcaaactctctcttcccatctctgtccctggatgacagcgcagagttttacgtcatttgctattagacatcttgtggcttgacatcctcgaaggctcagccacccctgggtgtgtttggttaatacagcaagtgaagcctgggcaacatatcgaggcctcatttctacagaaatttttaaaaagtagctgggcatggtggcatgcacctgtcgtgtcagctacttgaaaggctgaggtggaaggattgcttgagcccaggagttcaagcccgcagtgagctatgatcgtgccactgtactccagcctgagtgaagggcgagatgttgtctcttaaaaaaaaaaaataataataataaaataaagaaaagaaaaaagtagaggttctgtgcttagttagaagatatctaacaacacaattggttagactttcataattatttctgctgatgtaagtatcacagcgcaggtcatgggcaacagtttactgttttcacacccagcttcaatgttaaatgaaccccagactatagcgtgaccagtctgatattatcatccccaaatctttatagtttcagctcttgggatggatgactgaataaccattttttttccagtgtggtagtcttagggttttgcttattggtgtgtgtgtttcaagaggaacctctgttccttggacttgatgtgagtggcaagtcatgtaaaaagctggattttatcaatagtttttgtctaaaaaccaaaaccaaaaaattcttcccctgcagtaccagtgcttgaaataaaccaccctcctacccccacccagcttgcctgcgtggatccagtagcacccccggtaccccggtgggcctttttggcagccccgaggggtcagggatctagggggaagagtcaccgcagggagcgcagatgtacttggagtggggaatggttgggggggacccattcccctgctttaaaccgcaaatgtcttttgatatctagtaaaattggcaagcagaatgattgaaaacatgtgagaggtaactggatctaagtctcaagtagtacatatttgagaagttttccccaatgtaaaagtcactctttaagagccttaaactaataaaaacaaggaaattccatgttacggctgccactcggccttttcatttttattccagaagtcagatctgacaggtcagcagctcactggctctgggctccccgtgtttaaagcagtggggacgaggagaagaactggcagccgccgggacggggaagtctccaatgccattcagtgccaggctcgtaattccctcttagtttatcctattttctcttcttggggcggcttcctgtatgtactttattcactgaagctgcttcaggattccttcagagactattcttgtttctttccatttctgtgtctttttttttttttttttttttttgagacagagtcttgccctgtggcctgggctggagtgcagcggcgcgaccttggctcactgcaacctccgcctcccgggttcaagtgattctcctgcgtcagcctcctgagtagctgggattacaggcacgcaccaccacacctggctaatatttatatttttagtagagacagggttttgccatgttggccaggccagtctcgaactcctgaccacaggtgatctgcctgcttcggccccccacagtgctgggattacaaagcataagccaccgcacccggctaatttcctttatagttacactagcttggaagaataacatactgagtggcgtggaaggcgttggtgcacataggtgcagcatcccagagccccgtccactggcggctatttgtgcatggctgcctgtggcttcttatctgtgatggaacctcgtgggcagagaagtggctggagagcatcaccaaggctgcctggtccaagttgcttcctgttgctgcatgggcagtgttctggggtccagaccctgggtggtagtgataagatggtgatggggtggagtgggtccttatagatcccacattactgagcggccttttgcccttcaaaccagatcacaatcccctccctgccagttggtcctcaagaaatcacaggaggctgggcgcagtggctcacgcctgtaatcccagcactttgggaggccaaagcaggtggatcacttgaggtcaggagttcgagaccagcctggtcaacatggcaaaacccggtctctactaaaaatacaaaaaaaattagccaggtgtggtggtgcactcttgtgatcccagctactcgggaggctgagacaggagaatctcttgaacccaggaggcagaggttgcagtgagtcaagattggattgtgccactgcactccagtctgagtgattctgtctcaaaaaaataaaaaaataaagaagtcacaggaggcccagcatacagagaacatcaggtatagagagatgtccttcctgggccaaaacaggtggtgtcattttgctgagtttgatagagaaaaagtcctgatgtctgtgtacataagaactcacgtctagagttcgagaaaaaccggtgatgagaacttgaacttggaggagtcacagggggatcaggaaagcttggtaattggcatgaatttcctacctccaggggcctggcacagagacctaggatgaagagggggccatcgagcatggtgtgaacttggagagtgtggggagctgccccagccgagggcactggatgggaattcatgccagaaccccatcacatagcggcaggagctgtaattgtgcttcttaattgtgtatcttcatttagtgcgagtttaggtggttagcaatagctctttagctagctttacagagtctaagttaaagagcccctcagctatcttgtagaaagcgccctggacaggatggggtgatgctgacagctggagtcactgttccagcgcccagaatggggagactagcagcacttctgggcagcccatgaagcagcctcttccctctgccggtgtccctcatgtccagcagagctagaagtgaaactcactgaggattgacgcggcccctttaaaatcgcatctccgctcttggcaccaggagctgtcatgtagtgtaacctgttggtgcccagaacccaggtttcctggtggcagccagcggtaccggtgccaggaggcagcgaaggaatcacttgcgacgcccgctctctctgccatacgagtgtcgttctgcggggccatctggctggcagcagctctcagccaatggcaggatgttgtaaacctcactcgctgaatgcggcaccgaaaatcttgaaaattaactgcaaaaataaaatcaaagctggctccgagatggtatttcttggcctggcataagctctccggatgaacttgctctgccttgttgatagatgcctcttactagtttggttttttcccaggagccagttggcatcttttaacttttccttgtaaaatccaggcagaaacattttgagagctttctggagtttttatttgctaattaaaatgtgagaagggaacacagccacaggtagaggtctagtgcaagccacagctgtgattcagaagaagaaaaaaaaaagccaaacctgacagtttcaaaatgaagttattagcacttcacctataactgtgatagcttttaacttgcaggatccttctcttaggcaccacctcccatccgaaccccagagcatatgggaaaaggagctaatgtgtgtaagttgcaggatacttaatcactgaagaatctaacaatgataactactatctctctggaacttttttttaacttagaagagtatgtcttgttctgtttatatatcacatagttttccaacgaccctgggaggtgaggtaggtggtatattttaccaatgggaaaatcgatgctcaggaagtcttggtgacttgctcaagttcccataacaagaagctgctgaatccaggatggaacctggtctaccccaaatgcccctactgcttcctagggcccagtaatgcccctgggtagggcgggcccagctctggaagaaacagggctatacaaaaaatcacccaatattgggtcaccagccttcttctacttgcaaaataattaagcaaaatctgtttttatttgtttttgagacggagtcttgctttgtcgcccaggttagagtgcagtggtgtgaacttggttcactgcaacctccgcccctagggttctagcgattctcctgcctcagcctcccgagtaactgggattacagacttgcaccaccacgcccggctatttttttgtatttttaatagagacagggttttgccatgttggccaggctggtctcgaactcctgacctcaggtgatccacctgcctcggcctcccaaagtgcgggggttacaggtgtgagccactgtgcctggccacaaaatctattttaattctgcaagttataagcagccagtggcccaccaggcccagctgtacgttcccagggaccccccaaagcgtatatgtcccgggcacacacacactaggtggtttgttttgttccccagcagcccgtgtctgcccgggcagatgttagtggctgagaaaccccaacagggagtgagccacaggcccgcgggtggcttccctgccagtgttctcctcgcgaaggggaagggagcccttgccagaatggctggtgccctaacaaattgattcctgccaaacaatagaaataaatattttcagcagacagaaatgttggctctgaaagcattcaaattaaaggcttatttctgaaacaaatactttaggaggaaaacatttttaccagcgcagatgagatcagagctattccttttggcagtggcaggactattttgagactcagccacaacggtttccctgccccgtctcgtttttcactgatgacctcgccccctgtttcatggagacagggaattgcattcagctagaggcatggggaagagatggtggcatggtgttctgcagagagcctcagttggacagtcggccgaatctggattcaaatccaggccctacctctcctgctatgatttcgacaaagccggtcagtcatctgatcatcagcttcctcagtctgtgaaatggggcggtacctcccttgcaatggttaatagcgttatcctcaggacctgggggtcattggaggccagcactgtccctagaactctctgtgttgattaaatggtctctacccgccccagcaaatataattgccactagctacatgtaactgttgggcccttgaagtatggcagctggaatggagggaacaaattttaaatttaacttagatgaaatgtaatccacatgtggccactggctaccattttggatagtgcagttcccattcatccctctcatttcattagttggtccctggagccaattaattggttggagggtcaacccactacaaatctcccaagtctttctctgtgccggatgcagctgtgcggagttgggacctgtctgttgtctttgacatccgtcttctgtcctgcagacggagcagtggggcagtgccatcgagctgggcagaggaattaatatcttagccatcaactgcccaaatcaaccttcatgggcatcttttaattttctaagagatggggtcttgctgtgttgtccaggcaggactcgtgggctctttccgcctcagcctcccgagtagctgggactacagttgtgcaccaccacacccctctgatatttcttaattttaatggctgatgtttcttaattttaacaagttcccatatgtctcatgatgtatgctaagtataaaaagaataatagaaggcatgaagtcaaggggcctgtttcccgggcatttgtttcagtggtgagtcacattcatgcgaagcctcggtttccttatctgtaagaccagatcagcaaaccacctgtggctgcctctctccctggttgaccccgaggccaagaggaggggcagggtcagcagccggccagacctcagtagcccctccccatcctggtatgggggaacacaggaggtagaaaacaagtgacctacacaaggcgggtggtggcgggggaggtcccactttaacaggaggcaagatggccgggagaaagctatggggaacccaggcaaatggagatgagcagaccccaagaaccgtaccctagggggctggctgggtcgggggaattagggtcctttgggctccttgcagagccgaagattgtagtggggagcactgcgtgtgcctacaaggctgagcctggcaggcagaattatgtgttgttttgagataacagccacaacagagcagtaaagaatactgcttataaaacggacatttttttgtagctcaaaaatggtcaaatatcagtaatgtcatgtggtttgagtaatccataaagcagagcccttctcgttagggctgagaattatcctcccctctccctgccacagagccggccacgtggcctgccccggcacctgctccgccttacatgtcattatgcgtctccgagacagcgtctctcacatctcaccgtttaaatgagcgtctagcaagtattctatggagtgcaatgcttgttggatacatctggcattttcatcttcgcagagtgggtttgtgacggggtgaaaaacaaaaaaacaaattcttgattcttgatggaaatctctcagtcctgagagatttataaaaaaggcttgtaggaaaactttgtacgcgtagcttttatactcatagaccaaattataattttttattcaatcttattttctgaataggtaacgtgttcacttggtctaaaatcaaaattttagccaggtccggtcactcgcacctgtaatggcagtactttgggaggctgaggtggggggcggtcacttgagctcaggagtaacatggcaaaaccgtgtctttacaaaacacacacacacacacacacacacacacacacattagctggacatggtggcacgcgcccgtaatcccagctactcagatggctgaggcgggaggattgcttgagcccaggagttcgaggctgcagtaaactgtgattgcatcactgcactccagcctgggtaacacagtgagaccctgtctccaaaaaaataaaatttgtatgtttatatactgagaaattttgtctccgcctctgtccctttttacccctactgtctaccctaagtcagtactgtacttctgttcattttctgggggtgtgctgaacagattcaagagaatagcatttccatggaaaggccgcagcttgtaagtttcacttgaatttccgtgattgggagttaatatcaaatgatctctcagaatcaagaaatactgatacatatcaaatgtataataacattttgagaattttttttttttttttttcagacagagtctcactctgttgcccaggctggagtgtagtggtgtgatcttggctcactgcaacctctgcctcccgggttcaagcgattctcctgcctcagcctcccaagtagctgagattgcaggcgcccaccaccacacccagctaatttttgtatttttagtagagatggggtttcaccatgttggccaggctggtctcaaagtcctgacctcaggtgatccccctgccttgccctcccaaagtgctgggattacaggcgtgagccactgcgcctggccccattttgagaattaaaggaacatgggcacgtaatctttatacgaggtggagtcagattgaatagcaagaggaagagaaactgacatccacgctcattgcactgggcgttttatgtgacttaatcctcatagcagctctatgaagtatgtatcagagggtgtccccattttacattaaatcacttgcctggatcactcagctggggagggtgagagccaggtgacctacccaaggctgtgtctctgggtggggggctcagaacctctctccctcgttttgtagtagccagacattgtctcgtataaactatggcaactggaagtgaaccaggtcttttcctgccctctgattttggtggaaaatgtgacctacccaggaaaagcactatgattttaggagtttaggtgcacaaagctgttttccaagcatgctcattcttctcccaatttgggactcattgctgcctctctgccctcatctgtggggccaagggagctggagcgacagccacagcagaccgctctgcatccctgtatgcgttgtgggaaacagcagaggaggtggcgttgcgcccatcttacagactccagattctgttcacccgacaggcagtgggaatccgtgttcacgctggtcccttggatcagaaattcagtacccttccctccacaccatgctgtagacacctctttcctctcctagacccggaacatcctctcttcttcagggtactggggaccaagatccaccctcgtggtgagaaaaccacaccataaataaacacagccaccatacgccgtgagatctggccaagaggtttccttctgttcattcggccctaatctccaagatgggaaggcattgccagctgccctgtgtagagattcctgaacacgcagtgtttcttattaacccgccagataaccagaaaatcagtctttgggcaagcgcttgcttctccacgtgcccagtattttctttctttctttttatttttttaatgagacagggtcttgctctgtcgcccaggctgggctcgaacttctggcctgaagtgatcctcccacctcagcctcccaaatagctgggactacaggtgtgcgccaccatgcccagctaacttttttttttttttctggagagacagggtgttactatgtggcccaagctggtctcaaagtactgggctcaagtgatccccccacctcggccttccaaagtgttgggattacaggtgtgagccactgtggccagctattctttaatttactagcgctgactacatgcctgtgatgtccccaggaccctgcaaagttctgggaaattcatagtgagcaaaacacagtccttgctggagttcacagcccatggggagacggcaccaaccctgtgcccagactaggggagctgccacgcagccactcactgagctgggcacacaggttcccatctcttatgaggtgaggcaggaggagcagggagggagctggggaagtggcatcagaacattttttggaagagagaaaggaaaggtttccaagcagaaggaacagcctgtggcgaggtccgaggggaaaggaggggaccctgttctctggggacactaggggaacgtcagcatgccaggtcagggttctggggagccctgggtggtcttatcgatggcccccaggaagccacagaaggcatttgagcagggaacgccaagctcacggcgggctttggcagggcgcgccccgtgtcctggaggactgtgtcctggtcatctttctaggcccccactgcatgcccttgaggactaggaagggtgcctccttctctgcatcaggctgactcctagcagctgccgtatctccagctttcctgctttcaactatgctttttgtctccttttcctcattgcgagcctaggcctgtatggggtggtggagtgggtgggagctcactgcttaggtgggtgggcagtgtgggtggtggtggttccatgggtctctccctcccactgtcccatctttgccactcatctgctgccccccactcccggaccccttttggaggtcagtctcactctgtggaaaccctggcttcctggttcgagatgccccctctggcccacgtgtctgacatcacgtaccagaacactgtggccatcattcaggattttttatgacacagtagtgaatcaaagcctgtcagtgggaaagtgatggggaaggattaagtgtctgagaacatttgggaaatatgaggttagacctggttctcaaacttatgaaataagtgaaaacatgaacgttcactttgggaattctgcaagattctcctttaaatggagtccatgaagagaacaaaatgaattttctgcagcgttacgcaggagcacttttctggaaatgaggtttcctaggactttgtcagcccttcaaagcctaggtctccttactagaggggaagaaatgagattttatttatttttatttttattttttattttttgagaccagagtctcactctgtttcccaggctggagtgcaatggcacaatctcggctcattgcaacctccgcccccagggttcaagcgattctcatgtctcagcctcccgaatagctgggattacaggtgtacgtcaccacacccggctaatttttgtatttttagtagagacagggtttcaccatgttggcctggctggtttcgaacttctgacctcaggtgatccacctgctccagcctcccaaagttctgggattacaggtgtgagtcacccactggccacaaacttatgaaataagcaaaaacatgaactttaactttaggaatctacaaggttctcctttaaatggagcccacgaagagaacaaatgaactttctgcaaatgagatgtcctaagaccttgtcagcccttcaaagcctaggtctcattactggaggggaaaaaataagattttaaaatatcaatgtttagccagactcagtggcttacccctgtaaccccagcactttgaggaggctgaggtgggaggatcgcctgagcccaggaattcgagaccagccaggacaacatagcaagacttccatctattaaagaaaaaaaaaaccatcgtttacttttaggagtaggcattacatttacgtgcttaaaataccaaaggtacccaagtgtagatatgaaagactttcccacccccaagtgagtgcccagccccttaatttccctccctggtatggatactaccagtatcttatgtttgtagaaccttctacagaaccttgtgtaggtagaagcagattctatgcatctatgtgtatctgtgtatttgcagtgactagattgattgctgttgatggacatattctggggaggtgtttttacacttccattactgagcacaggctcacaggatggcactttcccgcatgcaccaccatgcctggctgatttttgtatttttagtagagacagggtttcgccatattggccaggctggtctggaactcctgacctcaggtgatttgctcgcctcggcctcccaaagtgctgggattacgggcgtgaaccactgcgcccagcctgttttttgtttgtttgtttgtttgtttgtttgtttgtttttgaatagagacagagtttcactgtgttggccaggctggttttgaactcctgacctcaggtgatccacccacctcagccttccaaagtgctgggattacaggtgtgagccaccatgcctggcctcaatttctcccttttctaagccccccacctctgtttttgtcccatggtctggtcctgtcggccttgttgcacctggcagtcagggttgacttatgatttacttgaaccatccctggagcccctggcctggtgggggatgctggtggcagaatgaattcgggtctgaggtcaagcatgtgtctgtgagagtacacaaaatgaactgtgatgtagcgtttactgtgccacaaacttgaaatgcatcatcttgattatgtccagagaaaggaagtcatttgaccacagccacacaggttacaatggggatgcggcctggagtccaggtgtgagctaccacacccagcccacatacactttaaagatgagcaaatccaggctgtaatcccagcacttagggaggctgaggtgggaggatcacttgaggccaggagtccagtcaggtttgggaggccgagacaagaggatcgcttgagcccaggagtccagtttaggtttggtaggctgaggcgggaggatcgcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggtgggaaaattgcttgaggccaggactccagtttagacaccactgtttgaagcgtcttgggatgttttcagtaggggacttggagaagtgatggaaagaggctggtgggtggggcttaggcccaccacccctttctagccagagaaccctccattcatcgaaatgattctgttgttggaaatgaaacaaaaaataaaatggtcttaggaccttcctgtgcaggaaccatggccgacctttccctttttgtacaagtgatctatttttttcactagcaaaaccatttaagatttctatataggatgtgctgtttgattagtttgacagataatcccccaagaaacatcagatgaactcactctttggattaaagtttgagataataaaacaagaatacttgtgttgctgatgtggccagcccaagtatgtttttcccaccagcccagaggttctgggggcaggaggcatcctttgcaggcctagaaggacccaccctgtgggagcctggccctgtgcatctgcagagagcacttgctggaaatctcagtgggaaatggtggggatgcctcccatacccccactttaaaacaaacaactgacaattacacttttttttttgagacagagtctcgctctgctgcccaggctgaagtgcggtggcaccatctcagctcactgcaacctccgcctcccgagttcaagcgattctcctgcctcagcctctcaagtagctgggattacagatgcacaccaccatgcccagctaattttttgtatttttagtagagatggggtttcaccatgatggccaagctggtttcgaactcctgacaattatactttttgagacagggtctccctctgtcacccaggctggagcacagtggcttgattatgactcactgcagccttgacctcctgggctcaaacgatcctcccgccttagccccccaagtagctggaaccacaggcacccaccaccgtgtccagctaatttttgtattttttgtagagatggggttttgccatgttggcaggctggtctcaaactcctgggctcaagcgatctgcctgcctagacctcccaaagtgctagaattacaggcatcatccactgttcccggcccacatacactttaaaggtgaacaaatccaagccaggcatggtggcttatgcctgtaattccgcactttggcaggccaaggcgggcagatcgcttgaggccaggagttcaagactagtctggccaacaaggcgaaaccccctctctactaaaaacataaaaattagctgggcatagtggctcatgcctgtaatcccagcttctcaggaggctgggtcttgaaccctggaggtgaaggttaaccagtgagccgagatcacaccagcgcaccccagcctgggcgaccgagcaagactgtctcaaaaaaaaaaaaaaaagatgggcaaatccaaatggatctctggtgttatttaaatacttatttgggaaaaaaattttcccactatttctgttaagcagacagctggttacatggtagttttttaattttgtttttaataacatctgaaatgcctggcagaaagtctggagttgggggcagagagaaacttaaaatgttaggagctttgccctttgaggagctgtcagaattggagaaaaaacatcccagaaattgtaatcagtgaggaaaacaggattccagctatccacagcaccccagctgtacaccagcgtcacgggatgagggatgcctgtgtgcacgtaggccttggtttctgagctgagacagcagcagccaggccgacttggtgataggcttggcctgcccctgcagtggactgcctgggcctgggcctgggccttggccttggtctcagccctgtggtggatgatctgagccttggctttggccctccagtggatggcctgagccttggccttggccttggtcctgccgtggatgacctgagccttggtcttggccttggtcctgcggtggacgacctgagccctggccttggccttggccctccagtggatgacctgaaccttggccttggccttggccttggccctgccgtggatgacctgagccttggtcttggccttggtcctgcagtagacaacctgagccttggcaattggccttggccctccagtggatgacctgagccgtggccttggccttggttctgctgtggacgacctgagccttggccttgaccttggccctccagtggatgacctgagccttggcgttgaccttggcccgccagtggatgacctgagccttggcgttgaccttggcccgccagtggatgacctgagccttggccttgacctctgaagctcttctgtgcaagggtggggctcctgttggtgacacccacttgctgagtctacacctgggaagctcttggtcagctcggcccattgacttgagagaggaatagttgccgtccagcgagtgctgggggtgtaaggtggaccgggccacacggctgccaaggggccggctgggtgggactgaaacctgacccatgtgggtcctcattgcctcctgacatcagtcatcctgtgatctcttagaaagataaaaacacattttctgcgttctggtgcctctccttgccagacattttctcagtaaagtttctgtctcagcctcgttggaagtgccaggttctgagcccatcagtttgctgctagcctgccagcttcccatgacctgggacctgggaccaggggcccgcaggtgtttctagctggagaggagttctagatagttctgagcggataccctcctctgtcttcctcgggagagttctggcttggtttggtggtgttttctgtgaccagcagtggccaccgccaccaccaacccctcttccccctcccctcttcctccccctcccccctccctcctcctcctctatctccatacgccctgagactggccagtgggcagcatattgtgcaagaaacagctgttgttttgacaaaggacataactcgcctcacttcttgcatcaccagacccacgaggctctggattccaggcctctgcccctgcaggtggacacacagaccgtaacgcagaggctcacgtgtcccacactatgcattaccatttgtgtacgcactcgttcacatttagcaggattgtaaaaattaatagttagtgcagttcttccagctagataatgcatccaaatggcaagacagtccaaagatacacactatggagtaagtccctctccccaccggcccctctggagagagccaggcacggtcacaagtttcttctgtatccctctggagataatcacagcctatgcgagcatatggatggatattcttttaaacattgtgttgcggtttgctttttggcttggatgtatctgatgattatcatatcccttacaatacaccgtgtttttttacattacaggaaaatctgtgaggggctaaaccgacagggtattgctgggcatggaggaggttgggtccaggttttttgctctttgtgactttttaatgcctttcagatgtgacgactctccatacgccttctcacacgtgacccgtgactcatgggccgaggcctctgcatttgggacccccacctccacctccccaagatgcatttcattcccttgttaatgtgtcattgtagttgacgctttgaggataggcaggcttggtagataataaaacagtatttggcttatgtttaatcgctgtctcctcccacagcccgagaacgccttagcgtccttcagaaaggatttggtggtactggtttttatgtgtgtgtgtgttgttttttaaaaaaattttctccaagggacctggtcaaagatttcaagccttaaatctgatcaacccaatctggggcggcggcagctcagtctctcctcctcgctgtgccaatctgtttctgtggtggcgggtggcggctcggtgttaaatttggagacccccgtgggtttcccatgccgacctgcatatgtctgcgggcacggggaagggagggccgcagacccccgttgagtccccgactgccagcagcaagttgccgcaggcgcactggctctgcagccccgggatcaaggtgggttcaccttgcaccgggccacctgtttcagtttcctcctccaccaggcaggctctctgacagatcagcccagggaggggcaggtggggaccgagggggacggagggggcccacagacccccggctcatctggcatcttccccagcgtttcccacacttgacccactagatgagaagttgggggtcggggctgggaccccaccttcatacctccagcgcctgccaactcaaagacatcggtagatgcccaccgattgggtaaccgcccccagcacccccaccctgctaggcttccatgcagtgggggaagtagggacccccggccaaaagcagtcatgttctttttgtttttctcctaagttttctgcgtctgtgtgcgattggaacgaaacatcaactctttttttttcttttttgtcatatttcaatattggctttcttccccgccttctttcgaaggctccttttataacttcggctgctgctgcttaaatatagatgtcaaagccctcctccctccagattgtttatatttttgaagagccttctgcttcgctgtgactgctcctctcttatctgtatcccccgttccaccacattggtttcggttgctcttttttttttttccctgccttcccttaactgggatgtgtttcaaatgtggtctatcaaaatgttcagtgtttcccttttttctgcaatagctttgacatctgttcttgaattctagcccacgttattccttaggacttgtttgcccaagatgtgcctgaatgccagaaatactaaggggagaagagtgtggtgtggtggtatcttcccctcattgcctggtttgttgttttattgtcgttgttgtttttttttctttcctcccctgctttttaaagtgtctacgattccttccttcttccttccttccttccttccctccctccctccctccctccctctttccctccctccctccctctttccctccctccctccgtccttccctccctccgtccttccctccttccttccttccttcccttcttccttccttccttcctttcttctttctttcttttttcccttgggacacctcactcatgcccaggctggagtgcagtggcgtgatctcggctcactgcaacctctgcctccccggttcaagcgattctcttgcctcagcctcctgagtagctgggattacaggagcccaccaccatgcctggctaatttttgtatttttagtacagacagggtttctccatgttggccaggctggtctcaaactcctgacctcgggtgatccacccacctcggcctcccaaagtgctgggattacaggcgtgagccacctcgcccggcctgtccatgatttgtaagttgacagcatgatttcatcccatccggcatggcccaccccgtagtagtaccaaggaagcatttcccagcaagaacttgtaacgtgtaggtttgctggttaacttccgccaaggaggaaagcctgtgggacttggtgagctgggtggtggggggtggagaaggagaggctctagtgtgcttcttggaggcgtggggataaatcttcagctttgatttttctcgccgttcagctctgcttggactcagggtgatggtcccaaccgtgagaagccagctagagcagccaccttggatcccagcagaacgggccgctgtgtgtctttagttgccaaagcgactcggcaggaaaacaggccttttggtggcgacagcagtgtgtccttgggcgcctgctgtcagcctggaacaccattctggggccatctgctgcaggcttgttggaaacagatcctcttggcagctcttcccagaatttctgaggccagggcacaggttctctggcgcgttgattatcggtttgttgcggggagcagagcccagagtcctcagccccctagcgggtccctcatggggaacccactcctggtggtcctcagcgttcccgcgcaagtaatgtgatttgagaataactgccaatggtgcctcatttctgaaaagtggttggaaataattattcttggaatttaccttttaaaggtccctcttgaaaactaatcataggttaatggtctcgaacatgatgcttggcctagagtgagctcaccataaacatttgttgaatgaatacaaaccaagtattactctcagagatcccaggcccacagcattgaaggacggccacacggaatgccccgaggaggggatagatcagcagaaggactagagctcaggagagtggctggctggaaggaacccttgggaagaagaggcgtggagcaacttggggaggcgggtgctttgggcattagcctgatagttgtggctggagcaagaaagatgtttctgtgtattctgttatgggaacagagtcatttatggcgtgcacattgaggcacgacccatgatgttgaacgagcttggttttctcaaccacttcacatgggacggacgtgggatggggggataatgttcatttctctgccttcccgccaccctccagcccctcctctgccaatgagttgatgttccttagagccactggggtctctcccccagtgttctggtcaaatgcaaataggaccctcctctagtacacagtgcaattacaatctcacttttcctttcctgtttccccaacagagagaactcgatgccaccgcaacggtattggcgaaccggcaggatgaaagtgagcagtccagaaagcggcttatcgaacagagccgggagttcaagaagaacactccagaggtgaggcgcgtgaccatcgtgttcgctttgaagggatcttagaatgctggtgcatgttcaggcgacgctccgtgagcgtttcattttcatcagatgaacgcacggccggcaaacaacccgtttctttccccagatgtcttcagccccatttccagcagaacgcatgccatcctgcaggctgtggggatgtggaaattgataggttgtctggaaatatgaaagtcagagccaattccaggtgcagatactggacaagcttggtctgtaagaacacgtgggcaggtgtgtgggtgtctcagaccctcgagctcatcccagaccctgtcccatgtcagttagcaagccaccaaagtccataagggatcctgtggggtggaaggtccgcggggcctgcttccctgttgctggtgcaggcggagtgtctgaaggctgcacgcatctgggcatagcagtgcgcctaacgcttcttgtaaaacagacatttcgcctgctaggccttttaaatgcctctctgtttcttgaaatatgccgtaaagggcaatggaaatgtgctttttatatactcctgttttttctctcgtgagtgtgcaatcgggggacagtgttgagttgctggggtggcgtttttctgctcgtttcctggccccttcttccttcccttcaaccctatcaggggcttactaagaaaaaaaaaaaaacatccaagcgtgttgcaggcagatgagcagtcgcgggaatggctttccgggtgacatctgccagtttggtccccatggcgctcatcccgcgggctcggaccccagcctctcttacatcttccccttgtatgggaaggggtcgcagcagcccacagcttcggcccggcttccgggcttggggaatcttctccgtatcgtagctcttggctcctccatataagacataggaacatgcctggaggcaaagctcctttctaggagagatgcccctctcttacttacataatattgctgggaaattatatgtgaattgcatttttaaaagcggactcatttaaaatgtttcaaaagaggcttgctagtcaagggactgctggcatgaatcattatggaaaacaaattaataaccttctgtcttcagaataaatattttaggagaaagcttggtagcagagtagaaagaaggcagcctttggccacagagccagctaagggttcaaatctcacacccgctgcttgcctcggctgcccctaaatgtgggtactccatgtttcacgagaccaaaaatgcaggtgggagtcactggtgcttgggggtttctgccttctctgccagtgttggggagtggggggccctattctccatgtcagccttgccatgagtaaaaacaggaggaaaaaaagagctggggacagaacgtccttcttctgttgcctccagcggcttcagagcagactttcctggaactccggtttcctgagcgcttgtccttgactcagtttccccagcccaagccccgccacatccatcgtgctagctcctcttagtgccgttcctgtagctagtggtcacccaccgttctgtattgtcactgccctttcctcggtgaccatatgtctgagggtttccatagaaaatcttagaggtttggctgggcgcagtggctcacgcctataatttcaacactttggaaggctgaggcaagcaatcacttgaggtcaggagttcaagaccagcctgggcaacataacaagactcatctctgttataaaaggtaaaaagaaaaaagaaaacgttttgtggttaaaaacaaacaaagaaacaaaaaaacccagaaaatcttagaggggcaaggccatccttcagaggccacggacaataaatacacgagtgtattcagccagagaatgaggttcctaagaggcctggcttcctgggtgttcctcagaagtccccaactcctagtgacagtggaggaggagcgtgtcccccttcggtcaccctgtccgttccttatgctctgctgataaatgccgcttgtactgcactgagccctatccctccatcgtgccttgtgtcgaattccacattagttactcaaagacacctggccttaaacttggcgtttttatctccttctgatcccaataaatggaagaggcttggggaggcggcagcctggtaggtacctgccacttggggcatttcttctcaggacacatttttagactctgtcttcatggagaaaggggctagaacccaccaggaaggggaggcagatgatggaaggtcaccacctgcttggccctgaccccgccactgccagtgggtggagggtggtgcccacttcctcatctttggctgtagtaacgagggtctcactgcagcatgcggtcctggggaggtggggagaggggagctggctgcaggctcctgccccgccagccctatgcactttctcatccaaggaccaacctggaaatctgtggggcgcccacgcggaaagtccaagacgagacccacttcacttgtgccagcagccagagcttcctgctggtaactttttttttattttttgagacagagtcttgccctcaggttggaggaccacccaatcgctcaggttggagtgcagtgtcacaatctcggctcactgcaacctccgcctcctgggttcaagtgattctcctgcttcagcctcccaagtagctgggattacaggcacatgccaccaccacacccagctaatttttgtatttttagtagatttcactatgttggccaggctggtctcgaactcctgacctcaggtgatccgcccacctcggcctcccaaagtgctgggattacaggcatgagccaccgcgcccagccctcctgctggaaatgttgaaaccacataagaccagaacagtggtgggagtcgggggctgtggccggagtgtgctgggtgtgcaggaggcggagttccctgctgttccctgtgacagcaggtgtgtgtgtgtggggggggagctgtgacagtacgtgtgtgtgtagatagcacatgtgtggagcctcagctcagtgcctggcctgtgtcccaaggggacactgggtcaccgtttgtttggggtctcagtcttgaggagccaccactgccctgacactggttgctcctctggccacaccgcaggattgattactaaccgtggaggtgacgtcgggttgttgcatgtgtagaaacgaggcttgcttagagctttcgcccgttgggtaggacagcctggcttaccgggaggagggtatcctcttccctatggatgcagcccacgatccccatggcaacataccttccagggcacagcgtggcagagccagggctggtggtgttcctgctggtgtgacaccaagggtgttgatcttgatggaaacgcccacgtctctctttgttctgggaaagaaggaaaggtttcctggtgtctgatgaatgtctaatgtgttccacagggaggattaggcacccgcgagggttcagtggggagtaaagtttgtctgccatcggagatttcaccttctagactggcccttcccagatgtcactgggaaaagctctagtccaggagggaaaaggtgggctgtgacggggaggtggccagggaggggtgctgtgtggtggctgggactctgacaggcgggagaagccacaggaacatcaggaggtgagcgccaggatggctggagccttgaagggtttttctggggacaggatcctgctctgtcacccaggctggagcgcagcggcacgatcacagctcactacagcctccaactcctgggctcaagtgatccctccgtctcagtgtcccgagtagctgggattacaggaacgtggcaccacagtgcctggctagtatattttattttattttatttttatgtgtttttttttttttcttcaagtgtcttgctctgttgcccaggctggagtgcagtagcacgatcttggctcactgcaacttccaccttctgtgttcaagcagttcttctgcctcagcctcccgagtagctgggattacaggcatgcgccaccacacccagctaatttttttgtatttttagtagaggtgaggtttcaccatgttgcccaggctggtcttgaactcctgaccttgtgatccacccgcctcagcctcccaaaatgctgggattacaggtgtaagccaccgcgcctggccgtagtttttaaattttctgtagaaacagagccttttgctgttgcccaggctagtctcaaactcctgcgctcaagcagggtcctcccactttggcctcccaaagtgctaggattacaggcacgagccactgcgcccagttgaaggttttctgtttagaattagttttttaaagtttcagttttatatcattagattaatatatttgccatcatatgatattgtgtctttttaatccagaaattgtagttaatttgcagaagattgcagttactctgcagataaaattgtatacgttttctttgaatctacaaaaagagtccctttgaaagaaaaacatttttaaatgttctaactgaacatccattccctattgaattaagaatcaatcgtggaacataataggcggtggagtgtttctagggtatattgctttctatatttttgttttttttggaatatagtggcacaatcatagcttactgtggcctcgatgtcctgagctcaggcgatcctctccttatagcctccagagtagctgggactataggtgcgtgccaccacaccctgctaattttatgttttgaagagaccgggtctcactttgttgcccaggctggtgtcagactcctgggctcaagctaaatcacccaccttggcttcccaaagtgtcgggattacaggtgtgagccactgcgcccagctctgatttttgtatttcttacttaaggcgacatacttagtagctgtgcgtcttggggcagatacctcccaaagccccagttctgtcatctataaataatgtaacaacagggccccgctcgcagggttgctgtgtgcacatatgtgtgtgtacgtacccatgtgcctgtacgagaagggctgcgcacaggcctgtccctagagtttagcttatgttcgttattagcattaacctgggaatactcaccgtgtaactcatgagatacagtggatttctgttcctcagagctagcttggggaatttctatgttttattttattttatttatttatttatttatttatttacttatttatgaggcggagtttcactcttgatacccaggctggactgcagtggcgccatctctgctcactgcaacctccacctcccaggttcaagtgattgtcttgccttagccttctgagtagctggaattacacgtacccgtcaccatgcccggctaattttttgtatttttagtagagacggagttccaccatgttggccaggctggtcttgaactcctgacttcaggtgatccacccgcctcggcctcccgaagtgccaagtggcatgagtcaccacacccggccttagctcgggcaactttaaaaaaaaaataacaacaaatataggtagtttcagcttaaagtgtttcaaaagttggtttgtggccagacacagtggcttacgcctgtaatcccagtgctttgggaggctgaggtgggaggatcgcttcagaccaggagtttgagaccatcctgggcaacatagtgagattccatctctacaaaaaaatcaaaagattagccaggatggtggtgtacacttgtagtcccagctacttgggaggccgaggtgggaggatggcttgagcccaggaggttgaggctgcagtgagccatgatcataccactgcactccagcctgggcaacaaagtgagatcctgtctcaaaaaaaaaaaattggtttgtaataacaattaatcatcttacaaatatttattgaacaccttccatgtgccagacagtttggccctgggaataaaaccctatctccattctttaaaaagtttcttatctttcttagtaagcaaatagaacccaatggcagagcgtgttaagtgctaggatagaatgactggaatcttctgactgtagactttccccacagaaacactcttatgtcagtggtgataaagttctctggataagccacatatggctcagtaaccctttttatagataaacagttctgctttttgagccttggttcttaacctttaaaatatccatgaaagttgaggacctacgcacctgggaaatgcacgtttgcagtttctggggggctcccagacactcatccatgcagccttagtttagaacaccagttctctgggcccatagtcccagtttcagctcaccattccaggagaaccagtgggtcacctctactctccttctcctccttgtgtcctggggtggaaggggatgaaggagggaggaggggggattctagagctttggggtgggtgacagatgagtaccaaggcctgaccgctgggcagggacagggtgtgcctggccttgggctgggtgctggggagtgggagatgggtgaaggagcaaggccacctgatgtgacaaggggctccacgggctggcagcaggggcagcacctctgcactgggctggccacagcatgtcaggagggagcagcagcagctatctggaagcctggtggtgttagaatcatgtatgtgagcagtggaggctgaaagcctagctctcgcaaaccccagaaagtgtctcttagcttttccgtttgccgtttgcttttccatggctttgatcgcggtcaaactccgatttcccgcgtgtgtgattccagagttcttctggaggcgaggttacgggaggtctgcagcatgtctgacctgcagccccggctcactggcctggctgtagggagttagtggatggagagtggctggacagtttggagaccaggtaacccagcgtggggtcctccctggagaaacccccagtgctcctgcgacatcggcctggcttcagggctctgctatttgaatgtgatgctcaactctccaataaatggtcgtctgtgttaggcttgcttccagaaagagctcagggatggttttgggttttgttctgcttcttttcaatatgggaggaaccttctctgatgggagaaaagagaggaggagaaccacattcctgagatgctgtgattttatcatgaaaccatccccagccctcatcctggtgacgtcagtcggcccagtcctactccagaacgcttcttgggtgtctgtctgcaggactttgctcagttaatttttgtctcctctaaaacagaccccgttgctctgggaggagagccgagctgcggctcaggggccgtcactggtcatttttgccctgatgtatttttgcctctacatttcttgatctctggaacgttaatcccaacgatgcctggtctgcggtgctcacagtctgtgtctgtgctttctacacctgtcctgctcagatgcacatgatgtcacacccaggtctccatcctggctcttgttggctgcggcggcagccctgactgtcggagacgcctggctcagcatgcccaccttgcaacagggagcaccctgtgctgctcacagaactgcccatccactttcttttcctttcctgggtgccaacatcttcctctgccccttctacgccggcctggcgcatttctctgatttctgtgttcccgggtagcagttgtaaaaattcaggcttgggagttgtcttgagataggacttggaaaggaatcttttaccatcgttgaaattggctagatttgtggattccttcccgaccctggcaggcacggtgaggggaggaggtccctcctttttattgatcaggatgcactgtgtgcggggtaagccaggaagccacgcacctgatgctatctctgccatggggaggaggacagaggatgggaagatgctgtgaacttttatgattcgtttttcactctcggtgagaaaaggagctagcaggatgggtgagggagtggagggtagtaatatatagttgtggcctgggcccaaacgcatttagtcactgcctcgacagcctttatatagacaccaccagagtgactcagcctggaaaaagagagtcacttaaaaataaagttgcgactccagtggacacgtggtgcacaggctgccctgagatagtcaccagggctccatggccctgcacaccccccaggaccctgggcgagtcaggtggtgaagtgagggtgatcgttgtaaccccatcttggcattgacgtgaggatttagcaaagtcacatatcatcccaattacttttttccttttttttttttttctttttggagacagggtcttgctctgtggcccaggctggagagcagtggcatgatctcagctcactgcagcctcaacctcccagcctcaaatgatcctcccacctcagcctcccgagtagctgggactacaggcgtgcaccaccacacctggttatttttttttattttttattttttgtagagatgggggtctcactttgttgcccgggctgatctcgaactcctgggctcaagcgatcctcccacctcagcctcccaaaatgttgggattaccggcgtgagccaccacacctggcctttgatgctttctaaacatgaaacagcatccaggcatcatcggctactccttgatatgtcagtgttacccactggactctcaactcttctctgttatcaacaaatcttgttttactcctcattagaccctaaaaccactgcacacagaaaagtgaaaagcccagcctcattttcctttcatcacgttgagcccattgagttggcttcattgaaggcccacagccctgatgtgacacaatggggcctttttttgagctagaattccactccgtcacccgggttggagtacagtggctcgatctcggctcactgaaacctctgcctcccaggctccagcaattctcctgcctcagcctcccaaatagctgggactacaggcatgtgccactgtgcccagataatttttttgtatttttcatagagatggggtttcaccatgttggccaggttggtctcaaactcctggcctcaaatgatccacctgcctcggcctcctaaagtgttgggattacaggcatgaggcacagtgcctggccaaaagtagatttctatagagatagaaacccccaggggtgaggggatagaggaatgaggaatgactgatagttggtatgaggtttctttttggaatataaaaatgtcctagaataagacagtggtgatacttgcacaactttgaatatgccaaatgccactgaactgtgtactttaaatgggtgagttgtatggtatataaattatacatcaataaagctgttatttaaaaaaaaaattcagccaggtgcagtagctcacgcttataatcccagcactttgggaggctgaggcagatggattgcttttgctcaggagttggagaccagcctgggcaatatagtgagacctcacccctacagaaaaatagaaatattagctgggagtggtggtgcgtacctatggtcccagctactcagaaggctgaggtaggagggtcgcttgagtctagcaggagattgaggcttcagtgagccatgattgcaccactgcactccaatgtgggtgacagagttataacccccgtctcaaaacaaacaaacaaacaaacaaacaaaaaacctaaactaaattaaaaaagaattcctctcttcatgggggtgtcagaaacccccgaagagatttcttattcagttgttctctcatcctctaaagaaactccccacagaaaagtatcttgtgaattttcatttttgcagggggcagtttggttttaaaaagtctactccaggatttggcaaaatgagaaaaccccagtaatcaacttgtgtgtttaatcattctagaatcacctactgttaagttataataagcctttaactagaaaaagtttaaaaattaaaagtgaacttttaactgttaccaattaaaccctttaagccagtttatcaacccaagacattattttctttcttttgggtctctaggggagaagaggtgccttgagtgggaccagtaatgaaggcaatttgaacctaattcgggccccagtcagggaaggtggctgcattatccccctacatcccagcaagactttgccgcatggtctggagggcaccagcaggggcctgtagggaagaggaggttgcctgggcccagggacattgaatgctagtcaagccctggtttcatttgctccaacagcattaatagtattgtgacctccatggcactgtgacagaaacttaaccccagtttcttcgtctgcaaaaaacataccctgcctacttcaaggggtcctggaggctgaatgtccagtctcaggccaggagtagaacgcataactagtaagtggtgacgtgcagtgaccttgagcaaggtcaaaaactgttctaagacttggtccccttatgtataagcaggaagaattggtgctatcccatttcacccaggaggtgaaatgaattcagatgcacagagcatatagtaggtgctcaacaaacaccctcctctcttctttccttccttgctttcttttacaagtagtcctgagcccttttctagggccaggggcagtcagatacagcagggatggagggagaagattccagatctcacagagatctggcagtggccaagtaaacaaatgatgcacaagataatttcaggtggcggtaagagctcagacagaacaagatggcagtgagtgatcaaggatgggcgaaggtactttggggagtcagagaacgtgttttgatcttaagaatgcaaaatgactttttgtatcacctgtcaacacaacacacacacacacacacacacacacacacggaggctttagtgcaaattttgaaataaccattgattaattttggcaagctgttagcagtggagtcccccacatttcttccatgtaaagccctgatcatcttggctgtaaccactcacttactttgaagcgtcagattcagtctctctgctttctaagaccagggatgctatttaatctgggcattagaaaattcagttggccaagtgcggtagctcatttctgtaatcccagcactttggaggctgaggtgggaggactgcttgagaccaggagtttgagaccagctggggcaacatagcgagaccccatctctacaaaaaaatgaagaaattagccgggcgtggtggtgcatacctgtaattcaggaggctgaggtaggaggatcccttgagcccaggagttcaagactgcagtgagctatgattgcgtcactgcaccccagcctgggcggcagagcaagaccctatcttcaaaaaaaacaaaaacacacacacaaaattagtcaatgaattgtggagtttcaaagagaccttattttgtttgtttgttttctgggccaaaggcccagaaattcttaggtaattcttcggtaattaattcttaggcaattcttaggtaattaacgaggagctaatctcccagttgctctgttccttgtcactggaagtggtcagagctgttgcggggcttggcccaggggcggcgggtggcatctgaagaccccgcaggccctgctttccttccgggagcatctcaggacggccgctttgtctgtctgcccccgccccttgctgaaacgtcaacaaggccggcatcccctttccttcctgagagccatgtgtcgcttccttcatgtgtccagccgtttttacagggctattttaagtataaaagacgcattatctgagagtttaataactgtcaaaagggaagcactgtcattagattcatgtgccctggaattttagtcaaaaacatgctgcgttctatcacgtctaagcctctattttcttatctcaaaaaataggaatgataacgacctcggagtcattatgggctggatgaactcttatagggattcagaacaacccaggcaccaagtagaaggtcaataaatggcttattgtgttcatgttaccaaaatctactcttttgagaaattgtgttcacaaatggccttttttttttcttttttctttttttttttttgagatggagtctccctctgtcacccaggctggagtgcagtggcgcgatcttggctcactgcaacctctgcctcccaggttcaagtgattctcctgcctcaacctcccaagtagctgggactacaggcacctgccaccacgcctggctaatttttgtatttttagatggggtttcactatgttggccaggttggtctcaaattcctgaccttgtgatctgcccgcctcggcctcccaaagtgctgggattctaggtgtgagccaccacacccggcctcacaaatggactttttttttttttgagacggagtctcgctctgtcacccaggctggagtgcaggggcgcgatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgagattacaggcgtgagccactgcacccggccacaaatggactttaaagttataaatgtgacggagggcagtggctcacacctagaatcccagcactttgggaggctgaggctggcggatcacttgagctcaggagtttgaggcaggagaatcgcttgaacccaggagatgggggttgcagtaagccaagatcgtgccactgcactccagcctaggctacagagtgagactccgtctcaaaataaataaaaataaaataaagctataaacgaacacttaaaaaaattattaaagcctagggtagaccctagtttctactgcggacttgaacagatacagtaaaattaaaacttgccttcttccatatgtgtctagagagtaattttctctccttttgcattagtttcactgttcatagagtggaaatgtttgctgctggactttcttttttgaagctattctttgagagtagcccataacttgtctttctggtcaataacctcaactgaaatgcattctgaatggagaacgtcattctgtgtaggatttaataataacttcagcacagaaaagcactctctgcctcttctcagcaaacaactttgttgagcatgattttaaaggtgtaacggctaaatgtgaaagccatatgatttggttgaaatcgtggtgagctgttattaatatttattgagtacttgctaggagtcaggcattatgctaagtgcatgaccatcatttctctgcccctggaagtcaccctgggagctaagtatcatcggtgccacttaatgaagcgtaagccacccacccacctaccaggattttcccgggcagacagactcctgggaatgaggccatataatcccctgaacaccctgcctccttagggttccagaagccaattttttttctttttttgagacagatttttgttcttgtcacccaggctggagtacagtggcctgatctcggctcactgcaacttctacctcccgggttcaagcgattctcctacctcagcctcccaagtagctgggattacaggcaccaaccaccatgcccggctaatttttgtgtttttagtacagatggggtttcaccatgttggctaggctggtcttgatctcttcacctcaggtgactcacctgccttggcctcccaaagtgctgggattacaggcatgcgtcaccacgcctggcccagaagccaaatttttagtcacttaaccattagcaattcctcttctattagattttttttaaaattgcttttgagtatttctttgaagtggcatactcatttaaaggattctatatgtcagggggaatgttttctaggagggtacttaggaaggaacatatcgttatagcctaaaatttgccattggcctgtgaaagccttcttaacttacggaattgattataagccaaagcgtgggaaaatctccccttccactttgagattatgtcagtcaagaaaatgacaattggataccaagccatgctaactctgatacttgctgtcttcgttttcttctttctttggctagggggatggagcgcgtgtggtgtgggtgggactagtcactgagcatgttattgactaacattggcttttcattttaacttgcaaatgtgagtggcataaaagtgagtttacgaggagcatgactggcctgttatgcagagtcttgtaattttgtttgtggccctttattttaagaagatgttgtgttatatagttggtgtccttaaaggagtatataattggatctggaagcttagattgtgattctgacttggccacttaatgaatgcaagatctgagcaagccatgacctctctgttgttcagtctaagaaaggaggtgttggtgctgagcatggtggctcatgcctgtaatcccagcactttgggaggctgaggcggacgggtcacttgaggctgggagttcgagaccagcctggccaacatggcgaaaccccgtctctactaaaaatacaaaaattagccgggtgtggtggagtgcacctgtaatctcagctattcaggaggctgagacggagaatcacttgaacctgggaggcggagattgcagtgagccgagatcacgccactgcactccagcctggatttcagagcgagactccgaggttctgtgtggctgagagccacacattttgcaacaagagactcgtcccttttccataggtgtccttattcctattgatcttacctgtgggcccaagacttaggcacatccctttcttcttaaaaggcatcacctcctctgcctcttggagttttcctacccagaattcattcatgtgtgcagcaaatattcctggcagtcccattgtgtgtggaatggggtaaaccaggaagactgttgtgagggctcagtaacttcagggacacagccgtcgtagcttataatggcagctgatatttagtgagcacttactgcatatccagtactattctaaacactggaaaggcatttaactaacttaacactcacaggatccctacgaaacaggtacagtgtttatttctgtttcaaagagagggaaactgaggcccagagaggaggagtaacttgcctaggcccacaggtggcaaagctgcctgaaggttttttttgagacagagtctcactctgtcgcccaggctggagtgcaatggcacaatctcagctcactgcaacctctgccttccgggctcaagcgatcctcacttcagcctcccaagtagctggggctacaggcatgcaccatggtgtctgactgatttttgtatttgttgtagggaggggttctcactatgttacgcacgctggtctcaaactcctgggctcagtccctcccaaagtgctgggattataggtgtgagctaccgtacccctcaggaattcttattttttagatggaaattttaaattggcttttattggaatctcattaaatttgtagatttggagaggctttagaaggcattttcaagttttgattgattgttttagatttcattcataggtgaatttcattctctatattttacttgagggatccacggaaactacctacatggacttcacttactctggttcattgtgtgggatacaaaatcgtcaaaattgaaggattgatcattgtgtctggagccaggcataaaaataaacctcactctgttatcataggtggctgtgattaagatcgagggaaatgtcggccctgggcctcctaacattgacagtttccttcagaagattaagtgcggcttcatttttggcccgggccatcagtagcttaaagccattactgtctattggctgtttggtttgtctgaaatatggggccggcgtcagcctatttccctggggtcaggtgtgttcacataatcaaagtgccaggaacccatatcgcatgcaagcgtgtgtgttcaaattagccttctccagggaggaattcacagcaccaggaatacgcgcagagatgttcttttgcacttttgcattttaaaacgtgcatcgcttacgagcgcagcattttcaagccttttcttgagatcagctcgttcagttacatgtgcttttgaagatgaccatttgtgaaaccatcagccactggcaaagtgaagaaaaatgaagatttcggcctggttgatgtgtgctcggggaaaggtgatagcttctgtttccttgaattaaaagctgcagacaagtatattttcatttattttgtttataaatcaacaacccacgaaaggtatttcatacgtatttaaatgattgctttgccgccatcaagaaaaaatactgtttcacttaacagtgaattgagacaaggaaaagtgatgtgtgaatagaaataaagaaattaaagtaaaaaacaggatcagggtaggttctagggctaataatttaagaacagaacatgtggtttaactctttttgccactctaaggagaggtgatatttgtatttttctttttactgaaaccagatcgtgagacacgcttttcattcatacttgaaacttgataaaatgtttggctttatattaattttctcaattataagtgtgggaaatgaattcgttgataacccttttcaagtaaatgaactgattagaaccagaagagccgagagtcatttttattttaaaattctttttgcatgaacacatgtagtgttgaggaatatgtggaaaattgaaatattgcttctctcctaccgtgtctccagtgcctcgataaatcaccttttttttttccttttaaaatgtctggccttataatttatgtttgcataacccattactaaattcatagtaggtgttttagttggcaggcattattccagggatttggaggagtttaaaaaaaatacagagcctttgttagtatttatactaagtggacattttccttttttaacaacaacaacaaaaaagaattagatttttaaaaaagaattcagagctagctatttacctttttcctagacaaacactattaagtccatattctcacattattcattgtcttaatggagattaagatttcttaatggactttattatagcttttctttctttttttcaaaattagaactggccgaagaaaatgcttctactattaagatcagatgaatttctacagaattttcagtaggtgtcatgttgtataggaaataaacatttctgttttagtaggttttcgatttcttacctcccgttgaccgttttgatcataaagtgaagatgaatacattcattcatttactgcagtctttggtacttgaacagaaatagcagtgttcttggtttgttcgcatacttgtggcttacctttgagactttctaatttttaaccagacatttaaaaatagccattctgtcttttagccctaatttagaaaaacttgtagcgctttcctttgaaatgatgaaaaaaaaagttctttctgttttctatcatcaaagtttaaaaagcgatgtttggatattttaaaagccggaaagaccatgtatggcgtgctgaggaagtttgctttgtttgatcattttctcttcccctcacccccatcagctggctaataatgttttccatgttaaatgtgtatcacagcctgttgaaatccctgtggttaatcagaagagaagttgtttctatcctatggaaccttaatacagttgtcaggaggtttgtgaacagaaattcagaattcatcacactgtaacgatgatctaaaggtcaagttgtacagtataaatttgaaaatctctctctgacttcctttctacctaaattagagcctaaaagtcatgagaattttgtcttctttttgtttattttagagatagcatagtcgatgttttaaaaagttgccaccttttcactataatgcgctcccattatcagagatgtttattctggttgtatctctctgacaaccttcaatacttaacagaataatttagtttggattcaaagaagtgcctcttctatttctgtgtttgtttctagaaactttgaggtggaggaattattgttccttcttcttggcaatgttcagggtttcacgaatctgacttttaaaagcccagctctcagccccgagcctctcatgagttaaagaaagggttttgcagcttttggtagacgagaaacacattttatggctcttcatgaagttgcccgctccgtccacgtcctgtcctcttcctccttcccagtttctgggctccctggctcttgtcatgaggctttcagttttgtgtcccagaaagcgcttcccccggggacagtgccatgccaaggctgggagaagggaaaaaggaggtgtttatcgccttgaagatgccttccagcctttattattaactcccttccaaagtaaactttcgggtttttttcaagtctgttctggccaaagtacagttgggtttgccgtgttctctaggagtagaggtgaaaacagcattgcccggggtgaggagcaggaggaggaagggtccacgtataggagtggatggaggggatctgtgagacagctgctgggacagatccgacttggagactgtcaggcctctgagcccaagctaagccatcatatcccctgtgacctgcacgtacacatccagatggccggttcctgcctttactgatgacattccaccacaaaagaagtgaaaatggcctgttcctgccttaactgatgacattatcttgtgaaattccttctcctggctcatcctggctcaaaagctcccctactgagcaccttgtgacccccactctgcccgccagagaacaaaccccttttgactgtaattttcctttacctacccaaatcctataaaacggccccacccctttctcccttcgctgactctcttttcagactcagcccacctgcacccaggtgaaataaacagctttattgctcacacaaagcctgtttggtggtcttttcacacggacgtgagtgaaagagactgccattcatgaatggacaaggcctggctccgtccacgctttcccagctctgtgtcctgccatcggacatgctggcacatctgctgtgggtgccctgcacttctccgggcactcctggcccagctggggaggttggcatggtatccaccattttgttctaaagtagtaaatgaaactcttgggagggcagcacccagcagatgtttggagctagagacagggctctggggatgtgtaggaacccggacctggtgtggcaatggtgtggggctgtcacgaggcgtgaggaggctggggtggtgttggggacagcacacgatgctggggctcaggccaagtgaagcttggacttcactctgtctgaggctttgccaagtgtcagagggtgcacacttgggagtcacatggccaggctcacatttccagccgaagttacactctacagcctggcagcagatggacgtttggggacagaggtggagccggaacagctgagacactgttttagaggactctgcgagaaacacgctcttaaaacaaggaagcggtggttatgtcttattcaacaacgatctgttgtggaccagctgtgtgccaggcagttgcaggccctgaggctgcagcagtgagcagaaggccaaggtccctgccctcgcggtgcttacattctagtggagacagatgttaaactacagggcaggaaaacactgtcaaggagatgcaggtggaggattctgactgtggaactggggcatagagacagtgggttttgaaagcacttggctgagaaggatgggaggagggaggagggaggagggcgggtacatctgtagatggaccaggttaaggtatggacttccccatcctgacaagggggagccccaagcttgttttcaggtgtgacgggggtggggagaaagagagcattccaagagaggcacgaacgtcatttccagagcgagatgaaggtcacagagtttgggaggagatgggatccggcactcgggctggcgagcagacaggagggaactcagggagatgggaaccccggggaggaagttagggcaggatcccctgggagttttcccggatacataggagaaaaggttatccttcaagggtgagcgggggctaagtgcaggggacagaagagaggaaagcccggcgaccatcatgcccggctgccgtgggtggtctggattggaggcggcagccgggctgtgtttgtgcggagggtggcagggggccagcggaggaaactgcccaggcgccagccctgccatccccaccggcctcctcgctttggggttttgctttctgccctggccacgtgggaccggctaggtggagatcatgcaatcagggttcccagctctcagaaccataatggttaagcaagcagcttcgtttccaggcacgcaggagctcccccgtgtcagcgttttcctaacatggctaatcataaaaacctcctgggtgtgtgtgtatgcttgttaaaaatactgtccctgggccccaccctagacttagtgagacacagtcaccggggaagggcctggggacttgcatttagaaccagctcctggaatgcttactctgaggccagtttgggccccctcccatggcctccctctgtgtcccttcctccagatgctgattgaggatgtgtcccctgccgggactgtgtttgcatgtctctgtctctgtcacaaagtagatgcctggggagtgtgtgctgcgtggccccctgaagaccctgtaccgggatgtcagcaccccagcccccagctcctccccctgtgaaagacattagctcctggaggggctcaggtggtggaaatgaatcttagcatcaatgtttagacctaaaagccatctccaggtcatcatagcacatgacagagatagaggcagaacctggtggccataggattatttctgagcaaagatcgcccaagctttggcataggccagggttattcacatgtccgagtccctggaagtggggtgtgaggaggttgtggggggccttcagaatgagggaaaagggataaatcaaaatcaagtctttttttttttttttaattgagacagagtctcgctctgtctcccaggctgcagtgcagtagcacgatcttggcccattgcaacccctgcctcccaggttcaagcaattctcctgccttagcctcccgagtagctgggactacaggtacgtgccaccatgcccagctaatttttttgtatttttagtagagacggggtttcatcatgttggccagggtggtctcgaactcctgagctcaagtgatccacccgccttggcctcccaaagtgctgggattacaggcgagagccaccgcgcccagcctaatgatataaatattagtagatttctgcttactcacttcaccaccagcattttctagcaaatgtgagttcagcagacaccaaagatttttataaatcaaagtagacagtctttaacgttgagaagattctgttaactcatctgttctacccacactcttgcccttccctcctcacagaaaagccaggagaagggtgaataattgaattacagatgacagtaaatatttggatctagctgcttatgaggccttaatgatatcagtcagtacaaaaggttgatatccatgttttttggtgtgtgtatttttttttttttttgagacagtctcactctgtcactcaggctggaatgcagtgacgtgatcacagctcactgcagcctcaacctcccaggttcaagcgatccttccatctcagtctgctgggtagctgggaccacaggcgtgtgccaccacacccagctaattttttgcagagacagggtctcgctatgttgcccaggttggtctctcaaactctggggctcaaatgatcttcctgtgtcagcctcccaaagtgctgtagttacaggcatgagccactgtgcctggccgatatccaccatgtttggagcctgtttttggttacatttcatcctcatctactggcctggagatattggtgtcaatcagttcttcactgggggaagagatttttttaaaaagtcagatttacactcagtaagattcacccttttcaggtgtccactttgatgaattttgacaaccacatatagtcatgtgccaccaccactattaagatagaggacaggctgggtgcagtggctcacacctgtaatcccagcactttgggaggccgaggttggcagatcacccgaggtcaggaattcgagaccagcctggccaacatggcaaaaccctgtctctactcaaaacacaaaaattagccgagcgtgatggctcatgccggtaatcccagcactttgggaggctgaggcgggcagatcacttgaggtcaggagtttgagaccaacctggccaacatggtgatacttcgcctctactaaaaacacaaaaattagctgggcatggtggtgtatgtctgtaatcccagctacttgggaggctgaggcaggagaatcgcttgaacctgggagatggaggttgcagtgagccaagatcgtgccactgcagtccagcctgggcaacaagaccaaaactctgtctcaaaaaaaaaaaaaatacatatatatatatatatatatatatatatatatatatatatatatatatatatatatgatggttccactgtcccccctattctcccaggcctctatgtagtcagtcccttcccccaccctcagcccatggtaaccacttatctgttttttgctggcatcattttgtattttctggagtgttacatagagggatcataccatatgcagtcttcgagtctggcttctttcacttagcgcagtggatttgcagttcaacagtgtggccgctgtcagtgccaagtagtattccattgtatggatgtaccacagcatggagggatttttaaggctggtcaggcagtgcttatgtcacaggtccaacatccagtcccctgggccatttaaagccaagcacagccccacacctaaccctcgtctgaacgatcttgtacagccactctgcagtttcacatcctgaatgtgagcagtctttttttaaagaaggaggttttgggccaggtgcagtggttcatgcctgtaatcccagtactttgggaggctgaggcgggtggatcgcttgagcccaggagtttgagactggcctgggcaacatagtgaaaccccacctctataaaaaaaatacgaaaattattggtggtggttgcctgtggtcccagctgcttgggaggctgaggcaggaggatcacttgagcctgggagtttgagaccagctggggcaacatagtgagacccctgtctataaaaaatacaaaaattggggctgagcgcggtagctcacactttgggaggccaaggtgggtggatcaggaggtcaggagttcaagaccagcctgaccgacatggtgaaaccccatctctactaaaaagacaaaaattagccaggcatggtagcgggaacctgtaatcccagctacttgagagcctgaggcagagaattgcttgaacccgggaggtggaggttgcagtgagccgagattgcaccgctgcactccagcctgggcaatagagcgagactccatctaaaaaaaaaaaaaaagccgggcatggtggtgtaagcctgtggtcccagctacttaggaggctgaggcaggaggattgcttgagcccgggaggttgagaatgaagtgagctctgattgcaccactgcactccagcctgggtgacggagggagaccctgtctcaggaaaaaaaaaaaaaagaggaggttttaatgttcgcaaagctggtcagtttccaatctggtgtcaccagtggaaaaaagatgtaagtgttgttggcaagagaagctcacccagagacacgctccatgaagtccctgacccccgctgggggtgcctgtgatggagggtaggctgtggtgcctgcgggcgcgcacaggtgagatggaaggaataaggggttattccttctgggtgcagctctgcctggaggccagagctgtcctcctcccttcgatctctgaattaaagacgctcttctagtattttcttatgttgatatatatgtgtatatatatatatgtgtgtgtgtgttttcttattgttctagttcttatattgtcatttaattcctttgtcctttagcttgcaagggaatgtgttttcttattagattgtaagctctggggaggtaagaccagcacttccaccctcccagatccttggttgggcacgttattgatcagtccacatctgttgcttggctgattgattaaatgctgtggtgcccgtgttcactgagggattccagacccctgtctagcccaaggatgcctcacagtgggaatgctggcacagctgtcttggcaatcagtagaccatcctgtcagttcttcaagcccagagagggtccgtgacttgctcagagtcacacagcaatccattagcgaggccagccccttccctgggctctgcatttctcttgtagtgaagagctcctcacagtttatttgcatactgtaaatttgcaaagtcagaaggaaaagggcagggagccgggcttccttgaggcaggtggctcttttaaagctggggcatgttgtcgccaatctgagcttgtttccatggacgcagccagccgggcagcctgttcccgtcaacctgagccctgatggagcctcggacctgacaggctgcctggggaactcactgggaggagggcgggttgggggagacccagaagccatgctggagtctctctctggcctactttttgccatagtttgaagggaaagttagtgaattgccaggatcaacctgcagtttccccaaaacttgcacaggagtggctttcatcgctgcatggggagacctcctttgcgggtctgcttagcggtagctggattgtctctgagggatacctggctttcctaactgttcctggagaatcttaaagacgaaaatggaagaaagggctcacatctttgttttgtgctgcaagcaaagtcttggaaaaatgaatgatgccaatggaatctatttcttgtaattaatttcctcaagctactggatctccttttcttgctgagattgtggtttggcagctgcagtttgatagccccattctgagactggatccctctcttccctcatctggtagttttcacgtcggggcattcctgaactccgtctgcctcgtttcaggctgggatcacagatcaggagcgaaggctttatgatattaactagtcaacagatacattctttgaagaatttctgtgtttttaattaccccacgaaagcctttggacgcacgggttatgaggggcattttgcattgctaaattccagccttgattgcaaacctgaaaagagcagaaactgctcagaacaagttgttaaaaccacagacacaagggaaaggtttctctctctccctccccctctctctgtccctgtttttaagtcctttcagctggaggtgaaactgcaacgttatcaaacatgccagtacacactgtttcccaggcctgtttttgcatgagttggggtagaaatgtacccagcttctgttccagtaggtggagaaagatgcttaaatcctagaagcactgttcacctacctttttagggtactgcaggtttagctcgagggttggagggcatccagaaaagcatgactaagagagaaaaagactactcccaaagctaacagggtggagtatcatagccaggacaggaaaattcccagcagggaaacggcctgtctgtaatgcagacacattgggtcataggtttgctttcacagaataagtgaaatggaacaaaagtcttttttgaattctcattccaagaggcccagtttctgcaggtgtgtcttttcgatcttaccttgtattcagtattatttcaagcaatctccattttaggcagtgtctactccagaccaaaaaacctggctaagaaagaaattttgttgattttgagacagggtctttctctgtcgcccaggctggagtgcagtggtgtggtctcagctcactgcagcttcaacctcctgggcttcagcgatcctcccacctcagcctccctagcagctgagaccacagatgcctgccaccacacccggtgaatctttaaattatttgtagagacagggtttccctgtgttgccccaggctggtctcaaaccactcctgggctcaagtgatccccctgcgtcgacctcccaaagtactgggatcacaggcgtgagccaccgcaggcctcccagactctgggtcagagggcagcttgagctcctccaccgactgctccaagcctttgccccagctcttggtgcctggggtggtgggagcagcatgggcttcgctgcacacggacctgggcccagatcttggttccatcggctgctgggagatcagttcccttctctgcacctccattcagcttggacgggaatctgtccttcctagaacagctgtgattaataactgagaccacacccatgttcgttgtggcttagcgccatgcacacaggtacctagtggatgttaactttcctctccatcctggtcagtgctttttttttttttttttttttttttactttttctttttctgtttttgagatggagtctcgctctgtcacccaggctggagtgctgtggtgcaatcttggctcactgcaacctccacctccctggtgcaagagattctcctgcttcagcctcctgagtagctgggattacaggtgcccgccaccatgcctggctaatttttgtatttttagtagagacgggttttcaccatgttggccaggttggtcttgaactcctgagctcaagtgatccacccgccgtggcctcccaaagttctgggattacaggtgtgagccactgcacccggcctctggtcagtgcttctgttgagttcaagaaaaatgaccaattcatctaaaaccccgagctggcagatgctctcccgcgcggcggcggctgacgtcagtgctactttcagcgtctttggtgcagtcttggtgttcgctctcaaatgggctcttttcagtatcacatatcatatgcaggatgcagaggggcccggcttacataccgagagtcagaggactcatgcggccacaagtaggttgggaacagtgtcccctaataggatgagttttgggctttaaaatttaaaaaaaaaaaaatgggggcattgatgagtctcgttggcaccttttggcttgtggaggctcgtgatctaatattggtctctgctgtatacccagcacactacctgccacttagccattccataaatatcgttaaataagtgaattaggccgagtgccatggctgacacttgtaatcccagcacttacagaggccgaggtgggaggatcgccttgagcccaggagtttgagaccagcctgggcaacatagcgagaccgcgtctctatttaaaaattaaaaaaaaaaaaaaaaaaagacaacttgagccgcacacaggttcttgccaaagcctctattagtgctgtgactcgggaaagaaaacttgtttttttcttcagttgactgggctcagccatcccaggtgtgagtgactcaggccttgagagcaggtaatggatccatagggagccctgtccccacccagggagactgtcccagcccctcccgatggctccttccagaaaggggcgcagtgggctgggttgcagggggtagttgtgtccaagagtcctgcaggatggagtgggaaggggcaggaggggtgtcctgcactgccagctgttcatctaccccagtgccatggaaacagagctcctgcttttccccaggaaggcgttgatacatttataggctagcattcaacatcagcgttgtgctctggcagtctcagcagtaagacataaacctaccaaggtctgggggaagcactgggtgttaccatcctggctcacgcgggagacgcatgctcctccgtgactgtttgtggccagtgagccaccagttgacaccagcaatccagccttctgcccctctcacttcacagatgagggaagtggggatctgcctaaggtcacactttggtgcatttctcaaatcaaacccaggagccggaatttttctactgagctcctgctaagacaccctgggtcgtttcctccgggcagtccatgtcatctgctgtggcgtgtatgttcatgggtgattctgtttctgtttttaaaccctgtgcctcttggttggtgcttttcctcctggaggatgctgcagacctgcagcggtcacctcgggccacccagggagcaggtgggcacacccaggttgcatctgtcgccacactggtgcaggccgtgttgcacatcactgctgccgggttgaccccacttggtatgaaatgagagggcctcttttctgaagcaaggtgttgcaatttagcctggggatgaagctgcttcttccaatacccagagttaacaccaaatgccacgagagtgagaaaataagacagcattgcactttcccagaaattgtcaccccagggtgccaccccacctcccaagcccactctgggactccttccacacacagtcacccactggttaccaagcctgcggggcaggtgctaggtgcgtgctgggagtcaggggtggatgaggtcttttgcagacagggcagagcgacctcagggcagagccatgagggcctgtgtgcagcggcttccacccaggcaggctccggctctgcaccttcagctacaggatacacttgctttcgacacctccactgtcatttagacacaaagcacaccaccaccgaaaccactccacagaatgtagagtttcttgccaggaaaataaaataaattaaaagtcactaatacttttatttaaattgcgagtacatttcctcgctgttgcattttgtaatttatacctgggagttaatttattgttatttacagttgcacaaggactcatggaaatgccttgtgtatcgagtgttctcattatgctgggcacggtcccaggtgccggggaggcaggtcatagtcctggcctcgtggagctgatgttctgaacgagagttgagtacccagtgggacatcctgagagcccaatgcaggtcctggtcagggctgtggggactgtggggaagacctggatggcaagaggagtagggacaagatctacaggattctgcatgcagggctgcaggccaagagggaggagttgggggttctagtccgctaggttcagggagccagacgtgtctgctgtcccaaacctcctgtgctcaggaacgtggttctgatgagcctgtatcaccttcccttccctccacctatgggtctgagtggcaggaagagttctagctgtgtcagccaaggccggggacaccagaggcacagggcttggtttaggagtcaagacaaggcatttgcttatttaaagaatgagttctatgcacttccaatgagtggttctgtggtcaggagggcggcacctggagagaggtcaaggtagaattgtggatttggaagggtggaggatggaaggccccagaggaaaccagcagtcagggactgaggaggtgatggcattctctagtgtgatgtgtggacagacagagtagaagaaccaaaaccagtcttggagcgacaggtgggtcagacggcagctttctctggacccgggtcaggaagagaagggtttccagcaggagggaagattgcgcttaggaagagaagggtttgctgggctcgatggctcacgcctgtaatcccagcactttggcaggccaaggcatgtggatcacctgaggtcaggagttcattttgagaccaacctggccaacgtggtgaaaccctgtctctactaaaaatacaaaaattagcccagcgtggtggtgtgcgtctgtaattccagctacttgggaggctgaggcaggagaatcacttgaacctgggaggtggaggttgcagtgagccaggatcgtgccactgcactcaagtctgtgtgacaagagcgagactccgtctcaaaaaaaaaaaaaaaaaaaaagagagaagggtttccagcaggagggtcagtggcggtgaagcttgcagctggcaaatgttgggttggatttggggtggggagtgaggccaggagctggtggaggggggcagaggaaggaaagatcactcactgctaagcctttcagatgagttccccgtggtcatcagaggtaggccttgctgtcttaattttacaaaagatgaaagccacaggaggcatagacttgctcagagaattcatactcagttcagcagactccagtattgatgctcaacccatgctgctgctggggagggctcaggggacaatgttaagtgagaccaaggaggtggcacccctgaaccagtctctccgtgagctcggcggtgagaaaacagtgcacagggagaggagccacagaaggcccgggatgtgtcacccagggtttcagctgggaggggacaaagccgatttgggtgggagagtggaagtaggtcccaagaacttttattttaaatgttttgatgacagatttaaaacttgagtaacttcattgtaaaatggccaggcgtggtggctcacacttgcaatcccagcactttaggaggctgaggcgggaggatcccttgagcccaggagttgggagaccggccttggcaacatagtgagtgagaccctgtcttgacaaaaaattaaagaattagccaagtgtggtgacatgtgcctgtagtctcagccacttgggaggctgaggcaggaggattgcttgcacccaggagctcgaggctgcagtgagccgtgatcatgccactgcactccagcctgagcaagagcgagactccgtctcaaaaaaacaaaaaccgaaaaaaccacctcactattctaggcccgagcccgagcttaaatatttaccccatatccaaccataagttaatcccgcacacaccttcatcagtttcttaaagaaactggtgccccagcacggggcatgccaacgtattagacaggcaacaacttagacatggggatgaaatgaattccatcttaaatctcaaagtgcacaatacagtctctaaaattaaagaaaagaaagatttatttccaaaaaagcccacagtgaaataattgtctcagtctgtggagagagctaatttggacagaatcacatattttgattcctgggatttttttaaaaggaatcttttaaagcagtaaatgaaatatttttggatgtagacaaaaatgacttacttagccattccactggcaatgtggaaaggatgaagaccaattttgagttagcaaggacaccttcagaaagttcagctcccaggaattgttgaccctagccatccatgtctgtatttcctgaggactattgcttacggaattaattgggactaatttctgttgcacctgatctccagccaaaacactcacattttgcctcatctgcagagacctgggctgagttttatctctgcgtcactgccgagttccctgcccccgctctgttaacagagctataattaactcacaggacgccaggcagccagattcggccaggcgccaagaaatcagccccaattactatattcacattgtcagtaatgcccacttcacagcttctgctaatttgaaatggcaagttccaactttccatagtaaaattaccatttttgtcctattctattacgtggtgatatttgtccattatttgggctccgtaaacttggcattatcacgacaattagttgttgagggttttctaaaatgatttgcaattacatctcttaagcggaaaactgtctgctctgatggagtgagaatccattccctctgtgccctagatccactttaggaattggcttttcataggggaacgtggtgcctcgggattttataataaagtcgagcctttaaaataagggctagccttggaacgttgcctgctttgtagatttccagtgttcaagttgtctgatttctttataaagatggagaagtgtctctgtccctctgggtctccgagttcccttgagtctgggcctctgtatctggatcccctcaagccctactttgttgtaagagccaaattagccaggggctactggttggtggctctgctgggggggcatcacagagtctctcttctctgacatttgctgaccttcaacccgccctggtacaggagcaccccattgaggtcctccgttttccagagtcctgtccctgaggaatcacctgcctgagtccctgagcttgggactggctggcctgattgggttgtacattttgttctcttttcagcagagaaatctcaggaggcaccatgccaggccactgtgcccctgcaagtgtgtctgagtatggcccaggaccctgcccatcactggtctgcaacaagataagcacagaagttcagagtaggtgtctagaaatgttcatagcaatttaacgtgacggtgacatccaagtggcattttaattttattttataaagatctgagtccacaatgggctggaaatgtaaaaatctgttgtgtgttcttctcccacagattgtttgacaaacattggtcattattattattattattattttgagacagagtctcactctgtcgcccaggctggagtgcagtagtgcgatctcagctcactgcaagctccacctcctgggttcacgccattctcctgcctcagcctcccgagtagctgggactacaggcgcccgccaccacgcctggctaattttttgtattttcagtagagacgggtttcaccgtgttagccaggatagtctcgatctcctgacctcgtgatccgcccgcctaggcctcccaaaatgccgggattacaggtataagccaccgcacccagccaaacattggtcattatttaatctcctcatctctgattggatttcactgtgatcatttactgtggctaaggcagagtgcttgctttttttttttttctttttcttcctttttttttctttgagacagagtctcactctgtcgcccaggctggaatgtagtggcacgatattggctcactgcaacctccacctcccgggttcaagtgattctcgtgcctcagcctctcaagtagctgggattataggtacacatcaccatgcccagctaatttttgtatttttagtagagatggagttttgccatgttgcccaggccagtctttgaactcctgacctcaggtaatccacccacctcagcctcccaaagtgctgggattacaggcatgagccaccacgcctagcgagtgcttgctttttctgctagacagtggtcctcaggcccaatccctgagagaggggcttctgagaggtgaaggaggcaggagttcttgcccctgactctcaggagctggtgtctcctgggcatcactcacggatgggctgattattgctcattaccccacaggatccgacagttccagtacaagctgcttctttgagacagagtctcaccctgtcgatcaggctggagtgcaatgctggcgcgatctcagctcactgtaacctccgcctcctgggtttaagcgttctcgtgcctcagcctcccgagtagctgggattacaggcacccgccaccacacccggctaatttttgtatttttagtagagacgaggtttcaccttgttggtcaggctggtcctgaactcctgatctcaggtgatccgcctgcctcagcctcccaaagtgttgggattacaggcgtgagccactgcgctcggcccagaagacttatattttatgatataagaaaattatatgaaattcccaaaaaaacccagaaaattatatgaaattcaaatttcattgcccatagtttgttgtttttttaaaaaaaaaattgtagtaaaatacacataacataaaatttaccattttagttattttgaaatctacagtttagtggaattaggtacattcagtgttgtgcaagccatcactgccatccatctccagaactttttcatcattccataactcacctccataaataaagttttattggcactcagccatactcatttgtttatctattgtctgtggctgcttttctgggctacagcagcagagttgagtagttgcaacagagaccatatggcctgcaaaacttaaaatatatttttttcttctttcttttctttttttatagagatgaggtctcactacgttggccaggctggtctcaaaaatcccagacctaagcagtcttcctgccttgcctcccaaagtgctgggattacaggcgtgagccatgtagaatatttactatctgaccctttccagtaaaacttggccaacccctgtcctggtgcacactctccttacttcttagttaccatagcaactgcctaactggtctcacttcctttggtttcattccctttctgtatatctgccccctggaggagtttttccaagatacaattctgattgattaacttcgctggttaaaatcttttagcaggctggtgcggtggctcaacttgtgatctcagaactttgggaggccaatgtgggcagatcacttgaggcctgaagttctagaccagcctgggcaacatagcaaaacaccatctctactaaaaatacaaaaaataagccgggtgtggtggcgcacgcctgtggtcccaaccacttgggaggctgaggtgggaggatttcttgagcctgggtggcagaggttgcagtgagccaagatcatgccaccgcactccagcctgggtgatagggtgagacactgtctcaaaaaaaaaaaaaattcctttagcagcatcctgtagactaatgccatgtctgggaacaccagtcccaggataactgcactagttattaaaggctctataaactcttgcagaaaagaaacctgctgaacatcgatcaacccagtacccttcaaaactcattgactgggcaagtctttttccttttttttttttctggagacagtctcgctctgttgcccaggctggagcgcagtggcatgatctcggctcactgcaagctccgcctccagggttcatgccattctcctgcctcagcctcctgagtagctgggactacaggcgtccgccaccacaccctggctaatttttttttatttttagtagagacagggtttcaccgtgttagccaggatggtctcaatctcctgaccttgtgatccgcccgcatcggcctcccgaagtgctgggattacaggtatgggccactgcatttttcttatcacccattctcattagcctacagcagggattggcaaactgtttactgtaaagaaccagatggtaaaatactgtaggtttcggcagggccatatggtctgttacaaagactcaactctgctgtaaagtagccatagataatacaaaaatggtgggcgtggctgtatgccgataaaactttatctaaaaagacaatcaggcccatttgaactcctgtcctgtagagcagtggctgtcaaggtgtggcccaggccagcagcatcacaggacctggggacttgttagaattgcagattctgaccaggcgtagtggctcacacctataatcccaatactttgagaggccaaggtggaaggattgtttgaggagttcaagaccagcctgggcaacatagcgagaccccgtctctacaaaaaaaaatacaaaaattagctaggcgtggtagcatatgcctgtattcccagctactcagtagacttgaggattgcttgagacctggaaggttggagctgcagtgagccgtgattgcgccactgcactccagcctgggtgacagagcgagaccctgtttcagtaataaataaattaaaagtacagattctcgggtctactccagacctgctgaatcagaaaatacgcgggcaggcccagccgcctgtgccttcaccagctctcctggttaaggcctgagaaccctgctacggaaccccgagtacctttcagaacatgttgacctcattcgcagggatcagtggccctttgtcatctggtctctggccagtgtccctccctcatctggtggacttggtactgatgccgaaccacctgtgggttccaaacgtgccattgtttctcccacccacgcatttgcacaaatgtggtcctgtgtggctcactcccttttctgccgccaccttctcccccactgcgccatgctggtctcagctcggggcttacctggtcccagaggtgtgttgggaggtccccaccccttgcctctgcccgttgccttttccacccctgcactgggtgtgcataggtgcgcagggcacgtgtgtgtcctctgcggtcactgacttgattgtctgcctttcccaggaggacatgggctctgtcgggacattttatccgtctgtttacaacatgaaatagacacctccgaaatgtgtgtgtgttccgtaaatgaaggagcagagggaccccttcggagcatctcagaggccaggaagcctggcttctggccgccctgcccgctcctcacgtgtgaggggaactggggaagtcgagtcagcccgctggggttcctgattctctgcggttctgggaagagcttgcagtggaaggcctcccagccatttcctcttctcccccaactgtgactcactgattgattaatgtttggaaattgtgactcatcttgttagagaaggaaaaggaaattttattctcttcattctccctccctttcaaataagtaataaataaaaagtggctgatcttccacttggtgcggtaagaagcatttaaatacattcccggccctcataattggtggcttcttggagaaaggtacttattagaagaaaaacacttccctatgtgttgttgttcggccttctcgttgatgaaattacacggtgagttggtgagcgaatttaccttgcccctttttaaaggtatttgtggcagctcttgttgtaggaatcaggggagaggagccacttctcttttagtaagaaatgcgaagagtggcctctccatcttcagagtttcaaaatgagttcactctggtggtgagtaatgatgtcttaagctggcttattaaaggcggaggaataagatgttcttgctttacctcacgtaccaaatatagataaggcgctggatcagcagagcctcaggcccgtgccaggacacagtcgggcctggcgatgtctgttttgtctcacgactggagggttgaaggggaagcacagcctttgcttttaagggttttcttctgggaaatccacaaaaaaaaaaaaagcatttgttcacttctcacgttgtgatgttgaaattatggcttggagttttacatttgccttttaattctctttatgggcagcatgtctgtatgtcttaggctcttggttctggaagaccaagtaaattcagtatcttttcaaattgtaaccctctggtctgggtaacacagcaagacccccatctctacaaaaaaaatttttttaagtcagccaggcatggtggtgcacacctgtagtcccagctactcaggaggctgagacgggaggatcacctgagacacgagtttatgtgtctgagacgcctgagacaggagtttatgaccatcctgggcaacataacaagagcccatctctatgacaaaatgtgaaaattagccaggtacagtggtgcacacgtgtagccccagctacttgggaggctgaggttgggggatagcccaggagttcaaggctgcagtgagctatgatggtgccactgcactccagcctgggtgacagagtgagaccctgtctcaacaaaataaaattgtaacccaaagtaagggctcaataaatgttagccactgtgattattctattattcccgtcctcgttgtaaatatttgtgtggcttggtgcctagcgtcttttgtagctgtatgtattgccaaggagaatcccaaggaaaaaaagtagaaatatggttaaagctggctgggcacagtggctcatgcctataatcccagcactttgggaggccgaggcaggcagatcacttgagtgcaggagtttgagaccagccagagcaacatagcaagaccccttctctacagtgtgctggcatttgcagtgcagccaccattgcccatggtagcgatgaggaagctgtggcttagaccaacttccagaatcactgctctggtcacacagctgctcgcaggtggcatcatgaacacacctagtctgactgttgcttaaccacgacaaactccatctccttccactttgcctggctgaggatcggatgcattacatagaaatatttgaatttggaagctgttgaaatacaggttcaggccaggcatggtggctcatgtgtgtaatcccagcactttgggaagccgaggcaggcgatcacctgaggccaggagttcgagaccagcctggccaacatggtgagaccctgtctctactaaaaatgcaaaaatcaactgggcctggtggtgcacacctgtaatcccagctactcgagaggcaggagaattgcttgaaccctggtggcggaggttgcagtgagctgagatcatgccactgcactccagcgtgggtgacagagacagattcagtctcaaaaaaaaaaaaaatgcaggttcaaggaagggagaggatgatttgtgttccgctctgcgcctcctccctggtccattcccttctccctgttggaccattgctgtgacacaggtgatctgagcatcaagaaaaaggcatttcttgcttctcagtgatattagcaagcacctgctgcttgtattcactgtgctgagttctacccatttattctctcattcagtctttacatctccctgatgaggaggcataataatatcatgcccattttatagacttgagggaactgagcccaagccattcagccagagagtaaccgagctggagttccaccaggtctgtctgctctgatagcaggcatgcctgacctccgcacctacccacttccccacttctgcagtctcatgtgtcccagggaacgcacagctggggcccctctcctaatttgcacccttcctgagccagttcagaagtcccagactgtgtctttctggctggctgtgtcactgggcccaaggatggtgctacggggctaaagatcttctacactgaccctctccactaacgggaaatcagaaaagggaacttgaagagaacattggcaccaatggttggacctagggatttgtagccacctttctaagggagatagaggacagggctaagagtcacaacttttgttctctacccttgagcaatcgaatacttgcaaagccctgtttctaaggttaaaaaaaaaaggctgggccctgtggctcacgcctgtaatcctagcactttgggaggccaaggtgggcggatcacgaggtcaggggatgagaccatcctggctaacacggtgaaaccccgtctctactaaaaatacaaaaaattagccgggtgaggtggcacatgcctgtagtcccagctactcgggaggctgaggcaggagaatggcgtgaacccgggaggtggagcttgcagtgagcccacgtctcaaaaaaaaaaaaaaaaaaaaaaaaaggaggcagctttgggggacaaaacattcagcgtggccggctctccgcatcttacagtggtagggatgaaatgcacgcgccctcatttgaaatgagaatcgcagtgcctcagttaaacagcggcctctccggatgccaagctgagatcatttccatttctgtgccgagatcggccttttgcagagatagatgggttatatttatcaccagctaacttattagcatgtgacaccagatacaccaaattgtaatctgactcataaaaggatatgtagttcatgacttgatggtgaagcaggtcagtttaaaaaaaaaaatcagatggattatggagtcaacgtttccttcagaaaacttcttcaggggtaaactggtataataggaatgtctgttcagactgttttgaaaacagttaccttgagaattttgtattcctttgacccagcaatcccacttttgaaaatctatcccaaggaaaaaaattagaaatacagttaaagccgcctgggcacagtggctcacgcctataatcccagcactttgggaggccgaagcgggcagtgcgggttgagtgcgggagtttgagaccagccagagcaacatagcgagaccctgtctctacacaaaatacaaattgtttgctgggcatggtggtgtgcaccagtagtcccagctatctgggaggccaaggcgggaggatcgcttgagccagggaggtcgaggttgtggtgggctgtgatcacaccactgcattccagcctaggtgacacagtgagaccctgtctcaaacagaaaaaaagaaatgtggccaaagctttatgaacaataatgttaattatagtgttattgatatactaaaaacaggtgggagggaacaaggctagtgtccaatatagaggaacggctaaatgatgctaaaaatcattcattcaaattattatgtaactgatattgtttcccaagaatatttactaacacagaaaagatcatgatatcacctaaagtaagaattaaagatgctgtatcaccctagtttaatgaaagaaaaatgttcaaaaatataaagacaagatgaatatatagacatacagcacaatagatgcaaatacctgcacatcacacaagggctggtgaacatgaggacactggattcttccaggcctttttctaagtcttagcagggattatttttggttggtgtgagattggcttttttctttgttatgcttttctgtgttttgcagattttctccatagagaatgttacttttttttaggcagggaacggtggctcacgcctgtaatcccagcactttgggaggctgaggcaggcagatcacctgaggtcaggagttcgagaccagcctggccaacttggtgaaacaccgtctctactaaaaatacaataaaaattatagccaggtgtggtggcaggcgcctgtagtcctagctagtagggaggctgaggcaggagaatcatttgaacctgggaggtggaggttgcagtgagctgagatcacgccactgcactccagcctgggcaacagagtgagattccatctcttaaaaaataaaataatttaaaaaaaacaagagaatgttactttttaatttgaaaacaataagaaaatgtccaagtctgcaaaatagagtctttttgaaagactcttcgtacttattaatttattcaccagacatctttaaacggaaacagtggttaagtgtgagagtttggaagtcccacagatcagaaccccagctgccgtttactcactgcagtccctgggcaagtaattcagtcatctgagtttccttgtccctacccgtgtaatgggggatctctggtacccatctcatggagctgctaaagtgattaaatgagacaaaagtatgcgagccctttgctggaacatgtttctggaatacttgctgttattagtggaaatattgccaccgtgccatgtgccagactccgtgtgaagtgtgcagagtgctaggtgggtaaaaatagcccccctccttctagaacctccaacccaaaggtgggaaggggcacacaggtaacagaaatgacagcgttgacatctggtgtgtgctgtgtaagtcatgtcatctgtgctgaaccctggggctcaggagagacgtagtggggctgtcgtgggaactgggccctacttgggagccaggatgtgggcccggcctgaagctgcagcagcagcagcagcagcaagatgtgagaatatttaggagatggaacttggttcagtgggaggagtaacccaaaaggactctagggtggtcctgagattttcttttctttttttttttttttttttgaggcggagtctcactctgttgctcagacttgagtgcagtgacacagtctcagctcactgcaccctccacctcccaggttcaagtgattcttcttcctcggcccctcaagtagctgagattacaggtgcgcaccaccatgcctggctaattttgtattttcagtagagacggggtttcaccatgttggccaggctggtctcaaactcctgggcttaagcagtctgcccacttcagcctcccaaagtgctgggattacaggcatgagccactggccagtcctgaagttttcacagaagcatgaaaacacagagagaattccttttctgtcataaggagatgatgcccttttttttttttttttttttttttttttaagagacagtattgccctgtcgcccaagctggactccagtggtacagtcgtggctcactgcagcctcgacctccctggcttaagcaatcctcccacctcagccctcctaagtagctaggactacaggctcatgccagccaccatgtctggctaatttttaaattttttatagagacacggtctggcagtgttgcctaagctggtctcaaattcctgggcttaagtgatccgcccacttcggcctcccaaaggattacaggtgtgagcaaccacgcccagcctggatgattggatggtgcctatagattcaggaaaaacagacttttcccccagaatgttttccttacctagctctatgtgtgtgcagtgtgtgtgtgtgtgtgtgtgtgtgtgtgtgtgtgtgcaagagagcgtggctaagacaagggtattcacctggcatcctcattcccaagttgccaatactcctctccccttttttcttaactcaccacctgggaagttttcctatttctctccctcctatcccagataagaagaattgccttctttcctcccagctgatttgcttttctcgtcattatatggcaaaccaggctgcactcccctcctaaggcaggcggtggttctctttgggctctgagtcctcagtgttctgcctcttcgggtgccaaccaggaaagccgccttccgcttttagagcaacgtgaagaaatcatggcagcccacgtaagatctctcattatttctgttgaaactgattctatcgagggtggagtgcattgcctttaatttctttgtttgcgtgtattttttttcccctctctctcacaagaagtatattcttttctttcctgtttgttcctgctcgatttggggaggctgctgtttccactgcctaattaatgggaaggtgttctgcggaggatttcaccgcgtacatattctctgtttggacatggtacaacctgtggacccttttaaacatagttacatgtttgactctttatagggtaataactcgattaattttgcaaggctttttagaataccattgttctcttgaaaagaacaggtttgctgttttaacaagactttaatgccatcgagatgcctcacattggcacggttgcgtaagaatcgcacggtcccatgaaatgaaattgagagagctttttccggcgcctggttggttggggcggcctccgttcggtgcttttttcatcctcgacccagtgaccaactgtgtttgccctgatgtttctttcaattccaccattccgaaatgtctccggaatctgtcgttttagcttttgcagcaaggttcgttgtgtttgtcttgcccgcttcaggtttctctaatgagattcacgtgtaaaggaggattggcaattaatcggatgactgattaattgtgagattcttattcttaccaaggaatgctatggaagtcctggcttcagataaaattctcaatgagggccagttgcagtggctcacgcctgtaagcccagcacttgaggaggccgaggtgggaggatcacttgagctcaggagtctgagaccagcctgggcaatatgacaagaccccatctctgcccaaaaagaaaaaattagctgggcatggtggcacacacttgtgatcccagatacagctacttcggaggctgaggtgggagaatctattgagcctgggaggttgaggctgcagtgagcagagatggcaccactgcactccagcctggacaacagagcaagaccccgtctcaaaaaagcaaattctcaaagaggccttaatataccttttttaatcataagctttaagagcctggtcatgcaaagataattcagtgagatgaaagattgtttatttcctactgtgcattggtcacaactttgattccacagaagggcagtgtgctgtcctaacagagctgagtgtgtggagtcttaagagcttcctccctctcagcaaatgtgtattaaatgtttctgctttgccagttccagtgccagtgccctgtgattagaaggtgagcttcaccgaggcctcctggtgttgtggagagggagccccgggaatggctggatgcagaaggtgaaggttgagatgcaggagagggagcagttagccttctggcttgggctgtggtgggtggtgccctccatgagattccaaaaaggactagtttggggaggaatgaaattggcatttggagagtgtaagatactagtggagtctccaagcagagctgcccaggagacaggctggccatgaggagagtagcattcacctggatatagatttgggagccactcaccgggagagagattccatctgtgtgtccctgggcagcgtgatcatgggaatactgcttaacctcaaatccttggctttctctgtaaagtaaatgtaataagatctccacagggtttgctgtgagggttgaacgagctcagtgcacatgaaaatgccctatacactcgaaaccagctataaatattggttattattgttaggatgctgacgttcaaatataaattgccaaaatcatttgggaagcattgcatactccattcccacatggagagttgcagggcatgtgattatctgtttgttcatttagtcacaatattgatcaatatagaacaaagcagtatattttaaaaatcaaccaggagcagccattctttgaagtgttatgcaaccattaaaaattaggtttggccaggcgcggtggctcaagcctgtaatcccagcactttgggaggccgagcaggcagatcacctgaggtcaggagttcgggactagcctggccaacatagtgaagccttgtctttactaaaaatataaaaatcaggcgtggtggcaggtgcctgtagtcccagctattccagaggctgaggcaggaagatggcttgaacccaggaggcggaggttgcatcgagccaagattgtgccactgcactccagtctgggcaacagagagagactccatctcaaaaaaaaaaaaaaaaaaattgcagagagtttgtagtacatgggtcaggcttaagcaaaaagaaagcaacttaggaagtatatatacagtattattacaactacaaaaggaacaggcagaaaaaaccctggaaggaaccatgccaaaatattaagtctcctttagggagcaggacttggagtcgtatttctttatgtttttctgtgctttaaacatactctgccatgacatattccttctgtgatcagaaaaatataaactaacagtaacagcagaacatcccttccccccaaatacaggtgggaattagatgtctgaagagctgaaaacacaaatgtatcgatttcatctttttaatatttccctgcaattcatcttgccttaatcaccgttttctctctgtccgtggaatcacagagctaactgcacagaaacggtgtgaatgaaaccaagttggccctacgtggaatctcaaatcgctctaccctttcgggatcttccgtttaagtttttggataatgaaaatttgatcttgatttcaactaaagctgttgtgtataaatctaacctttctatttagcgaaggtttttagcggtccatagaggccggagataacgaactgttacttgtcttctgtctttcccgtgtctgccatgggttctggtttgtaggcagatataaatgcagatacgtgtgcccctgtcgtgtctgaaaggatgatagaagcgagctgaagactccttcctgggagaaatggatttctcccttgcttttagaatcctcaactcctcccattcattctgagcaatagccatcataccatatttcatcaatctcagatttcttttttcttcctttttttgaaacagggtcttgctctgtcacccaggctggagttcagtggtgcaatcatagctcactgcagcctcaaactcctgggctcaagcaatcctcccacctcagcctcctgagtagctgggactgcaggtgtgcaccactgcaccaggccaatttttgtattttttgtagagacagggtcttgccatgttgcccaggctggactcaaactcctggcctcaagtgatcctcctcccaaagtgctgggattccaggcatgagccactgtgcccagcccaatctcagctttctggtttggccaagggatttactttcaagttgtaaagtaaacaacttgtgcttttctgcttttgccatctcctggttccccctgctgatgccacctctgatgccacttgtcacctttctctaaaccacccccttctctcacctggcaggaaaattccctgcctatccttcagtgaccccagcaccggtttcagtgccagaaaatgtgctgtcctccctgtatttggctcgcctgtcctccccctcactgatgttttctgctcattgggtgggggaggaatcacatgggttaggtgcccatccgtccactcctgtattccatgcgcgaccacggtggcccaaagttggattccagcatgtgatgttgaatgaggcaggcgtggctcccgtccccgggctgcacccagcagttcatcccggatccaggcctctgccttcctctactctcacctcttctcctctgcagagaagtgactgctgctggttagtagggtgggaagtggaggctggagggcatttgagagggcagagctgagttctggcctgatccagtcactcaacagcccatttcctcatctaaaaatagaataataatcaattacttagtacctgtcaacacaagcctatgtatatatatatatattttaagagaccaggtcttgctctgttgtccaggttggagtgcagtggcgtaatcatggctcactgcagcctcagctcttgggctcaagtgatcctcccacctcagcctcccgattatctgggactacaggtgtgtaccacgacatctggctaactttttaattttttatagagatgggatctcactatgttgcccaggctggttgcgaactccttacctcaagtgatcctcccacctcaccttcccaaagtgttgggattacaggcatgagccactgtgcctgggcaagccaatattttaacaggccctttacctatgtaatttcacttcaacttctcggcaaccctgtgaggtcgggagatcgggtgttcttgtcaaaggcacatcaagaaatgacaaggcggtaccgggcacagtggcttatgcctgtaatcccagtgctttgggaggccgaggcaggtggatcacctgaggttaggagttcgagaccagccttgccaacatggtgaaaccacgtctctactaaaaaatacaaaaattagcctggcgcagtggtgagcacctgtagtcccagcttctcaggaggctgaggcaggagaattgcttgaacctggggggcggaggttgcagtgagctgagatcatgacagtgcactccagcctgggcaacagagcgagactccatctcaaaaaaaaggtgaaagaaatgactgagcaggaatttgggcccaggtttcgtcaccaaattttgtatgttttagctatcattattgctgtccttgttattgatgttatcggccctgagggtataatgatgagcagaatatatcccgattctaagaagtcaagaggaaaggaagctagctttgctttatttcaagtttctcattcttttttgccgtcattcttttttgatcacaaaatgcccacctgtgctctagaaaccacgcctccattggacaggctttgggagtactggctccagtgatttgggtggttttgcactgatttctcatccagcaagcaaacctcaacaccttcagactgtccccagcaaccagaatattatcgtttcagagtttcgagggaccatagctgtcagcctgtctgtccaccctgcctggcgctggccttaattggaggatggttgcatttggaccagagcagaggcagatatctcattcctccaatgaaatacgagggcttgtgcaacaggcttcttatctcatctccacctgatcccaggagcctgattcctttccagggagcagcagatgagacttttctctttccaacaccagtgtgtgtgagcgagtgaatgagtagggtttaatggtgattaaaggcgtggtcttcattttgacaccttttgttctataacaagcctgacaaccatgaacctacttcttgccagacagaaaagtcattcccgtgccttgcccctgagcctcctcggaaatggcagagctgcacatgaggaattatgcttcctcgaacagcaacatatgagtcgtgcctcttccctaacaccgctttgcagtttgtgactataatctaatgaatccagctgacgttgatcaggtccttggtgtgggcgaggcactgtgcggcggggagggggcttccttcctttgttcctccctagtgcaaagcagtgggtatcacagacgaaactcacaagccacaaagaggttcccaggtcgagctggcctttgtgcccatgacgtctccctcccagacctgttctccttccaccatccttggttcccagtcagggcatggtggtgggggaagggcagggtcagcagggcatatggcctggccctgtcctgcagtggggttgactgcggtactgctccagaaaaatggactttgttgccagcgttaaaaaatgatgacttggccaggcgcggtggctcacgcctgtaatcccagcactttgggaggccgaggtgggcggatcacgaggtcaggagatcgagaccatcctggctaacacagtgaaaccctgtctctactaaaaatacaaaaaaaattagcggggcgtggtggcaggcgcctgtagtcccagctactcgggaggctgaggcaggagaatggcgtgaacccgggaggcagagcttgcagtgagccgagatcgcaccactgcagtccagcctgggcaacagtgtgtgactccatctcaaaaaaaaaaaaaaaaaaaaaaaaaagatgacttggagattgaaagaggttgaagagatagctaaaggcaatgtgtggacctcatttagattacagttggaaacaagccagcagaaaacgtgtttctgaaacaactggagaaattagaacagtgggtttctggatattttatgatattgaggcgttattgctattatttgtgaagtgataatagtgtttgttttgttttgttttgggacagggtctcactctgttgcccaggctggagtgcagtggcaccatcagggctcactgcagcctcaacctccccgggctcagctgatcctcttgccccaacctcccaagtagctgggactacaggtgcgcgtcaccatgcctggctaatttttgtattttttgtagaggtggtgtttcagcatgtcacccaggccccggattatagtgttttgactgtcttttttttttttttttaaaggatccttatcttttagagaattcacactgagatatttctggatcaaatgacttgatatctgagatttgcaacaattaatacagtaaatgaaacaagcctggccgagagttgatactcattgaaagcgcatgatgggcacatggggactggtgttactgtttgcttgatgtgggcttgtctttgagattttcgtagtaaggtggtattttgcacaaaaccccagctctgatttttctgggaaagtgggaaggcctggtgattgcaggctgctggagctttagatgggtgggaatgtcctaggtggcggatgtcccatggtcatgtggagggaaggatagaaagagcatggcagggggccaggtgccccgacaggtgagggccacctgcagggaacatcagaggtgtgtgcttcttgagggtcgttacccacggtctgtatctccctatattcaccaaaatacacgtgggacttcccttctgatcaggtgcacagcctaggggatcctctgggccgagcggacctgccagggaagctctcaagtggtctggatagaacaagcagggggcttctgcaacaagccggcctagctccaggacacccccatccaagagggatttgacagatccatcccagccccataacttggttcctttgcagagggatcatttggaatttttttattttattttattttattttattttggtgagatggagtctcactctgttgcccaggctggagtttagtggcgcaatctcggcttactgcaacctccacctcccgggtttgaatgattctcttgcctcagcctcctgagtagctgggattacaggtgccctccacttatgcccaggtaatttttgtatttttagtagagatggggtttcaccatgttggccaggctggtcttgaactcctgacctcaggctatccacccgcctcagcctcccaaagtgctgggattacaggcgtgagccaccgcgcccggccagaaatctttttccatttgccacacttgtgacttagccaagtgtctttttcaaagactaataaagccttcacagcttccgaaacaccgcgctagatctggtagccgcggacaatttggattccttctccagtgggaaagattcaaaactgcaggtttcagaagcctttaaaagcttcttgtctgtgtgatgttcattgaatgcaaattctttcgcaaataatggcctgcaactgctttaaagaaataaactcatcttgctgagcccgggcatgtatgcgtcaatggtgaaaaactgcaaacacacattctgttagcagaatcgtttaattaaaccacattcttgaaatggtctgcactataggaagggatgttgtgtgcaccacactttctaaaaagatatgtaaaaggtccccagaaacatataatcagaatttatcctagacaagtaatttcctctccccatgtctgtgtcctcatctgtaaaatgaggtagtggggccaggacgtctgtaaggtccttgtagtgatgctgttcacaggtgctgttacttgggggaatcataatgctctagggtttttggtttggggatttttctttgtttttttgagacagggtctccctgtgttgcccgggctggaatgcagtagtgtgatcgtagctgcctgcagcctcaacctcctgggttcaagcagctccccctgcctcagcctcccaagtagctgggactataggtacacaccaccacaactggatatttgttaaaatttttgtacagaggaggtctccctgcattgcccaggctggtctccaattccgaggctcaagtgatattcccaccttggcctcccaaaatgccaggattacaggcatgaaccactgcacctggtactagggttgtatcgtttgtcttttaaaaaatcttcacataaaagttaattgtggggtgggagggagttcctatatcaaaagtatgttgaaatacaagagtcaagaggttgagtctggggtccaggtgggtcccctggacaaccctctgcagacttgctgctgcttttgttaaagtgtctgggagtcccaagccacatggggtaggggcatcagaagagtctagaattattatttttgagacgtggtctcgccctgttgcccaggctggagtgcagtggcgcgatcttggctcaccgcagcctccgtctcccaggttcaagtgattctcctgccttagcctcctgagtagctggggttacaggcgcgtaccaccgtgcctggctaatttttgtatttttagtagagacagaattttcccacgttggccaggctggtctcaaactcctggcctcaagtgatccacctattttggcctcccaaagtgctgggattataggcatgagccaccatgcccggcctgaagagcctagaattcttcagccttctccaggatatccctgctgcctgggtgggagacaggggagagttggtagggagaggactgtgctgtggaggtatgactctgcaaggtgaccccggctcagcagctgatcagctctgtggccttgggcaggacacggggctccctgaactcctctctccacattggtaaagggtctggtcaggccagctgtgggctagtggtgagagtaacagagatactgatctgttactggaaacgccatgagctgattgctgtcattaacctccctgtactgagagttaaacaaacaggcacctaggatgggtgcagtggctcacacttgtaaccccagcactttgggaggccaaagcaggaggatcacttgaggccaggagtttgagaccagcctgggcaacatggtgaaacctcatctctacaaaaaaaaaaaatgcaaaaaattagctgagcgtggtggcgcacacctgtactttcagctacccaggaggctgaggtgggaggattgcttgagcctgggagttccaggatgcattgagccaagatcgtgccactgcactccatcctgggtgacagagcaagaccctgtctcaaaaaacaaacaaacaaaaaacagcaaaaaaaaaaaaaaaaaaaaaaaagcaggcacccagattttcctgtactgtaaagagaaaaaccttgaatttggattaggaaggtctgaccctgtcacaaacaaaagtgaccaaatcatacattttgaaattcacctcctttgacaaagccaggatcctcatgaaagagaagattctgatgtgaagtcagccctgcactttcagcctttccagcgtgcaggttgatagaatcccacactttttagcggtcgaagggaacttaagatgtagcagttatttcagagttgtgaagcagagaccaaaatagtttgaagctgaattttaagcctcttttggccagatcaaagaaacccaaactcctaaaaataccaaattagctttttaagcatagtttctatctttagttgaaaatgtgtgcagtgtatacttctggaacctgcttaaatgtatccattgaaatgaagatgtaccttgaaaaaagaggcgcctgatctgcagtaataattaagtaactttctctgcccttgactcttgccccaacgcgtatcaggattccacggtcccctttctccttcctttttcaattctgaaaccatccttgtcttcttgccggagttagcaccaaaaaaaaaaaaaaaaaaaaaaaaaagttactcttgtagtttacatgtcataaatgaaaatggatattccctcccagggcataatctgaaatatttgtatttgggtttcaaatgtgtgataagatgctctctgtggcagatcggcctttctaattgctgtgcttgttaaaattcaaattaggctttattctcttagcaaacgttgactgacagttgcagagagtggcccagaatggcactgagtgatgggtggccaggaagcctgcggtaggaaattcacaacagacctttcatagagaaacggctggccttgactttgagtccttccatcccaggtgctttagagacagagccgcctgacccttccttagcttggcccgggggtgcgttggagggggctgttcccacctgcagttcctaaaggacaaactgtctgatacaggcttcatgtggggctggccaaaccccaccgaggtttgcacacaccccaggattgcagaacctgagctcgaggagtgggacatgacctccccacgcctctgctgagtatcccagaccttcccatgtctttcttttctttctttcttttttgaaaaggagtcccattcagtcgcccaggctggagtgcagtggtacgatcttggctcactgcaaccttggcctcccaggttcaggcattgctcctgcctcagcccctcgagtagctgggattacaggcgcgtacgaccatacccggctgatttttgtctttttagtagagacagggttttaccatttggggcaggctggccttgaactcctgacctcagctgacccacctgcctcagcctcccaaagtgctaggattacaggcgtgagcccctgcacccggctgaaccttcccatttctaatcagaactgaccctgggatcaactgacctccttggagtgtagaggcatcctggttgtctggggactttgggtgggatctctgccagttttgcctgcagcagaaggaaagggaagtgacttatcttaggcacctgctttgaacaaggcactgagctgagcacgttcacatgtatctactaatttaatcctgacaacagtcctgaaaaagatactttccccattttccatctggggagactgaggctcagagaggtcactggcctgcccagtatggcgctgccagcaagggttgagctcatattgagtctgggtcggtgtgaccctacagccatgcccttgacactatgccattcctgccctcctggctggttgtgttctgctcacttccaagaatgatttccaatggcttgcaaagttacagttagcacagtatgacaagcaaggcatgagactgggagtgagtgggaacgaagaggaaagaaagtgagaggaggctgggcatggtggctcacacctgtaatcccagcactttgggagaccaaggcaggaggatcactggagcccaggagttcaaggtcagcctgggcaacatagggagacccaatctctattgtaaaaataaattgtaaataaagtgagaggaaaaggcagttagaaccagaattagacaactatccaaagttccccaggccctgtgtactttgtaaagatgagatacagacttgattgtgagcttcccagcaaccaatgcaaaaagggcaaccagataagtcatgtgacttacgctgtccacaagctcaaaacaaagcatgtgttgagggaaagcacagctcctctggtgttggcaaaaaaaattctccctaaagatcctcgtaaaaagaagtcacttggtttcattgccggttacaagttgctggcaaccaagtgccactggcaggtatcttacagcttaatagaagcagcattacattggtctaaaagaagacaagagaattacaggcccatttttaggagtggatacacctctttctataggtagaggaacttctgtctggatttgtgagttgggtgatttcagatactgatttatttttatttatttatttattttgagacagagtctcgctctttcgcccaggtgggactgcagtggcgctatcttggctcactgcaagctccgcctcccgggttcacgccattctcctgcctcagcctcccaagacgctgggactacaggcgcctgccaccacgcccagctaattttttgtatttttagtagagacggggtttcaccgtgttagccaggatggtctcgatctcctgacatcgtgatccgcctgcctccgcctcccaaagtgctgggattacaggcgtgagccaccgtgcccgggccagatcaactgatgttttgagttcagatacagagtaaatgtagcttgtaaagtactggtcattagaaccagagaatgaactctgtccctcttttaaatctggttggtttagtctttttagacacataccgttcggggacaaagagatcgatcagaattttcttgcctcctcggacggcatctgacctggctaggttgcggggatctgttggagagagaagcgtgtcatggatcccgcatcgaaaacagccttgaagagggccaggagcacggaggacctggggagggccctgaccactggacacatctgccctttgctcctcctttttgtctctgctggtggccctttctgctgtattcacgcgccctcaccacctcctgtgtattcgtgtgctggagttcagccgccaaggtggagagagactccctgtcggggaaggactccggccccaatgcctcctcctccaggccaggccgccatggtgggtgggaagagaggccactcctagagaaagagacactgtcagtaggtgtcaggaggtgtcccgggagctcgccgcgtggtaaccaacagacacagcccttcttggcattcaaagttgcaccctgatgcctgtgagggagtcgtgactttctgttaccactgacccagggcagagttttaaacagtgaccttaaggcgaaaagctccagatctcgttactgaccagtgcagccagccactgccttccttcctttttgattctaaaaatgacactcgggttttagagggttgcttttcaggcagccgaaatccccgcatgcaccttctcgtacatttcaggagagaagaatcaagtccatccacggtatccttgcccaggtaccggtatccatcagagcgtgattggggtttcagcagagccaggcctgcttttcctggcagaggctgggcccctttagatttttcttgtagattttgcttgagcctcccagcccttccttgctcagcacctgtgacccactgggtcacagtgacccacatcccatggctctgaccgcagctggactcatctcacactcacgttcatcacggctcccagaaggcacgtgtttttaatgagaggctcatttccaccactgccccccagccctccgcagcaagccagtgcaacgccaggacagtctgctgacaggggaattggagactggagggagcaagttttacctttttggtttgaccatttaaattgaagtcatgcatacagggaaagttatgcatatagaaaaatgtacacttcatactgcgtgcattcaattaatttgcgccaaatgaatgcacccgtgtcccctgcacccagatggaaaatgccaccagcacccttaatagcccccacctggacccctgaattggagtgaattttgaaagaagagggaaagaaagtgacatgtcccaattagaacatatgggacaggcactttctatactgtccaccttgccccagattctttttctttttctttttcttttttttttttttttgagacggagtctcacactgtcgcctgggctggagtgcagtgtcatgatctcagctcacggcaacctccacctcccaggttcaagagattctcctacctcagcctcccgagtagctgggattacaggtgtccgccaccatgcctggctaattttttgtatttttagtagagacggggtttcactatgttggccaggctggtctggaactcctgacctcgtgatccactcgcctcagcctcccaaagtgttaggattacaggcgtgaaccactgcgcccggcccagattcttttttttttttttgagatagaatctggctctgtcacccaggctggagtgcggtggcacaatctcactgcaacgtccacctccctgggctcaagtaatgctctcacctcagcctcccaagtatcaaattctcattttaaaaattaagaatcagacccaaaaagaacaaatgacttgaccatgactgaggccacagagccgaaaatgtccccatcctggagtcttactgtggcacactctcatcttaaccacacactctagttttatcctctctgtgtctttcatagattatcaggaagcgaaataacctgttaatattttcaaaagttcttatgaaatgtgaagtgctgtataatgattaagatagaaaggagaaactaggaaacgagagcttttaatcctagcttacaggaaattctaactagtaggaaatctaattcaggcagcgctgggaaacatcacaggctatgagatgaaagtcagctaaattgggatctaattctataatctaaatatagatgtagatatattacaggttggccttttcagctggagagagtatcattcactccaaaagtgccttttgtatcacagagaagagcgcagccaggggtgatatcagctgaggaagggggcgggcagcttggcgtgaggggctttcattcattccttagtcatctctattttcttaaattttatagtaggaattatttgtgcgttgtatgtataataaacacatggaaaagacaagagcgaggaaggcatctcaggagtgtttttgggaaggaggctgtcatggcatgtgggcagagggaggtctgggaatgggatttgctgggtcagaaagatgtccatgttctttgccaatttggcatcagaaatggcccacaccagccaggtgtggtggctcatacctctaatcccagcactttgggaggccgaggtgggtggatcaactgaggtcaggggttcgagaccagcctggccaacatggcaaaacctcatcgtccccactaaaaatacaaaacttagccgggcgtgatgggaggtgcctgtaatctcagctgctcaggaggctgaggcaggagaatcccttgaacccgagagatggaggttgcagtgagtcgcgattgtgccactgtactccagcctgggcaacagagcaagactctgtctcaaaaggaaaaaaaaagagagagagagagagaaaagaaaaggctcacgcctgtaatctcagcactttgggaggctaaggcaggaggagcttgagaccagcctgggcaacatagtgagacctccttatctctacaaaaaatgaatttttttttttttaatcagctaggcatggtggcatgtgcttgtagtcccagctactcaggaagctgaggtgggaggatcacttgagcccaggagttcgaggctgcagtgagctatgattgtgtcatgtactccaacctgggtgacagaacgagaccccgtctctaaaagaaaaaagaaaatgcctgtttcagttgtcactcctcaccagtgaggcatgggagtgttctcttcctccaaacctcactaaccctggataatggcattgtgataaattttccactggtcaaaaaatatatattgccttaaactcaaaactcgtccatcaacagtgaggttggctgtctttccgtgtgtttgttagccagtggtatctcctgtgtaaattaccttttgacatcctttgtttattttggttggtcttttacctcgtcgtcatcttactcacttttaaagagcatgaattaaggccgggcacagctgctcacgcctgtaaccccagcactttgggaggccaaggtgggtggatcacctgaggtcaggagttccagaccagcctggccaacatggtgaaaccccgtctctactaaaattagccaggcgttgtgatggatgcctgtaatcccagctacttgggaggctgaggcagggagaatcacttgaacctgggaggtgaagattgcagtgagccgagatcacaccactgcactccaacctgggcacagagagagaccccatctctaaaacaaacaaaaaaccacagtatgaattaattatttctctcttacatgttgtagaaatttttcccaaatctaccattcattttgtaaacataaactatatttctgtactctcttatagtaattgtagatttctagtgtttcacttggtttttgaatcgacaacagttttgtgtgtagggtattgtagtgtaagggatctgttttttcccccaggcagatagctcattttcccaatgcaatattcctttaaatattctgaataaaagaaaattttaaaaatcatttttgagcgatgggaaatgtgaaccaaaaatatgcataaggaatttttgattgaaaaacccagacgggggcaggagtttgaaatgaacttcccctaaaagccaaaacttgtagaggtggcagcctgagggctttccagagagctgtaattgactgtttctcccatcagccactctcctctttctcataacttttttgggcagccattaaagatctgatgacgagtgtgaatgtggcagcattttggcattttggatggtggcataattgcacatattgaaaaactctaaatttacatcggtggatccagtgcgtctcattatactggaggtgtgaaaactccatgtgcctctttgaacaattgtcctgctctgtcacagttcaggggaaacaaaagtagctccaacttcccgagatttaaatttgactttattccatttagttgatattgtaactagaatttgaatagtcttttccctttctgattttttttttttttttttttttttttttggagatgtagtttcgttcttgttacccaggctggagtgtcgtggcatgatttcagcttgctgcaatctccacctcccaggttcaagcagttctcctgcctcagcctcccaagtagctgggattacaggtgtgtaccaccacacccggctaatttttgtatatttagtagagatggggcttcaccatgttggccaggctggtcttgaactcctgacctcaggtgatcctcccgcctcggcctcccaaagtgctaggattacaggcgtgagccactgcacccagcacccttcctgatttccatttccgcttttatctctccactcccgaagatgtatcaacccacaaggaacttccttccagcccttacttaaaacattgctctttttccagctccagatattccctacattggctgccactcctccttgtctctgttcagtcttggaaaattggtttggtccaagctgaagctattctttgaagaaataccattatttttaaataaaaggattccccagcctggacagtgtagcaagaccccatctctaccaaaaaatcaaaactttagccaggcatgatggtgcacacctgtagtcccagctatttgggagggtgatgcaagagaatggtttgagcccaagagatcgaggctgcaggttagctatgatcgtgccactgtactccagcctgggcaacagagtgaaaccgtggctcaaaataaataaataacataaaaagattctcctttgagagaatcgcttgaacccaggaggcagaggctgcagtgagtcgagattgcaccactgcactctagcctgggtgacagagtgagactctgctcaaaaaataataataataaataaataaaaaagattcctccttccaggagccaagaactaggaatttcaagctgcaatcttgctttttaagcatggttatatatggggggtcagcagaatgtgtgaaaattattgaaaagtaaagcatgagatgtgactgagctcttgagagcagaccactttccccttcttaaaacgttttttttttccctgacccctgtctgagatacaggctctcctggttcggcccaccttgcccatcactctgctgggtccccactcgcgccctgcacctgaggttagagggcacataagtctcggggacctgccctttgatatctacaagaccctgtcctcaggggatcccatcgactctcgtggcttaaaataccatccacagaaggatggcgtctatatttatattaacccaaatattcaactgaatattcaacatctctacttggaaagacatctccggcttcacatggcttcaaaagagaactgttgacccctcccacacacaccgcctgcaccaccaatcccagtccccctgtcacctcgggaaatggcgtcaccacccaggggctgctcaggctaaaacctaggtgtgccctggggctccccctcctctcccccgacatgcctggtccaccagcaagcccgtccttcctcctggatacacctgggctcccagctacacgctgtcaccttggcccaagccactgtcatggccaccccaccaccacttccgttcttggctgccttctgtccattctctttccccagcggcctcagttttatttctaacgaatgcagttcagatctttccgtctccctgctagaccctctgatgtctttccatccaaccttccacattctgtgaccccacgtcgccctcactggctgggccacggcccctctagccccggtcttcacccttgaacctgcctagcctctgtcctcctcctctgcgccccgtggcttcttccactttcttccacctggctcacccggaattccagctacttgtgctcttcctgtcacacattgcctggtgtgtcatttccatctctgtctacctttccctcctagaatgccattcccatgagagcactttcaggccacttcacggcgtacgtccagccccaggcacagagcccggggtatcataggtgcacagtaaacatctgttgatgggctggctggattctatgtgggaagcataatgaccagtggtcacaaattactggggccagaggggcgctgcctggtgttaaccgcctggtgcctgccctacctttaaagccaagagtgtccatttaatgagcaagaagcagaaatcctgggcaagcagtgcagatgtaggctctcgggaacatgttgaccactcagaaaaccttccaggaggtgagtaccaggagatggaggtgctctagactgtgatgctgggaaaggattgtgggctagaaaaagggctccctagggccggcatatgggccactgggtggaagaggggctctgagaccctcaccctggagcaggtcatcacccacaccgaaggaatgaagcgtgaattcggtcacgcttaaaatgttgaattgttggcaaaagcccaagttaatgaaatagcatggaaaatggatgtgatgagatttttgaattgtaattagattaacattgtcactagttatcagtctgatatatcttataaatcaaacgttgggttgatttatcttttatcacttctagggacttactcctaacagtaactcacaaaccagccccaaatcagagctggtaggatgggctcccagctatctttaggaggtttgttggtttggggaagacagctcccccttggcagggctcaggtgttttctttcttttttcttttttttttgagacggagtcttgctctgtcatccaggctggagtgtagtagcacaatgtcggttcactgcaacctccacctcctgagttcaagcaattctcatgcctcagcctcccgagtagctggcactacaggtgcccaccaccatgcccagctaatttttgtatttttaatagagatagggttttaccatgttaacaggccaggctggtcacgaactcctgaccttaggtgatccacccgccttggcctcccaaagtgctgggattacaggcgtgagccaccgtgtccggctgggtgttttatttcttcgtctgttattcaggaactttgtttccagcgctgtgagtatgagtacaggcccagggctgggtgacagagtgcggagagcggggccctacccttgagctgtttctggaagggctcccagccagcaccgggcttagggagcagtgccctgcagtgtcattctgggccagggaggttgtgatgaatattattctcaacagagggtccccagggcagtgatgccactactcaggatcttacagaagaagaaccttcaggctgggtgtgggggctcacacctggaatcccagcactttgggaggccaaagtgggaggattgcttgagcccaggagttcgagaccagcctgggcaacatagcaagaccctgtttctccaaaaaaaatgtttaaaaagtagctgagcatggtggcatgcacctgtggtcccagctactggggaagctgaggtgggaggattgctccacccgagaggtcgaggctgcagtcagctgtgattgtgtcactgcagtccagcctgggcgacagagggagaccctgtttccaattaaaacaataaaaatcttcattttgaagaatctgaccagttctctacctggcacttgagtgaaaaatgacacaatccaaagtaggtggcagattggttctcactcaggcagaccctggagacacctctcccgcttctgactcaggggagagtgcggtgacataaaccaccttcttctgctctaggccagcttgtaactgttcagccagccagccgtctcctaactctgtgacccccggcccaagaacagggctcctgaaggccccgagaaccagcccgccgtccgcacggatgtacctggaagccacagtgccccacaccccgtgggactttctcccgaacacagcacctgcgcttcctgactcctctctctgaatctggcctttgagttcaatgtcctgggaacttaactctagggatgctctttccccctttagctaccgagtcacatgctgcgtctttggaaatttcaggcaatatttagtttggtgcaaaagtcattgtggtttttgcaattaattgcaaaaataataaatggaaaaatgaatttgtggacatcaggcttgcctagggagatgacctagggagaggcctcttttggcatagctcctgaacagggagaggtcctgacatgaataccccccgttttgtgaatcctgagccagtactgtgtccccggccccctcctcccccaacctatacacacgcctcactttcccttgcaggacgttttctaccacagttcctctctcctgacatagtatgtgtttgtttcttacttgtcttgccgcatgaggatgtaagttgcctgaattcaaaaacatgtcttcttttttgtgaatgaaagagtggctggcatgtagcaggtactgaaattatttgtagagtgaatgataaatctcagttcagggcactcagtgtggcctgggctacgtggaatagccaattggtggccacagagagtggccagccattcccaggctggcaatgtgagtcttagccactctcttttacagataatgtgcttattaaaatgatatcccaggcattccccagtggtgtttgaatcgtgaatgcaaatgtcagaggctctgaagtttaaagtctttttttttttttgagacggagtctcgctctgtcgcccaggctggagtacagcagtgcgatctcggctctgcaacctccgcctccctggttcaggcgattctcctgcctccgtctcctgagtagctgggattacaggcaagcaccaccacgcccagctaatgtttgtatttttagaagaaacggggtttcaccatgttggccaggctggttttgaactcttgacctcaagtgatctgccgccttggcctcccaaagtgctgggattacaggcgtgagccaccgcacctggccaggtttcaagtcttgactctaataaaaccagggaggtttcgctcagccacataagtgggagggaaaattaactgttgctttctgtattcaccaagatggcctaaaataagcaagcagaaaagggaagaaagaaaaccaaacccatgaggttgtccaagtcgatcttggcaggtattttcttgcctgttgattgctagagtttccctctacctgcattgcaggctgaaatgtatgactcagccctgaccaataacatagcagtaaaaagtagtttcccctgagagctttctcttcctccatagctgtgactgctgacatcttccactgtaagtgagaaaagttgagtgtgccctgctgcctcgtttttctcaccaaggtgttatgagctggtagggaaggccaggagctagggcagcagctttagaattagtgcaagagacaggaggacaagtcactgggtctcctgaatttcctcacctgcaaaacagggacagtttttaaatttcttttttttttctttttttcttttttgtttgagatggagtcttgctctgtcgcccaggctggagtactgtgttgtgatcttggcttactgcaacctctgcctcccaggcttaggtgattctcatgcctcagcctcctgagtagctgggattacagatgcgggccaccatgcccggctaatttttgtatttttagcagagatgaggtttcaccatgttggttaggctggtcttgaactcctggcctgaaacgatctgcctgcctcggcctctcaaagtgctgggattacaggtgtgagccaacagggacttttttttttttattatactttaagttctaggatacatgtgcacaacgtgcaggtttgttacatatgtatatatgtaccatgttggtgtgctgcacccattaactcgtcatttacattaggtatatctcctaatgctatccctcccccctccccccaccccatgacaagccccggtgtgtgatgttctccttccccaacagggacagttttaatcaatcccctttctgggtggtgtcaggacacccacagaggtgtgggtctaagcgctttgtgagtgtccacgtcctgtgcctaaggaaagcactagtcattcattcattcacccaacagttcctgacggcccacctcaacaggaaggaatattatacagccactaaaatgtaaaatcaccagtgctgttcagaaggacggagatgtttatgtcattggctgtgtgaccaaaagaaaaagttctgctggggatgtgggatgggcatatacgtgttttgaatataagatctttctttaatgctgttatatttggtctccataaaataattattctttgggtgacaacctcttagaaaaagaaagacaaaagcagctatttgcataaacctcagcccaggtgtggtctccagccccaggaaacttctctaacacccctcccatcctcccaccagtggttcctccctcggtggcatgaggtggttcagtttttttcctctgtgcccaccctggggtgccctgggcccatggccactgactgcagtgaacaattatgtgtgagtctgttagttcatttgcattgctataaagaaatacccgaggctgagtaatttatgaagaaaagaggtttacttggcccatggttctgcaggttgtacaagaagcatgacgccagcatctgctgctggtgaggcctcaggaagcttccagtcatgatggaaggcaaagaggacttgacatatcacatggggagagagagagtgagaagggggaggtcccagactcttttaaacaaccagatctcacaagaactcagagcaagaattcactcattaccaggaggtgggcaccaagccattcatgagcaatctgccctcatggcccaaacacctcccaccaggccccacctccaacactggggatcacatttcaacatgaaatttggaggggacactagccgggtgtggtggcatgtacctgtaatctcagttactcaggaggctgaggcaggaaaatcgcttgaacccgggaggcagaggttacagtgagctgagattgtgccactgcactacagcctgggtgacagagctgagactgcaccactgcactccagcctgggtgacagagcaagactctgtccccccccaaaaaaaaaaaaatatatatatatatatatatatatatatatatatatatatacacacacacatatatatatgtgtgtgtgtgtgtgtgtgtgtgtgttaggggacagatgtccaaagtgtgtcagtgtccatcatggctattagactgtcaggcattgaatatgggcccatgttttatttctctttatttcctcattgttgaacacatgggtgtgcctcctatggatgggaccagtggctgactcacctttccaaacttgcatcctgatgatctgtaaagtgtacccaccctgtaagattgtcgtgggacaatgtagataaaaacctcgatatacagcctagtacacaaaggacggtgtaaatattctcttccgtgcttcgtagatttcatttttgaacgctcagattgttctccggcaaaaaaaaaaaaaaaaaaaagtgcttgcagtgagaacctgccctgcactctcaggcgagctgttgggtgcaagtcctgcaggactgagctctgaaggccacccacaccctgggttgtgcttggatgatggcatccctcctggcacaagcgcagatgggcagtcgggagggaacatcagcctgggaaaactagatgtcagtgaaaaatgctggaggtggctggcgttcgcaaaactcagtcgtaaaaaacagcacgttctcagtacaaaatgagcactgttaaaaataaaccgcgcaagaagaaatatatgaatacgagggcatggcaaacagttttgcaaggtattaagatcgcattaatcttaattttattatatattaaagtttctaacttttcaaataatgcagttttcgttgttttaaaacgtctgagaattatagagctatttggtgtggctctcaggcaaggactcctgccatttattggggccctggttttatttaatagccagatgaatggaatagttaataaaagaaatattgctttattccctgacatttatgtccttggtttccaataaagaattgaaattatgaatagttgatggtttaaattgatgttttatgttgaacgctagctataatttgccctctgaggattgtaataccgagaaacagatggtttctcacagtaacaaattgctatgtgtatacacgctatagtcttggctttcagatactttcacctttggttctgagctgctctgcagacgggagaggggggtcgtgcggggagatcagcctctggaggaaggggtttcctgccctgtgggggagacacagacaggccctgggggttcagggaaactggggaaatgtagctagcctggcatggtgtcagtacctggggccaagaggagcgttctgtccacgatcatggtggcagctgcaaggtagtgcctgcaggactgctgtgcatgtggctgtttgacaccatgccgtgctgcaaactccacatcttcctagaacaaccaggagaatgccgtggagacttgttgccagatttttgcagttgccctgcagtggagaggttaagagcttggactccggagccaggtggctgggccactttgggggaagtttcccaaattcccacatctcagtttcctcatctgtaaaatgtgcataagagcaaaagccaccaccctgttttgaggattcagtaaaaccatccctctaacacaacactgagcccagtgccgggtatggtgtcagtgtctgccaggtaatggtgtaacgaaaattacaaagcagattgatgtggtgtgattcttgacgttacaaaagcttccttgtttttcagagggagttcccacaggggttctttagacaggcagtgcattaaggttgcagaaatttactttccagaaggttttaaaggaacgcagcttcaatggcagcaaggtacctgaaacaggaacccttccagagtgtctctgttttgttggcctttgagacctgccgcttctgactgcggggacctgggctgccccagatctgtctgtcagaagcctggagttgttaagctggtgaaatttaacaccactgtaaagagcccctcacagacaattcaggaacgcttacagatagaaaccggtcctggttttaaggtgtaattttgcacaagtgttaacaacaagagatggaattggtaacgaggcactggggtcggatcttcatatttttgtcacatttcatcggtgagatcagtaggtctgtctcccctaagaggagtgtggaatttagtgtttttccttttttgggctgtgacccaagagcttgttttcaagatatgtatttatttagaatacaaggctcttttccataaggaaagaaaatgttacagaaatgagctctcagttaattgaataagaaacctgttcgtctcatgactcacttaagagagagctggcagcccttcctgaatgcctattacaggcggcactgtgtccttttacttaatcttcccaaggaggatgagggttgcaggctccccaggcccatcgctgtgttggtgagtgacagagcctctgtaaaggaatggggatgagctctgagcccttttcccgtgggctctgctgcctggaggcatgccctccctcggcttgtcttccagctctcgcacagaaccaagtgttaactggtggtggtttggagacgagaggaaatggaccgtaaggaccattgagttggcataaggagaccagggcccaactccggaccctaccagagcagagtctttctcctctgtaatgtgagactgtagagctctagaatgttccttctccaactcagagctgatgctgtcagggccctgctgcagggtccttcagtggctccctgtggcctgaaggacaagccagctcctgccctggaagccgtggggatgtggtcctagcctgtgctcctgcctcgctcacctccctggaacaccagggccacctctctgggctcctcctgtgccccagtctgctcctgccacccctgtcccaccgtgcttcctccctccctgtgcctcagctcaggccttgccacctggagctctgacctcgtccgtcttggaatgaggcacctgcatgggtagcccatgggtagagttgcagtcatctgtttgctttcgattcactcccgcatcccgacacagtgcccagcacatcatcgatgaatgagtgtggggcaaatgcttgcacagaagtccgtgcgtgagccacgacggtaaacagaggcgctcctcttgtcctaatgtggaactccccaagctacgggaaaggggtgcatatggaccgctgctcactcacggctcagatacttccacggtaatgggttggcgacagtgactcagcttctcataggttcaagcggaagaaatggtgagtcctggagcactgcttgctttgaagtctgtttcagactagggtcatgtttcaaagtttttgaatttcttttttattcaaaagacatttgatgagttgactattgggggaaccttgaccccggtgactccgtgggacaggggatacccccggggtcccttataagcctgctgactcaccgcctgttctccatcttctgtcttccacattagaagcaagggcggggacattgcctttcccggccgctgcggtgtcctggcgcagggcacgtgcctgagggcccttggtcatccgagggaggactgcaccagggacatcagagtgctgatcttacaggaaacggcaaatgaatggaattggtctgactccatattactccttacttagatgtaaaacaaatacacatgatttttcatcctagaagaaagtctaaacgaactcttgacaaaaacagccaagttcagagaaagctgactctgttggtgtaagaagcgttttttcaggctgggctgctggctcatgcctgtaatctcagcactttgggaggccgaggcaggtggatcacttgaggtcaggagttcgagaccagcctggccaacatggggaaacctcgtctctactaaaaatagaaaaattagctgggcgtggtggcgcatgcctgtaatcccagctacttgggagactgaggcaggagaatcacttgaacccgggaggcagaggttgcagtgagctgagatcacgcactgcactccagcctgggcaacagagcgagaatctgtttcaaaaaaaaaaagaagaagaagctgttctccgtgagtcagccccggtgtctgataagtgtctgcagctgacagctcagagctggtgtcaacccactttggaggctggggtgggaggcaagaaacccagacagaacccctcctggctgcaaaacctccaggcttaactgtggcgcccactccatggtgggtcttaactctcctgaaaacacttcatgggctgtgggcctctcgggtgcttctgcgccagctcttcctcttcacctcctgccacagatctgtgtccccaggctctcctgtgtgtctccctgctcctcctttccctccaggtccgattccacagccctgggctgcctttccacctctgccttctctggggtatgtcctcgcctctcctgtcaccattgtcctcagggatcttccagctttccaggcatttggaaagaggcctccataccttgatgtggcctcccaggttccttgcgacagagtcctgcgtcgggataccaggggctgggcgcggtggttcatacctgttatctcagcactttgggaggccaagacaggaggattgcttgaggccaggagtttgagccagcctcggcagcataatgagattccatctctacaaaaaaataaaatttagccaagtgtggtggcatgcacctgtggtcccagctactcggaaggccaaggcaggaggattgcttcagtcctggaggttgaggctgcagtaagctataatcgtgccattccagcctgggaaacagggtgagatcctgtctcaaaaaaaaaataataataataataataatatttgtaggggaaggacactcagatttcctactggaagcaaggcttcctcattccatcagattctgctcctcctccaaggctcggctcaggggcctgcccctccatgaaccttcccagccctcagcccccttccttcctattcccccagcaccgacgtcacctcatcctgcccgactctgtagcatgcaggcctccgtcctccacccagctgcagaaccggagacctcaggtggtatctggttccacgtgtccccaatggcacctcgcctggaacgatgtctgcgccgaccagtgataacaatcgaaatagcaggcgtggctgaccgtgtgccgaggctcggcgtgccgcactggccagccgtgatttcatctcagcctctagcatcctgctggggtaggttaataatccctggatttctcagatgggaaatgttaggaaagtctgtaagcccccatggaaggtcccggagcccaaattcaaacccgagtggagcgttctgttgcttcactgtgctctggtgtgaattttaatgtaaggccctggcatttaagagctcgaagacaccatggaggtggagagctcagccctgtcattggatggaagctgagactggtgagattctcaccggggcttttgcagggagtttgggggaattttgaaggtggtacaggtgttctgaccccaacaccatctcctccagctgggccacacacttatttcctgctcctacccccgtccttcccaccccttggattctgggtgtacagaagagtgggcacatgctaaggtcagccctgggttagcctcatggacaaggtgggcctggagcaggaacccgcctgatagaagacactcaaagtctgtccgtacacgctcggtgtgggcatcgcttgcacgcaggtgcagcttttgctgtgggaaaccactttaaatgaattgatagcctcaccacagtggagccatggcccgactgtggagagactccattgtagagaaatatttgagtgaaaggtttcatgtcagaatagcatctgcatgcaaataagaggcatgggcgggtgcagtggctcacacctgtaattccagctacttgagaggcagaggcaagatgatctcttgaacccgggattttgagaccagcctggacaacatggtaagaccccatctcttaaggaaaaaaaaaaggtttaaattagctgggcgtggtagtccccgtagatgaagttatttgggaagctgaggcaaaaggattgcttgagccctggagttcaaggcagtagtgagctatgattgtgccactgcattccagactgggcaacagagccagaccccatctcttttgtttgtttgtttgtttgtttgtttgttttgtttttttgagatggaatctcacccaggctggagtgcagtggtgagatcttggttcactgcaacctccgcctcctgggttcaagcgattctcctgcctcagcctcccaagtagctgggattacaagtgcccaccaccatgtctggctaatttctgtatttttagtagagatggggtttcaccatgttggccaggctgatcgtgaactcctgacttcaagtgacgctcccacctcggcctcccaaagtgctgggattacaggtgtgagtcaccgcgcctggcccagaccccatctctttaaaacaaaaaagtacatgggataaatggggaaaacactcttgagacaagaccaaaacatacagtggctgctaaatgtcagtgccatgagcccagggttctcctacatccccttccgtggtcagggaggactgctgggctctgtgtcttctgtgattctcccctggctctgagccctttgcacctgcaactcacagcgccgctcaggtccctgggggtaaagtgccataggataaaagccacaggagggttttgaaatgctcttttcctctcagatatgtatttccgcatctttacggagtctcatcaacgctttttaaacctcccctgggatttgaaccagcgcccatagatacaggtggcttgtcaggtcagctaggtgctgctactgaggcagcatctgtccctagccccgcacccacaggttcagaaggggaacgcttcccccgggtggcttatgagatccagtacttctagtttcacttctttaaaaataccgtaaaaaagaaaaaggctgtcaaaacacaagcagtgtttgaaacgaagctttgtaggtccccctacaccaccaccgtcgtgggcagcatagcggatgagttctgggacaccagctaaaatgtgggcaagagaagccagggcgcgtagcagatgtgtgtgtgtatctttatgggattcaagtcatgtctctgttttgttgaccaacttccgctagaattcatagccatctagcctatgtattggatttttatttctgtgatgtctgcttcttttaaaaatatcagttggggccgggtgtggtggctcatgcctgtaatcacagcactttgggtgaccgaggggggtggatcacttgaggtcaggagttccagacccacctggccaatatggccaaaccctgtctctactaaaaataccaaaattagctggacgtggtggtgtgcacctgtaatcccagctactcgggaggctgaggcaggagaatcacttgaacccgggaggcagaggttgcagtgagctgagatcgcgccactgcacttcagcctggggaacagagtgagacttcatctcaaaaaaaaaaaaaaaaaaatcagttagtagccaggcaccatgcacacacctatagtcccagccactcaggaggctggaggatcacttgagttcaggagttcaagaccagtctgggcaacatagcaagacctcatctctacaaaaaataaaaaattagcagggcatggtggcacatgcctggagtcccagctccttgggggaggcaggagcatctcttgagcccaggagtccgagaccaacttgggcaacatagtgagattccgtttcaaaaatatgtatcagtaggttaatctagactttgtttacatgggccaagtggccaaggtcacatcttagagttgtggactgtataatcaggtaagtgtggctacagtcacagaaagtcagggtagaaagaggcttggaggggggtgcacttcttctagccagagctttcctactgagctccttaaagcacaggggaaagtgggacggggttggggggcaacctaaaacccaccccctcccatcttcaaccagtgcgaccctgtttttacctgctcagcagtattgtgcatccctgtaaaattttatttgaaaatggccttctgcagttaaaactacaaaaaaaggttgaaagtggccaacttaaactccactctgtttcttttttgattggggagactggtgtgcatagaagggaggtgtcagctaacgagactgttacctcaccacagatgcccacccgtgggtgatggagctcccaagtcctgggccacaccctacgtgccccatgcccagcaagttgggtgggggaggggtcagtacatgtttgtaagataaagaaaaacatccttcccaatcagccgtattacccagagggtgatactgatttagatcttatttcagtttggttagagaagctcaggtaccagtgagcagaagtctggccattgtggtggcttctggaagatgatgtgccatactgttagcaggggtgcaatttggggtgtgaggccaccagagctttgatttccgcccccgccgcccccctccaacccccgccccgccggattatttggagtttttttattgttgttcatggtaattacctgctattagacaacaatctagttccatttgcaatagggaataatacgtctgtgacacagtctccagacttagggagcctctggccaccccgagggggccctggtcattctgctgctggtcatgcctagctctgggtggccgactaggtggcctgggcgggagggtccactctttgcctttataaaaagaagggcttgggccaggcgttgtggttcatgcctgtaatcccagcactttgagaggccaaagcaggaggatcaccttaggtcaggagttcaagaccagcctgaccaacatggcaaaaccccgtctctactaaaaaatacaaaagttagccgggtgtgtggtgggtaccagtaatcctagttactcgtgaggctgaggcaggagaatcgcttgaacccgggaggtagaggttgcagtgagccgaggttgcaccattgcactccagcctgggtgacagagtgtgactccgtctcaaaaataaataaataaataaataaataagataacaaggcgtgctggagatggccacaggcctccagcagccgcaccatcagagaaatggagtcagagagagctgcagctgctctgatggggggtgggagtatgcaggatcctctgggggtggctcaggcctcccaggggagcacttaccttttcatttcatagtatgtcggagctgctgatgcaggaataaagcaaagtgcctggcactctgcgcgactgctattttttcattcattcatatatttgtccttcctctacacatgtatggcagattaacaaaagcacctccacggcctagctatgtggcccccacgggtttcttagcctctctgagcaagttggacagggctgccttttcctctccctaactctgacttctgtcccagcctcttccatctaatgtcagccctcatccctgcctgcccctcccggtgcagactgggacattctcaggctgtttgagccaccccttcatcctctgtgcttttccctggcatcctggactcccttctccccttcatggtgctcctaggccattcccagcgctcctgttactctctctgtcctcccagccccaaacccgtccagctctgtatccatctgcctggctgccattcatgctgcagacgtagcactcccagagcccatctgtctccacacattgaggcttccagccccctaaccccggtagtggccacagtgcccagtgggccaccccagccaagcccaagagtggccacatgggagcccttcttccatctccctcccctcatccacacattaccaagtcttgccaatttcatctcctgaggacctcagcttctgtcattctctccccattatactgcagttgccaccgttatttctctcctagaccttggctggcattacttggacattcatttctttggaatctcttggccagctttgcacacctttaactagactaagaagatttgaggccaggggcagtagctcatgcctctaatccccagcagtttgggaggccgaggtgggcagatcacctgaggttaggagtttgagacctacctgggcaacatggtaccccgtctctattaaaaatacaaaaattagccaggtgtggtggcacacgcctgtaatcccagctactcgggaggctgaggcaggagaatcgcttaaacccaggaggtggaggccgcagtgagccaagattgtgccattgcactctagcctgggtgacagagcgagactccgtctcaaacaacagcaacaaaaaaggaaatatgagctcccttcccagatccgtgcctctggacctgggctgaaggcttctactccctccattgtcaccttcgggaatctgcttgttaccttcctcccaagaatgttccagaaggtcttggtttaatttctggagggcattcaagaactcagtcatctcacgtgtctagaagagaaacattaaggccaggcacggtggcttatgtcggtaatcccagcactttggaaggctgaagcaggaggaccacttgagcccaggagttcaagaccagcctgggcaacatagcaagatctcatctctacaaaaaaaaaaaaaaaaaaaaattagccgggcatggtggcacatgccattagtgtcagttatttagaaggccgagacggggggatcatttgatcccgggaagtgaaggtgctgtgagctgcgatcctgccattgcatccagcctgggcaacagaacaagaccctgtctcaaaattaaaagagagagagaaacaaacatggcagctcagaaacctggctgggggtgattgtggggaactgctgctgacgggctcttgggcacacccctcactccagccattctgcctggatgccttaggaacactcctcataccctcctaagagtcccatccaggccgccatggctcacttatccctgccacgtggactccagaaaacattctcagtagaaacccacagaaactgttcccagtcacaaagcacgccaggtgcatcctgttctttctgtcatttaaaaaaatgaatgtgtctctatccctccttcttataaaacagtaccctctcaccctgcatggcttaaattctggtctatcttacgcctttggattcaatgaccttcatcaaatgtctgcaaggcaagggccatttacagtaaacatggtgggaacttagcaatgtacttgggaaataaattctggtcaccaaatagagaagcaaatgcaacaaataatcccacagaccattataaaatgtcttttagacgatagttgtcaagaattagagttactcgtccaaaactgttgttggtgtttggaagcatccaaacatcggctggcccatgtcccataggggcgtctgcttagcaccctggtgagtggagagttgtgtgtatggggacttagcagagtgggaagcagcttgcaggaaggttgccaacgcttattaatatttaccaaaaagatgcaggaccggctgcggtggctcacgacagtcctcccagcacttagggaggccgaggtgggtggatcacctgaggtcaggggtccaagaccagcctgggtaaaatgtagaaactccatctctcctaaaaatacaaaaattagccgggcatggtggtgcacacctgtagcccagctactcgggaggctgaggcaggagaatcgcttgaacccaggaggcggagattgcatgagatgagatcgcgccactgcactccagcctgggcaacaaagagcaaaactccatccaaaaaaaaaaaagagagagagatgcaggaccatctgcctatgttccattttggtgatgatatctgaccttctgggagagagaacatcttaccccacagacccaggaaggcatgcacatgaggatggcaggagagtggctgtggacacttcctgtgtcaccatcctctgctctaggtgtgtactggtcacaggcacaggacagaaggctccccagagtccgatcccgtctcttgagctcagctggctatcctggaaccccccaacccgctgacctttggaagtggacagcagcccacgcctgcaggtggtccggccctgctgtgcagccctgttacagcacgttgtgtttttctggcttgtctctgccaagccccatgtgaccatggagggggccccgagcagacctgggggtggcggtactgaggcagaggcaggcgcacagtggtttccaagggagaaaatgaattcatgatctaaaatgcaaaaccttaattatgcctgactcctttcctccctccctccctcatttctctccctccctccctccctccctccatccatccttccctcgtttccttccctccgtctttttccttccctcccttacttccttcctctcttcctcctacccttcattgacctttcattttgtgactttgtcaaatacagccccaggctatcttctctttctcctctgctccaggttgttttctcttgctcctctgccgcatacatacccttccaccctgcgtctgcccatggaaatctcgtgtcccctccagtattcctgcccacagtggcctttgttaggaaattccggcacagtctcctcacagggcagcccttctgggaatcgctcccctgcgctcgtgtgcactcccctgcgctcgtgtgcactccggcccagccttcagagctgcttacctggctcttgtcttgtgtcctctgaccgcccatcagggcctgcccatggggctctgtctgcaggggagcagccccaaacacagtccttgtcagcacgccgatctggacctgaattgggcccttgcacacactagctgtggaccgaagacaaatcaggttctccccgtccccagagtggggaaagcggtagtgtgggcctccctggggtgcccatgatggtgtaatgagtgcgtgcacggagcctgctccacgtctctatggacatttccataacttttcttttggtttgtttttttgtttgtttgtttgtttgttttgttttctctgagacggagcctcactctgtcacccaggttggagcgcagtggtgcaatctgggctcactgcaacctccgcctcttgggttcaagagattctcctgccccagcctcccgaatagctgggattacaggtgcccaccaccacgcctggctactttttgtatttttagtacaaacggggtttcaccaggttggtcaggctggtctcaaacttctgaactcaaatgatcctcccgcctcagcctcccaaagtgctgggattataggcatgagccaccaggcccagctaacttttcaatttataaacactaatacctacttgtgtcccgtggcctcatctcagccatgtgaggccgatgttgtgcccattgtacagatggcagagcgcagctgtgtgtgcagtgcggattgcaggactgtgcctgagtctgggacagggtctttgccacagctcttgggatcctctcttctcatcaatgttatctcagagagctttcactgttggataagaggttgaccctggaccccaccccagtgctgctgggccctgtgggcactcacagagcagtccttgctggcctgactcatattcctgagtctcaggggttcctgtgccaccagagaacgaactccccaactgtcagtcactcagctcagtgcctgtatcttaaattgggcacctttagcaaaagtgcagtgtggaactgtgtatcctgctgccccagcccaggacctagcacagagccgggtactgtgccataataagccttggtaaaggctgctgtaggcttcacagtacagatggcagggctgtgcccgggctgcaggctcccatttaccagatgtgtgcagtgtggattgcagggctgtgcccggctgcaggaacacatttactggatgtgtgcagcacggattgtagggctgtgcgtgggctgcaggcacacatttactgggtgtgcacagtgcggattgcaggactgtgtctgagctgtaggtgcacatttaccgagtgtgcacagtgtggatttcaagacttagagatgagacagccagttcctgtcctgcccaagggtcgggcagggatacgcatcaaagaccctgggcatctttcccagcccgggcggtgcccccagccatcgcttctcagcaggacagccggcagggcatctgtcgtcttcgtccaccagcatcacgacctgtttgggggagaagtagtatttccacaccccactcagggcgatagcgtttgaggaagaagagaaagagagacttttggctttcctgatttcaatctttctgaaggtggacccatcactggtgaaaaaaattggtttttttggaaccaagaaagcagcctcggcctccagtgcctgaccaggctctggccagggtataggatcctggcgaggatgctgtgctgtgttgggcaggaagccacttcctccctctaaacgtcagtgtccagctctctcttcgtcgctttcttaagttgagggagctgctatgccaagggcaagcaagaaacaggcccctgagcccccaggttcacggctgggctttgaagcaggagtttcctcttcgccctcgggccacacctctgtagggtgcctctgcagcatttccctcctcgggcaggagcctagcttgcagaggacagacaggcaggaatgctggcctccatcgtgccaccagatcctgtccccaggcaagcaggaggggaggggaggcagtctcatcactgcagcaggaggggccacctctggagtccgcatggctgtggctgggctgtgcttctagaagcagcagctgtcgcctccactctctagggatttttatctttcctttacaaacttttttttacctttttttttttttttttttttttaagatggggtcttgcttgttgcccaggctggtctcaaattcctggactcatgtgatcctcctgcctcagcctcccaaagtgatgggattacaggcatgagccaccgcgcctggccgatttttatctttcctaccagccttttcatatgagctgagcctgcaggctgtgcctaagcatagccctttgaacttgattgaccatgagctttgaaaggctgctttgcagtctcagttctctggcaaatacaccagctcggttaagacgacttttctttgattgatgtcggctacatctagaaagcaggattgccaccactcctcgaagcaccccacgattagagtgtctgagcgctgcttctgctctgctgaggctggtgacaaattgcctggaaagacctcctgacagaggatgacgggctcgtctgcagcagggccgcttgcagcccaattgcttccaagattaaacctttccaaggcagtctgcactgccccatacacagttgggctgcttggtttaagattatggatgaatgtactgaattggatctcatttaaaaatatataggttttgaagtttgagggctcaggaagaaaatgaaatcctttgtcccaaaccagggcctggttttatcagtggcatgcgtgcgtgtgtgtgtgcgtgtgtgtgtgcatgtgtgttctaaagagaccctagtggcaaggcacagtggcttatgcctgtaatcccagcactctgggacgccaaggcaggaggatcacctgaggtcaggagctcaagaccagcctggccaacatggcgaaaccccgtctctataaaagtacaaaaattagctaggcgtggtagcaggcaactgtaatcccagttactcagaaggctgaggcaggagaatcccttgaatccgggcggcggaggttgtagtgagccaagatcgcaccattgcactccagcctgggtgacaagagcaaaactctatctcaaaaaaaaaaagagagagagagagagaccctagtttagctcttttggaaagcagctgccctgcattgagacacatgtgtcttaagcttgcttctggacgctagcactaaaatagcaatcggactctggatgcctctcacaggcaacttgtccacaaaaccacttccaaatgttttcccaagtgcatgcgtctgacccaggcttctttctcatccgcctcttgtggaaggaagatcgcatcttgagttctaaagatttttaaacaatctcatacctgcagagcaatgtatatttcaagaccattgacattggaaaacattcttgtttaatcaatgactctggtcctgctttagatttctccaaaaatagccagatcccgtgggcacgttgaagctgcagcccattgtgcagaattgcttaatgtgtacctcacctggttttggccttcacacaactgttgctcccttagcaaggggttcatttggttgggttttatgtgcaggaatgctggtgggttgggtgagtattagtatttaagggaaggttttgtttttgttttgttttgtttgtaagagctagggtctcactttgtcacccaggctggagtgcagtggtgcgatcatagctcactgcaacctcaaactcttgggctcaggtgatcctcccacctcaccctccctgagtagatgggactatagggtgtgcatcaccatgccaggctaatactgtttatttgtatttttgtagaggtggggtatcgctttgttgcccaggctggtcttgaactcatgggcctcaagtaatcatcccaccttggcctcccaaagcattgggattacaggcatgagtcaccatgcctggccataggggaagatatttttaaacaagatttgcttttgactagtgtcctgcatttgttaaagaccctagattgctccaggtgttctaaaaataaccaagcccacctgcctgccttctagatatgggctggagggcctgccaggagcattcttggggattgccagtagccccagttagcccaggctgacttacacttcctccctctcttaaccaaaataatgttgaatttttgtgttccttgtcttttaactgaaaagctcctgtttgtttgtttgtttattttctgagacagagtcttgctctcttgcccaggctggagtgcagtggtacgatctcagctcactgcatcctccgcctcccaagttcaagccattatcctgcctcagcctcccgagtagctgggactgcaggtgccctccatcacaccaagctaatttttgtatatttagtagagacagggtttcaccatgttggccaggctggtctcgaactcctgacctcaggtgatccaccgcctcagcctcccaaaagtgctgggattacaggcgtgagccaccgcgcccggccccgtttggtgtttttaatgctgtattgccattatttgcacttattcttttgcaaaatttcagcacctggtggtcaggatgttcctcctggccatgcacatgcaggacacacaacaggttcttgataagcgtgtgctgagcaaaactcactccttccttctggacacattcatcacaggtgtgctcgaagcagcaagagcttgcccctgctcagaagtgcttagttgctaattagatgtttccgcaaaggtactgaaattggaggcatcagtgttcatcctttagctatagcgttggaaaaatgtgattgatttacaactgtgactaaaaaggtgtttagagaactgttctatgtaaaacaagacagtaagctgggcacggtggctcgtgcctgtaatcccagcactttgagaggctgagatgggtgagttgcttgagctcaggagttctagaccagccggggcaacataacgagacccccatctctataaaaatatatattttttaaaaagctgagtatggtggtgcatgcctgcagtcccagctactccagaggctgaggcaggaggatctcttcagcccaggaggtggaggttgcagtgagctgtgcttgcaccactgcactccagcctgggcctcagagtgagaccctgtctcagaaagaaaaaataaatatatatagtgtgtgtgtgtggttgcaacttttgcacatcaccttgagttctgggcaaggggagaggaactgagattggtcactcccttcttgcgtggatggctgtgggatttgggtgagttttttgctccatagtgcttttcaccctgtattttctcataggttttgccccactggggctttgtatagagattggggctctcaggtcccatatggcacttactagcgagagttccgagtggccagtcccctccctgccctggcattggtacaagggggccttgctgttggaccacagtcttccaagagtccagctcccctgttctatcgagtctgaagcaaggtcccacttgggagttacagatcaggctcctttgatgtcagagcatcgcagcggaattctaggccacccggcagtgagtgctctctgcagatctgtgagtggtgctgggccgccctgccacctccatccctagcaccgtatctgtgtgaaaaagctgtgacctgccccttgggtggaagccttccagtccttggaaggggaatctttgctgctgctactgtctgcagagagactctttttatttttatttatttattttttttgatggagtcttgctctgtcacccaggctggagtgcaatggcacaatctcggctcactgcaacctccacctcctgggttcaagcaattctcctgcctctgcctcctgagtagctgggactacaggtgcttgccaccacacccagctaatttttgtatttttagtagagacagggtttcgtgttggccaggctcgtctcaaactcctgacctcaggtgatctgcccgcctcggcctcccaaagtgctgggattacaggcgtgagccaccaagctcggcccagagggactctctagagaggccccttgatcccacaaggggcgggggtctctggccaggcacagcccctccccactaagcccagcacctggtgccgaacacacacacacacacacacacacacacacacacacacacgcccgccccccgctccactgttctgttgtcagttgtgttcgttgttttcttgtaaataaacagtatgacaataaagggaagttacttcttagctgctcagaaggtgaccagagcagggctggagtgccagccttgcattcattgtttgctttattgcaaggctgcttggaattgaaggggatctccgttcgagtctgagctggaggaaggaaggggctcctgtaccatgtatagaacttgggctctccccggggtcaggggcctgggctctggtgcagccccaccacttcatcaggtcaccccaggtggtttcagcctctgatttctcatccctggaatggggtgtttgcagcctcgtaggttgctatggggattgaatgagatatgttcatgagccagtaaggcagccaagatgtcacttacatggaacttacattgcaaccccagttttagaataacataggatattaaatatcaccatctccttgaatactcatagtccgcagtttgcttcatgttataaggtgtttagttctaggctgagcctgtaatcccgccactttgggagactaaggtgggaggattgcttgaggccaggggtttagaaccagcctgggcaacatagtgagacccctgtctctacaaactatatgtatacacgtataaattttataaagatgtttagttgttctgaatttcctaaaaaatacagcttaacttttttgtcttcctttacctgcacctggatgcagtgggaaagattttcccagtagcacaaggtggaccaggtgagctatcctcacccaatggggctgaaagacagggctttgatatcctgccccagagcccggctgttaccacatggtttgatttgcgatgccaagcaggcttccttacgggtccacacacctctggtttttagcttgagattggggcagctgttcctcctctggcccagccaggtataatcaggtacaaaggaaagtgacctagaatgaagaggttgccctgacctggtggtggaattggagcctgggagcacgggtcggatggcttagttcatctgtttggcagtggatcaaatccccctcctcccacatacttgatttatgtggactgggaaagaatgttgggtttcaacataaagaaaacaaatttggctgataactcgtaaatcacaataaactttcattccaagagtgttctgggcttctaagaaatatattcctatctcacatctcagttgatattcacagccaccattgagctagagtcattcccaggtggagaaactgaggcttgggagttatgcctgccttggagagggatggggctaagacttgggctctggtgtcctgaccaccgagcctggttccttccacgtggtctgattcctgggatgtgaagcagccatcctcacagggccacacacctggacaggtacacagtgcagcaagtagagaggcaaagaaacaagggaattgatcaggggtccacacgctttctctaaaagagcctggtgctacatatgttagtcttgacggagaaagaggcaaaatcaggatatcatgtaggcacttatataaccactttaaatgcaaccatttaaaagtgtaaaaaccattcttagctcatgggccataaaaatcccagcagctggctggttttggccggcttgccgcagcttgctgacccctgggagagagcatctgctgctattgcaggcaggggactgcaggtcatccccctgtttgggtcccactcctgcccgtcattcaggctctgtcagcttctacccagaagtacctgggagtcgggggttttgctgtgtcacagagaacttggctctcgatagagtcggaaaggaattctgggaaaactctagagatgcattaaaaaatctccactgggccgggcgcggtggctcacgcctgtaatccctgaggcaggcacattacctgaggccaggagttcgagaccggcctggttttttgttttgttttgttttgttttgttgagacagggtcttgctccatcatccaggctggagtgcagtagcacgatcatagctccactgcagcctcgagctcctgggctcaagcgatgctcccacctcagcctcccaagtagctggaaccacaggtgtgcaccactgcacccgggttaatttttttatttttgcagagacgatagtctccctatctttcccaggctggtctcaaactcctgccctcaagtgatcctcctgcctcagcctcccacagggctggggttatagacgtgagccactgcacctggcctctttcttcttgaggctagttttcctgactgcgtgattcccaaagcttcaccccactgatgctgggttcccctcctctgtctactccacctgctgaggctggggctctcagggacacagtcagcagctcagcctctggaaagacctggaaagatcacatccttctgggaacctgcttctggaggcacaagtagtgtagctcctcttaggccctttcgatgaagtaagagcagctcattagcatcccaggctacaaagcctaaaaccctttgcttttaccaaaaccagagggtctaaagagaaaggtcacgaggagcgagcggccgcgtggatgaggttggccagagaaactggtttgttttggaagccgatggaagatgcgcttggaaggctaaggctgccgaggttgaagtccgtcattctcagtgcagaccctagggaggaagtagcaggaccccagtggggctgcaggcattcagaaagagagctgcctggggtttcccttcagaacctccctccttttaacccgggagtaaagagaaaaagacccgcggggtccactggctcggaagtcggtctctttcagtttggagcctccagttggaaacctgccttttaatggccaggctgatggtctagttactctttgaacagggaagcctcgtcaggctctctgctgaccacgcctcagtgctccctcgaaggacaactctggaatgccagtttttatctcatctcggtagaatggattttttttcttttcttttcttttctttctttgagacagagtctcgcgctatcacccacgctagagtgaaatggcacgatatcggctcactgcaacctccgcctcccgggttcaagcaattctcatgcctcagcctcccgagtaactgggattacaggagcgcgccaccacacctggctaatttttgtatttttagtagagatggagtttcactatgttggccaggctggtctcaggcgatccacccgcttcagcctcccaaagtgctgggattacaggcgtgagccaccgtgcccggccctagaatgaatttttcttttagggaaaataaggttattggtgaatgggtttgggctgtcatcttcagaaactgatttcatctagaacagtttgtgacgggcagatgtggaataaaaccactggatgcatcaggcgtcactgccaagggtgcaaggggctgctccatgctgggcgtgcgagaggagcaagaagccgtccccgcccaccacggtgcaggccgggatgcagcggaaagcccttgcttcttagatttcccacacaaaagtgtatttcttgtagatttcgccagcgcgggcctcctcctctgcttggcagtggctctgcacgagctgccttgggatggatctctcatctttgctgctggcctcatccaaggaacagaccccatgcacggagcctagatgccccgaggtcttcactgatggccctctgaatttttattttgtttgtatttcatttgttactgattgaatttttgagacagggtctcgctctgtagcgcaggctggagtgcaggggcgcgatcctggctcactgcagcctcggcctcctgtacctaagccatggccctctctgactttgaacccctcagttcattctcagatcagaccactcactcactgaggccctcggctcttccacaggtctcagccttttgccccttatagtttttagttgttgcagcctttctgttctcttcccctctcctgttaaggggacatttccaagcaccctggccacagaacctcctcacctcccaccctccgcccctgggtgccagggcctgggttctctgtggaagtcctgccagctccgggtatttcccacgtggatttctcatcatcttcaccaccagatcagttcctggcctgcacccctcctgtctggcttgtggcaggggctgccaccctcacctgggccctaaacttctacaaagccccactctctcctgttcccgtcagtctgcttgccaagtccagtttattttaattctggggaacgttgtcttcctcctcccccctccctcgccaccacccacctctggtgttttttttgttttgttttgttttgttttttttgagatagagtctcactcttgtcacccaggctggagtgcagtggtgcgatctcggctcactgcaacctccgcctcctgggttcaagcgattctactgtctcagcctcctgagtagctgggactacaggcacccgccaccacacccggctaatttttgtatttttagtagaggcaaggtttcaccatgttggtcaggctggtctcgaactcctgacctcaggtgatctacctgccttggcctcccaaagtgctgggattacaggcaccacttctggttctgttaccttcgtccaaacttgtatttcccagctggtatcttccatctccaggctttcccctctggcctgtcctttagcaggagtcaccttcctgaagcagaccctggtctggtctctgcgtactaccttttgcatggttggtggccgtccacccgcctctcaggccatgtctgggttcttctaggggcttcggtgatctgggagcctgtccccgctggccccctctcccatgtcttactccatcagcttcaccttgtttgtatctctggatctcctcttttttccttctgtttgtatcttgtctctttctagaaagcccccccacctctactcgcccctctgtggcaaatatcacccaattcaggtgcccccagcccagcaaagagggattttcattccttgggcccccgttgtaggctagctgcgcctgtctttcggcacatttcatttcctgcctggtatttcggtcgtgtgcgtgtctttattctcctcgtgtaatccctgaggtgcagagtgcgtgtctgtcctcctctgccctctctagagattgggatatgaccagtgttcagcccccaaccaaaagagcctaagaaccccaggtccccagcctgtcctgctctgctgggggcccacatgcctggggacaaggcacctttccttccctgaccttgactaggacaggacatggggtagggcctgaacattgagcaattgtcaaactgcctacttacgatgaacaaaatagcttttcaggaggcgagaccacagcacagtcatggtgaatcctgatgcgcaccccaggtcttttatcaggatttttgtttttcctggtgggcacagatgtaggtggagcagatcagaggcctctcaggttcttgatcactcatggcagttcaggcctgccagtagtgaggtcagagatccatacagcaggggagagaagggaggtacagggaaccctcggccccgcgtgctccagcaggtctgcatgattaacctgaattgcagtgttcagaggctcggcctgccagccacagcggttccagatgaaatgcagcttagaaggcagcatggtgtagtagctttggcgccagccgcacccagagtttggattgtagccagatggcctcaggtgcaatgtataacctctgggaattccagatttcctatttacacgacagggatgattccatacctgaagggctgtttggaagcatctagaagcaagcacagtggagtggctgtcatgacgctgaccgcacaaatgatggtgttaggatccctccacggatgtggccaggtgacacccctcacctaggccgcacagcaccctaatgtacacactgaagaaaggctgcgtggggctgcagagcggctcatttctaagaaggccaaagaaattgctcagtccagaccagggaacccagtttctcttttagaggtgggatcttgctatgttgctcaggctggtctcgaactcctgacctcaagtgatcctcccgccttggcctcccaaagtgttgagattccaggcatgaaccactgcacccaacctgtagcctctttctacaagtaaaataattcaggtgagttcaggcccacgccaggtcttaaaccctggccctctgcccatcttccagcctccaccccttctctctccttacagaatcttctgttcttctgcacaccagcgtggcagacaggttggccaagggccttggacttctttatctctagtacatgttcctgtaaatttaaacctcctcagttgggtaaaagctttggaattactaacattccttttgtgctgcctaacgttcttgccatttaaaagattagcaggcataatttcagtgagccttcgtgactggcgtgcctcacttagcttaatccctggttggtacatgttaaaacctataaagacagcctctccagcacacatggggagcttgaaaatgaaagaaaggttgctctgacctctcagaactgcggacttcttaaaaaagaaagagtgaggtgggcggcctcccttgctgccggtgctagattccatgatatgaaacagcaagggtgcagctgggtgcggtggctcatgcctgtaatcccagcacttcggaggcgggggtgggcagatcacctgaggtcaggagttcgagaccagcctggccaacatggtgaaaccccgtctctactaaataatacaaaaattagccaggcatggtggtgagtgcctgtagccccagctactcaggaggctgaagcaggagaatcacttgaacccagaggtggaggttgcagtgagctgagatcacgccactgtactccagcctgggcaacagaacaagaagactctgtctcaaaaaaaaaaaaaaaaaaaaactgacttggatatgtgcttacataagaaagggagattcaccaagtgaaccatgcatagcatctcttaaatctgtatcatggaattcgtgattgggcctctctttcatatcaggcaacatacatgtgatgtacatacctgtagcttccgggaaagggaaggaagtagagatgacattgtctgttactcgtttgtatgtgtgtgtgcgtatttaagtaaatatgtgtgtgcatagggacatgtcacatgcatgtgtggcacatttataggatgaagaggtgtctaaaagacattgaggaaactcagtgaaggagttctgccggcgggcgtgaggaccacgctaaaagatgccggttgtgctttgtgtctaagctgaaagcatggatatcattttataaaagtaaaattatattggccaggcgtggtggctcatgcctgtagtcccagcacattgggaggccgaggtgggcggatcacctgaggtcgagagtgtgagaccagcctgaccaacatggagaaacccccatctctactaaaaatacaaaaaattagccaggcatggtggcacatgcctgtaatcccagctactcaggaggctgaagcaggagaatcacttgaacctgggaggcggaggttgcagtgagccaagatcatgccattgcactccagcctgggcaacaagagcaaaactccatctcagaaaaataaaaaaaaaaagtaaaattatattgttattgacggtctctttgttcgagtaagccgtctctggatatatcattgtatggtgtattcatgccaaggatttggtgtgagtcttgaagcattcacaccaaattgtggccaagcccagcactgagagcgcagtgggcgttcggaggacacgtttggattttgtgatcctctgcctggcaggagctgctcagcccctacagccccttccccgagaccaccaatgcgtttctcttcagttttgctattctcatacgctggtgatgggattttggagacaaacatggtctcttctgcttgcttgcttgcttatttatttatttttcctcccaggttcaagtgattctcctgcctcagcctcccaagtagctgggattacaggtgtgcgccaccatgcccagctaattttgtgtttttagtagagacgggtttcaccgtgttggccaggctggtcttgaactcctgacctcaggtgacctgcccaccttggcctcccaaagtgctgagattacagacatgagccaccgcgcctggccttctgccttttttggtgaactccctgtgggtgggagaactacccggtggagtcggtacctaaccagggcaggacacggaggtacacccctctcattttcggcagcagggtgagaggatttttattatcttacttagacacttgaatttatttttttattttgagacggaatttcggtcttgtcacccaggctggagtgcaatggtgtgatcgctggtccctgggttcaagtgattctccaacctcagcctcccaagtagctaggattacaggcgcccatcaccacacctggctaatttttgtatttttagtagagacggggtttcaccatgttggccatgctggttgacgcttgaatttatttatttatttcagataattttggactacagaaaggactctttgaaagggtattctaaaataatttcacccaattaggttttaaacatagtctgccatattgttgatttcacaggatttgcttttttaaaaaaatgtattttatttatttagaatttttctttaagagatggggtctcactctgttgcccaggctggagtacagtggtgcgatctcggctcactgcaacctccgcctcccgggttgaagcaattctcatgtctcagcctcccaagtagctgggactataggtgcgtgccaccatgcctggctaatttttgtatttttagtagaaacggggtttcaccatgtaggccaggctggtctcgaactcatgacctcaagtcatgcacctggcttggcctcccaaagtgctaggattataagcgtgagccactgtgcctggccttcagtagcttttaaaggttgtagctgaagattttgtacttgtcacatgggggaatatgataatgaaagcagaagatagactagtcactctacttttcccagcgtcctctctgactggactctttgaaggtactgcccagggtcatgaagagatggccctggctgcttccagaaggtatacattcccgtgtccactctgtgtcctggagagtgggggcggggggagggggttgtccgtctttgtatctctgtctctcagtacaaatttaatgaaggaatgaatcaatgaatgaatgaagcaagcattcccccagagaattcttaaatcatcttagccggtcatggaatttcccagcaagtcagcttttagaatcctgaaaatattttcagtattcatctctttaaggaatatatcaaaagcagtcagcaccaaccacggtttttcagctgattcccaaatgtgtgataagaaacacctaattccttgggggagaaaacttgttcaggttaaattcttgcggtaatccttacggccctgtggtgttcgctaagatgtagcaagaatgtaaatagctaggtactttgatctacctcaaatacttactagtttaaacattctgccattctgccgtcataccaaaaaaaaaaaaaaagcaccatcccagggttatgaatgacgttactgtctttggacatgctgtcttgtgtggctgagacgtagatcaagagaaatttgtaagaaagacaataaggtacaaaaatcgccgaagctaatgtcaagatggagataaatagatctatatttgccatatatggtagtaaaagaaaagtctgtgcaaatttgctcgacatttatggacttctatgattcatctaccagggccagcagctccagccaagagatatagaatgtcttcaactgtatttctttcctaaattgtttcattacaaagaagccatgttgtgtattcagaagaaaattccaggaccgcatgaaagtcactatttgggaacaggcctgagaaagcttgcttagaggaattccaaaagtattcaaaaggcagttattgaccaaacacataataattctctaagcatcaacaattttccatagatccaagctcacatatacagcgtattttctgtggctagtcactccagaaatagagggttctctgctttcttgactgattgactcatatgcaaacgcttctcatttcattttgttatttttttgagaaagggcttgttctgtctcccaggctggagtgcagtggcacagtcacggctcactgcaccctcgacctctctgggctaagccatccttccacctcagcctcccgagtagctgggaccataggcacacaccaccatgcctcgctaatttttgtattttttgtagagacagggtctcgccatgttgcccaagctggtctcgaactcctgggctcaagcaatcctcccacctcagcctcccaaagtgctgggattataggcatgcatcaacatgcccagcctgttttttgttttaatctgttattgagtaaggtgcaatttgtggctccatatacagggacaggttgcaaaacaggtactgagccgtgtgtatccttcaggtccaagcagcttctaaactgtgtctatctctgttcaggtccctggaactctcctgggcagcaagctcacaagagaccgacctctgtggccttcgaagcgggttgctgttagacacaccttttagaagctacattcatagtatctcaaaagacagacataaggggtactcggtatggccaccactcactcccacaacacagccaccatttcccacccagaatttcctgtgaaatgtgctcattttaaaacagcacacatcctgagaattgcaaagttgggcatagagatcaatacaaattagacttctttttagatacgctctacgctctgcagagccctctggggtctccaagggctgggacctgctggataaaactggatgaaactaagttgctgcttctttggtgcccttgaatggactttcttggctgcagtgacgttaggtccgcttcctagccgcgtgctgctctgccatcggggatgctaaagtcggggagggccaggaagcctttctttgcttggaagtttttgtttctccttcgcctgctaggttgggataatccgttgggaagtctctgagcgtctttaaacataaaatctagtttcaaaggtttaaattcccaagttgccccctaagttacatgttgcttaggcttggttgctatctgtatggtataaataattccatttagaaattaagaaattatgggctgcatttttgatgccagtggctctgtagtatcccccaaccaccaaaaaaaaaaaaaaaagaaaaaaagcatctaaaaattgtgaggttaccgcttagctctgtctttctggctgcacatgggttaccaggtgccttgccaagaccctgcctccgtgtccaccatgctttgtgtctgcaagtagatttacccatcgttcattattaattattcctctgagcagctctgtgaagctagtaaatattaataaacaatatgtgctgattatgaacctaagacaaaaggatgtctttttcaagctgcttaattttaggtaaactagttgcacacaagcgatgaataaacgtgaagtcaggcatccaggcggtgaaacaaaatcaaactggaactgcaaaaggagagtgcctgagatctgattttattttatttttgggatggagtctcactctgtcacccaggctggagtgcagtggcgtgatctcggctcactgcaacctccgcctcccaggttcacgcaattctcctgcctcagcctcccaagtagcttggactacaggcacacaccaccatgcccagctaatttttgtattttaagtagagacggggtttcactgtgttggccaggctggtctcgaactcctgacctcaggtgatctacccacttcagcctcccaaattgctggggttacaggtgtgagccaccgcatccagccgaaaggatacagtttatttaaagacaaaggaaaaagaaaaaccataattgtgttcacttagaaacatctcccatttcatactgatgtctttcctggtggtggtgtccaaatgcttatatgtgtgtgagattcattgttaccatgttgggatcagactgtaaacaagctttataaaagttcgtggctcctttcactcatccacccgctatgcatcgtccagatctgagttcacgtgctccttccccaaaggagccttctctcctgtctagggtcaggtctgcctctttttttctttttctttttttggaagcagggtctcaccctgtcaccaggctggagtgtggtggcgcgatcacgactcactgcagccatgacctcctaggctcaagcagtcctcccacctcactcccaagtagctgggattacaggcacatgccactacacgtggctactttttaaaatttttttgtagagatgggatcttgctctgttgcccggggtggtctcgacctcctaggctcaagcgatcctcccttagcctcccaagtagctgggacgacaggctcatgccaccacacccagctaatttttttgatttttagtagagatggggtctggttatgttgcccaggctggtgttgagctccagagctaaagcagtcctctcgccttaacctcccaaagtgctgggattacaggcacatgcccctgtgcccggccaggcttgcctcttaaactcccttcgctccacatgcccttctgcagcaccggccacagataagtgtcatccatgctggtggtgatttgactcatgtctcacctgccacacaacagaggcccaggaggcacagcagcctgtggtctctgctcatgattgaaggagcccctaaaacagggccggaaggcccaaaatagccactcaacaaacatctgtcgcataaatggaagtcacgtgcctcattccaagtctttgctgttcttcaaaaaataatggtactccaaaaaataatgatactccagattacactgagccatgaccacacccctgcactccagcctggacgacagagcgagacctcgttccttacaaagaattatactgagtacctaatatgcaattgcattgctttagtagaattctctcataagtactcccctggtgtcggaatccacattgttcccagttgttctctgttctaaactcatgctgaacattcttgtgcataaatctctgcctacatctctgattattcttacggatagactcctgaaagtactaagaggaaggattaatctgcgttctgattttaaacagcccatttgtctaaatattagcagggcctaagatctggaataaatgacacagtggcaaaagtcggagtcacacgtcctggttggtttcagagagtcctggggtgaaatggtgcctttggggtccatccctgtctagcacaggagtcccctttgcagcagtgtccataaaacgttagcttgggctgggtgtggtggctcatgcctgtaatcccatcactttgggaggccgaggtgggtagatcacctgaggtcaggagtttgagaccagcctggccaacacggtgaaaccttgtctctactaaaaatgcaaaaattagcctgacgtggtagtgggcgcctatactcccagctactcaggagaattgcttgaacctgggaggcggaggttgcagtgagccaagatcgcaccactgcactccggcctgggggacacagagagactccatctcaaaaaaaaaaaaaaaagtgagcttggtgatgagtctgggaagagcatctcttcattcattcagtccacaagtattcactgtgtctgccccgaacctagcaccatcctttggcccaggaatagaacggaggaatgtacatctcctcaaatgtctcctagaaattgagacctcaccattctcgctaagctccctgagggcagggactgtgactgtctcattcactgctcgtagttaatgctcaaatggtttttgaataaattaaaatacaatatgtgggccagtgcggtggctcacgcctgtaacccagcgcttcggtaggccgagatgggtggatcacctgaggtcaggagtttcagatcagcctggccaacatggagaaaccccatctctactaaaaaatacaaaaattagccaggtatggtgacacacacctgtaatcccagctactcaggtggctgaggcatgagaatcgcttgagcctgggaggcggaggttgcagtaagccaagatcacaccactgcactccagcctgggcaacagagcgagactctgtctcagaaaaacatgtggttcctctctttgacaagttccaaatctattgatgtaattgatgtatagatacatcagtaaatcacagatgtattttcaaagttctgaaatgtaactagagatttgtttatttttgagatgaagtcttgctctgtcacccaggctggagtgcagtggcatgattatagctcactgtagcctcaacctcctgggctcaagtgatcctcccacctcacccttccgagtagctcgcactataggcacttgccaccatgcctgggtaatttttttagaaactttttgtagagcaggagtgtccctatcttgcctagactggtcttgaactcctggcctcaagcaatcctcctgtctgggcctcccaacgtgcagggattacaggtgtgagccactgtgcccagtcagaggtttcgacatgagcagttattcagaaagggacctggaagaatattttgaaatcagacctagagtcaaatcagacttatttaagagaattaaccaatggagcctgaatttggcttctcccatttcctaccactgatcccctggccatgaggacagtcctgcaggaaattcctgtgccaggtgggctagcccaggacacatggctttggagactaggcagggaagatccagcccagggtactggagctggcgcttgcatgcccctctcactggggtgtctgatccccagatgccaacgaggctctggctgtcctgtctgagctgcccctgaggccacacacaggatctcagagtggacaaacagcctttcccttgacaatgagcagttctcagctctgagaccagaagaagccttagtgcaaccatttctcaaagtttcagtctcttaaaattgaggactccggagagcttgagtgcgtgcgtgcgtgcgtgcgctgtatctctcagtattgactgtgttagacatgaaagctgaggagtctgcaaagcacaggaacacacaaacacacgagccgctggtgtcagagtgaggctatcatcacacatcgcaggcatctggaaaactccactgtacacttgcgggagaaggcgaggaaaaggcaagtaacaagaatagttttgaccttgtggatccatgaaaggatctggggagccgggagtccccagaccctgctttgaggatcgttggcttagtggcattggcatccaggctccaccataatcctgagccgtggccacgtgctgccagatcacggcctctgtgcagttcgaatctgcccttcttcttagtcctttgcaccatcctcagcctttatcctcctcggtccacattcaggcattgccacttagataaccgcccccgcgcccccctcccaccccacttttcaacatcagacaagtctttttttgtttgtttgttttttgagacatagtctcattctgttgcccaggctggagtgcagtggcacaatctcggctcactgcagcctctgcctcccgggttcaagcaattctgcctcggcctttggagtagctgggattaaaggcacatgccaccacgcctggctaatttttctatttttagtagagttggggtttcaccatgttggcgaggctggtcttgaactcctgccctcatgtgatccacctgccttggcctcccaaagtgctgggattacaggtatgagccaccatgcccggtctcatcatcagacaagtcttgcagatcccctcttgatcaggaactcaggggtccccacctgcagcttcagggtacccctcgctgcttaccagcaggcaccctatgttgaaatcctgcaccctcatctcagttcccaatcccaccagtcccccaaagccagcccttcccgtggtggagttgtaccacgtaccacgcaaaagccacagcatcagcattggagactctgccaggacacggaacgtgttttaaatggcacaaagacatttaaatgggaagaaattatagcaggagtgagtttatccctttcaagataatcttatttaataaccaaaaaactcacaaagatgtgcattttatccgactacaaaagcagcgtggcgggttatatattgtggtaattacatgtttggggtttcattcctcctttaaaccagatttcttttatttcagaaaatcagccattgtagaaaaagactattcatttatttcattgctgggtggcctatacactgtaaaaataggtcaagaacagtaatctaaattgactgctgataaataattaaagctaatggaatttttctcaaacctgtgaactaaaatctttgagaaattgccaggacatacttactgtctgctgttgtatagaaagatattttttatttaatacttgagtttcaatgccatttaaaattacccttttctatcacaaggactggaaggaatatgtgttcatctataaaagtaaccaaaggaacgatgccgtgttgatggttatatggttcatcttcagatgagatgggaagtgacggtttcagtatcctggaacaaaagaaacatcatttttcactgaactggattttaagttgaggtctacagtccacatatcatataatatatattgtcttgtttttaaagactccatacctggtctgagctcttgtatacattgataagggaaacttaacagctatctaacgtgacatccaggaaaataaatactaagaacattttttctttcattagtaattactgttctctcattgctgctaccaggaccttataaaaagacattggggtcaggcgtggtggctcacgcctgtaatcccaacactttaggaggccaaggcaggtggatcccttgaggtcaggagttcaagaccagcctggccaacatggtgaaaccccgtctctactaaaaatacaaaaattagctgggcatggtggcgggcgcctgtaatcccagctacttgggaagctgaggcaggagaattgcttgaacccaggaggcagaggttgcagtgagctgagatcgcgccactgcactccagcctgggtgacaagagcaaaactcggtttggaaaaaaaaaaaaaaaagaaattacaaagtgagctaagaccagaggagaggggagaggcaagagcggagaattaccccagatgagggagatctggaacagaaggtgacaacaggccaagccacagggccaggtccctaagggtccccacctctagcaccattggcaacaaccttgtgagagtcagaatcaagtctttcagaagtgacccagttcagcccctcactacccccaccctgccctagtgctcttggaaagactacattgtctccgaaggagaaagggtcccacccctgaactgtcactgtacaggatggggtaccaccaagagatgttgtacctcttaaatgcagtcagggttatttcccagaaaagtatccaagttactgtaggatgaaaaagacatccagaaaaacctggattatcagatttttttttcccccatttggagacagggtcttgctctgtcacccaggctggattacagtggcacagtcatagctcactgccatcccaaactcctaggctcaagccatcctccacctcagcctccaaaatagataggactacaagcctgcaccaccatactcactaatttttgtatttttttctagagacgggatttcaccacgttgcccaagctggtcccgaatgcctgggctcaagcaatcctcctgccttggcctcccaaagtgctgggattacagttgtgagctaccagatacttttttttctcttttttttttttttttttttttggatggagtttcctgggttgaagcgattctcctgcctcagccttctgagtagctgggattataggcatgcaccaccatgcccacctaatttcgtattttttgttagtagagatggggtttctccatgttggtcagactggtctccaactcctgacctcaggtgatctgcccgcttcagcctctcgaagtgctgggaatacaggtgtgagccaccacacccggcccagatattttaaaaacagaaatgacttgatgactttggagatgtgtttgtaattcacagcctccttctatgtgtgcattgtgtttgtgctgattccagtgagcctctcgctcctgcagacagaggtgaacctccatgcagcagctcagcgtgtcaccagctctgggtccctggcacgcgactctgggatatggggagtggaagagagctcatgggaattgggagcacgaggccctaagatggagcagagccttccagagagggctcgggagtgtgtgtgttacgactcccgctcgtacgttacaggtgcaattgaacactgcatgacgattttgtctctattttgcttttacatcagaatggtttcctccagcaattggcattacctagaaaattccttaatagcattttgctgttcagttctctgacctaaaaactgagttgtgaatcagcagtttcgagaataatggaaatacggccagacacagtagcacacgcctgtaatcccagcactctgggaggctgatgtgggtggatcacttgagcctaggagtttgaaatcagcctgggcaacatggcgaaaccccgtctctacaaaaaatgcaaaaatttgccggacatggtggcgcatgcctctagttccagctgctcggggtgctgagatgggaggattgctcgtgcccgggaggtcacgactgcagtgagctatgattgagccactgcactccagcctggaagagcgagacactgtctcaaaaaaaaaaaaaaagaaaagaaaaagaaaagaatggaaatccttccacatagaaacctctctgtgtaaacatcatttatttgctgtgtactcaaaggagaggaggttgacatgagctattttggcttttgccaaaaggcatatgattggaattatctcaagaacatcactttctgtgcattaagatgtttgttgctttttgcccaatagatgggatgggatggaaacaaggtgaaaacatcactgacaaacctgaattaagtatataactgaattaagtgtgtaacgtgtaacttgaagtaattaagttttaaaacatggccgggtgcagtggctcaagcctgtaatcccagcactttgggaggccgaggtgggcagattacttgaggtcaggagttcgagaccagcctggccaacatggtgaaaacttgtctctactaaaagtacaaaaattagcagggcggggtggctcgcacctatagtctcagctacttgggaggctgaagcaggagaatcgcttgaacctggggggtggaggttgcagtgagccgaggtcacgtcactgcactccagcctgggtgacagagcgagactccatccccctccccgcaaaaaagtttttaaacgtgttcactgcctccttatcatttgttccactgtggttttggccagcctgaaccccactttttccagtttatgaccacaaagaaggattgtgcgggtgtgcatgaggaccagtaagtggcagagtctgcattttctggtgctgtccagacagcaaagagtgctgtgttctagaaagacagtaaatcgtatcatgtccttgctaaccgacgatggagaattctgtgggtcagaattgagcatcttttttgagacagagtctctctctgttacccaggctggagtgtaatggcatgatcttggctcacttgcagcctcaaccacccgggttgaggtggggagcctcccaatgtgctgggactataggcgtgagccgccgtgcctggccagaattgaacatctttgtatctttcttcttagtttagtacaaaactgaataatatttgcaggcagcagaattggatcgggaatttctcaaactgccaaagatgaaattagaatgagtgatttttggctggcagcttgaagtacatatatatcagtttgtgtatgatacgtgtgagtatgtagtggtttttccctcttcaactgtctttaaatatgtgtgcgtgcgtgagtgtgtgtacaaacacacgtagctttaatatcaaaaaggttatttttgtaggtctgttaggagacatgaatatgctcaaaagggaaaaaaatacatggatagggtgagaggagtttgctttatttaaggacatgataaaaggcatagcccttctgcctttctggaatgctgtaacagaatatagaaataattgtatcatctcctgtacttctcagagctggtgtttgcgtgaggctggccctgtgccaggttggcagggttgggggtaacccaggagcatgcctgctaaggcacactgccattcagggcctggccttgcccctgcgccccagccccctgctctcctccatccagctctgccctcttccatttctctgctacagtctgaaatctctcagccacaccagctttctcattccatgacctcatctgacttgtctccttcccctctgaatctgagcccttgttaagcctttttttgttttttctttgagacagagtctcactctgtcacccaggctagagggcattggtgcagtctcagctcactgcagcctctgcctccgcggtttaagcgatcctcccacctcagcctcctgagtaacctggactacaggcatgcaccaccacgcccagcttatttttatattttgagtagagatggggtttcgtcatgctggccaggctggtctcaaactcctgacctcaggtgatccacttgcctcagcctcccaaagtgctgggattacaggtgtgagccagcgtgcccagccatagctattcttccattcattccctcatgcaccctttccatgtcttttgagtccccactgtgtgccaggccccatggtcgttttccctggaccctgctgggatcatagtaatcttcccccatcattctttacgccttccacactcttttcccttgttaccctttgtgttatatgttgtcctctacctttctgaaaagcacagtgggtgaaatgcggtgatgtgttagcttcctgttgctgctgtcgcaacctgccatgcgccgagtggcttaaaacaacagaaatttatcatgtgacagtgctcgagttcaggagtccaaagtgggatggattccccaggctggaatcaaggtgtcagccagagttgtgttcctattagaagctctgggggagaatcagtttcctggcagtttccagcctctcgcgctgccggcattcctatagcattccgacctctgcgtcggtcctcagatctcctctgactctgagcctcctgcctgtctcttactaggagcactgggattacactgggcccacctggataatccagggtcatctcctgactcatgatccctgacataatcccatctgcaaaagccccttttaccattgcaatctaacacattcacaggcgccagctatgaggacgtggttatctctggcggactattattggtgctgaccacagatagccttatttatataaaaagagattggtggccaggcatggtggctcacgcctgtaatccacagcacttcaggagaccaaggcaggcatatcgcttgaacctgggagttcaagaccagcctgggcaacatagtgaaatcctgtctctacgaaaaatacaaaaactagccgggtgtggtggcgcatgcctgtggtcccagctacatgggaagttgaggtgagaggatcccttgaacccgggaggtggaggttacagtgagccgagatcatgccactgtactccagcctgggtgacagagccagaccccgtcttaggtgggaaaaaaaaaagattggtaaagaatctgattattttttgtcctggagcctggtgtaaaaaaatagaaaatcatctagttgaggaagtaacaggattgacttctccaaggaaataatggtatcacgtttagaaatgcatcctttggaacagtatatagttaaaagggaaattataatgcttcttgaccaaatgtttctacaggatcacaatacaaaataacgtgggctgtgatgatatttgtcaaaaaacttgtggtacagtggccaggtgcagtggttcacacctgtaatcctagcactgtgggagatcaagacaggcagatcgcttgagtccaggaattcaagaccagcctgggcaacatagcaagacccttatctctacaaaaaaataagaaaattagcaaggcatgatggtgtgcgcctgtagtcccagctacttgggaggctgaggtgggaggatcgcttgaacccaggaagttgaggctgcagtgagctatgatcacaccactacactctaacctggatgacagagcaagaccctgtctcaaaaaaacaaaagcttgctgtacaggcctgtcctgtaggtccctctgcaatgatggaaaaattctgtgtctgcattgttggaagcagtagccaccagcaacgggtggctaccgaatccttgaactgtggctagggtaactaagaaactgaattttccaaatttatttaactttaagttatatttaaatataaataagcacatatggctgtatgtgttgaataagaagactttttcatctgggatcttgataggtcttacttaggaagcctctgataaaataatttgcagagttttatttctaatggcaaggtcagtagctttcctcagattctcagaaggcttcatcaactaaaatgtaggcctagcccggtggctcatgcctgtaatcccagcactttgggaggctgaggtgggcggatcacctacggtcaggagtttgagaacagcctagccaacatggtgaaaccccgtctctactaaaaatacaaaaattagccaggcatggtggtgggcacctgtagtcccagctactcaggaggttgaggcaggagaatcacttgaacctgggaggtgtaggttgcagtaagccgagatctcgccactgcactccagcctaggcaacagtgagactccgtctttaaaaaaaaaaaaaaaaaaaaaaaaaacatagtttcaatgcctaaactttcagtaaataagatattatcttagtcgagtcttttcaaagtttttgaagcactttctcagttacttcattttaaataaaatgctctgaacaagatcataagcatgcacctatgggatgtcctggtgtttcgaaatgggcactggtggcatgggataaaatttattgtgactctgtcagatgtggattcaaaacaggctgtatctccgacttaacagtgcattaaaatggcagctagggccggccatggtggctcatgcctgtaatcccagcactttgggagatgaaggtgggcggatcacctgagattaggagttccagaccaccttggccaacatggcaaaaacccatctctactacaaatacaaacattagccgggcgcctgtagtcccacttactcgggaggctgaggtgagagaatcactcaaacccagaaggcagaggttgcagtgagctgagatcttgccactgcactccagattaggcgacagagcgagactccatctcaaaaaaaaagaagaggcagctaaaatacagtgcagtggcccaggtccatttcagatagaaacagccaggcaaaccccccattctagtctattttattctaagcagattatctcacttagactgacatcagcaaaagctttagtctgtagcacattcaaaatgaggtatatgtgaccaggagttagtagaaataaaacatcgttgtaggccaggtgcggtggctcacacctgtaatcccagcactttgggatgctagggtgggcacatctcttaagcccaggagtttgaccctcgcctggacgacatgatgaaaccctgtctctacaaaaaaatacaaaaattaaccaggcatggtggcgtacgcctgtagtctcagctacttggtaggctgaggtgggaggatgactctagcccaggaggcagaggttgcagtgagccagggttgtgccactgtgctccagcctggtcaacagaatgagactctgtcttcaacaacaagaacaacaaagaaccacctcgttgtattcttaaataagtttaaatcctgaagcgccagttggcgttattgatgttttaggagtgcaggaatgggtgaggtcccaggcttgctttagatagtgataattagcactgactgccacgctgtttttaggaggccttaaccaatgtttcccttctttctccttctcaaatggctgcttcctgacctccgcctcctgctccaggatttgcgcaagcaggtagcgccgctgctgaagagtttccaaggagaggtaagcttttctattcattttctatcctgagccacccttcgtggctaattggtctttttattcacattaaagaaatgctccgggcaaaaggtgctgcccagatggtgccttcccggctgctccgacccagcgtcatgcagattttgcgctctgtgatgtaattttccattgggtccttggtgaaagccctcctggaaaaggaagctatgctcagaatacacagagctgtggtggattgccagcagaagtgccccgtgtgtggttgcaacaggcaggttgttggcgctacggccttcaggagcccatgcatcccctctaggaagtcgccttgtccccctgagctggtctggggctgccactgccatgagtgtgtgccataagtgtggtgctttgctgagaggctggcgggggcacagggaggccacttgatcacaggcttgaaacacagagcatctagcagaagccacgaggagcaagcctaggctcagtagaaggaagtggtttctaacggatccttccagagaaggacggagccatctggcagacggcacgtgggtggcaagtcacctgggacatccgccctggctacctgttagcgggaacagcagccatagaggggactgggctccacgtgagtgacactctttgccagccctttgtgtgaagattcagtgatgtttagaaaaccagaaattatattattcttgcggatttattgaatctcacctctttagcttctcccgacggaaaaacagaaagtggaatcatagcaggctgataaggaaaggaaacgagacatttccaaagcccctgaaagagcccatattggtacagtcttagggatttttttttttttttttttttggcgacagagtcttgccctgtcactcaggctacagtccagtggtgcaatctagtctcactgcaacctccgtctcccaggttcaagtgattctcctgtctcagcctccccagcaaatgagattgcaggtgtgcaccaccacacccagctaatttctctatttttagtagagatgcagtttcaccatgttggccaggctggtctcgatctcctgacctcaggtgatccacctgctttgacctcccaaagtgctgggattacagatgtgagccactgtgcctggcagggattttattttcttgcaactgctaagtcacagggaacacatgggggaagggacaggagagatatggccgtgagatacaggagagatatggccgtgagatacagtaggttcctcttgggacacaggtgatgtgggccttatatatggaaggctgggttcctggtcccagagctctagagcaagttgtcgggcttccatttgggaaattcatcaactgggagcgagagcagggagtgagtgaatgaaggaggccagggcgattgtagccaaagacagagaggcgatttcaggacatcaaaagggaccagcgtagaaagaagacacagcagttggtgatggctggaaattttcgagggcagaacagtacccctctcttcttatgatcttcttcctgcctcattcagcccccatgcacgtagcttggtccggccagcaggacacctgcatcccagggcttggatggacttgaacagtctttttctcagaacttcatctccaagcccgtagttgatgagtgaggctgttacctgacacctacccacatttgatcttacctgttctgttacctgtccagcggcttttgggagacccactggcttcctagttctctcgctcaaagagttcagtgtgctttctaggtgtttgcttgtttttctttcttattgaaaaatttcaaagctgtgtaaaaatggaaagattagtacagtgaatacctgtatgcttttttttttttttgagacagattttcactcttgttgcccaggctggagtgcaatggcacaatctcagctcgctgcaacctccgcctcctggatttaagcaattctcctgcctcagcctcccaagtagctgggattacaggcatgtgccaccacgctcagctgagttttgtatttttagtagagacggggtttcatcatactggtcaggctggtctctcattcctgacctcaggtgatccgcccgcttcgacctcccaaagtgctgggattacaggcgtgagccactgcgcccggcccacctatatgctctttacccagatccacagttgctaacatttcaccccatgtacctcccccctcccctccccgcccaccacttttgctgaacattcagaagtaagttgcagaagcaggcactgtgtccctcaaacacacgtggaaggctcccgaagttaaggaattattagcattctcctacattaccacaataaccacaaatatcacacctgggaaaattcacagtaattccaggtcatctcatatttgatccaaaatcaaatttttccaattatccccaagatgtcttttataacggccctcctcgcaactgaggtccagtcaggttcacacattacatttggaaatctgtctatctaattttctattttaaaaagtgttttttttttttgagacagggtctcgctcggtaacccaggctgcagtgcagtggtgccatcatggttcactgcagcctccacctcctgggctcagcaatcttcttgccttagcactcccctgcccccaccgccagatagctgggactatacatgtgcaccaccacatccggctaatttatttttatttttagtagagacgaggtttcaatacattgcccaggcttgtatcgacatcccgggctcaagccatcctcccaccttggcttcccagagtgccttgattacagacatgagccactgtacccggcccctgcattatctcttttaatgtaggacatcctctccatctccatcaccttcatttctttttatttttattttttctagacagggtcttgctctgtcccccaggctgggatgaagtggcacaatctcagctcaccacaacctccacctcccaggttcaagcaattcttctgcctcagcctcccaagtagctgggattacaggcatgcaccacctcgcccagctaatttttgtatttttagtagagatgggatttcaccatgttgatcaggctggtctcaaactcctgacctcaagtgatctgcctgcctcagcctcccagagtgagtgctgggattacaggcatgagccaccgcgcctggcctgatttttttgtttgtttgtttgtttgcttttttgaagagtcttagcaaattatcttgtagattagcccacattctcagtaggataatgggtttgattcctgataccttaaatttgaaatacccaagaaacatctaggctaagcttccatttgcctatttttttttaaaggccatatgaaagctaatcataaataaatacataaaattatcatagattttgaacccacaaaagaaaggtaattttttggcaccattaattaatatttatcaagcctccgctaatttataaataaattttattatgtatacttaaggtatacaacatgatgctatgggatacatacagacagtaaaatggttatacggggaagcaaattaacatatgcatcgtctcccttagttactctttttcatgtgtgtggcaggagcagctaagatctcatttagcagaaatccctcatattgcaattatatttactatagtccttgtttgcacattaaatctctagacactcccagcatcatccctcccaaaatgtgacatttatattaaataatttgtacttttttttttttttgagatggggtctggctctatcacccagggtggagagcagggtggcatgatctcggctcactgcaacctctgcctccctggctcaagcgatttgcccacctcagcctcccaagtagctaggaccacaggctcttgccaccatgcctgcctaaatttttgtattttttggtagaggtgggagtttcaccatgttggccaggctggtcttgaactcctgagctccagtgatccgcccgcctcagcctcccagagggctgggattacaggcatgggccaccacgcctggcctggaagtggtttttaaaatattttacttccatcctttcattatgatgtgttcctattaaaaaggtgatcatgtgtggaatcccagcagtttgggaggacaaggcaggaggatcgcttgagcccaggagatcgagaccagcctggtcaatatagtgagaccccgtctcagtctcatgcctataatcccagcactttgggaggctgaggcgggtggatcacctgaggtcaagagttcgagaccagcctggccaacatgatgaaaccccgtctaatagactaaacatacaaaaattaggcgggcatgatggcatgtgcctgtaatcacagctacctgggaggctgaggcatgagaatcagttgaactcgggaggcagaggttgcagtgagccaagcactctagagccactgtactctagcctgggtgacagagtgagactccgtctaaataaataaataaataaataaataaaagtttcagataatgaaatgattacttataattattataacaaaatcataaaatgtaactcacactgaaattagatatcgattgattgattatgatacctaattttgggtgtttcacaagcccagcaaattgatgggtggtgtgggggaggtgtacccttaatatgaagtccaatttaaagcttattctagcccaacaatttagacaatccctttagtaaagtaatgcacataccctctaggaaaatgctgtctttccactagtctggccaatccttgcttctctccctgagaaggggcgtgttatggaaggttgaggggatgaggggctggctcagagaacctcttggtagtgggggacaagtgtcctcagggaggaaaatcctcttaagaaataacttgagtgctcgtattagagaataaatgaaaaacaatctatgaactaagcatcggctttataaaattacagtaggctggtatgatggctcacgcctgtagtcccagcactttgggaggccaagccaggaggatcatctgaggccaggagtttgagaccagcctggcctaacctagcaagactccatctcaattaaataaataaacaaacaaataaatgtacaacagaataagttcaaatagaatgaaagaaatgacaaatataataataaacataagaatagaaatgaatgaaaaaaacaaagagccaggagagaaacattgcaaaagtcatttatttgaaaataccactgcaactgacaaaccactgtactcatcaagacaaaaaatgttaggaataaaattggggatgacattgcagctgctgcagagattaaaaagataaagggaatgttataagcaactttctgccaataaatactgaagtcgaaaaagttccaaaattctgtaactaccaaaattgattaaagaagaaacagacaacttgaatagctttgtaactattactgaaatatttccataaggtctagacagtttccaagagagttttatcaatcattcatgaaatagagagttctcatacttagcagactccttcagaaaatagaaagagcgagcacttcttaactccttttatgaggctaatataaccttgataccaaaacaagacaagaacagtacaagaaaggaaaattaaaagtcagtcttattggccacgcatggtggcttacgtctctaatctcagcactttgggaggctgaggcaggcagatcactcgaggttgggagatcgagaccagcctggccaacatggtgcaaccccatctctactaaaaatataaaaattagccgggagtggtggcaggcacctgtaatcccggctacttgggaggctgaggcaggagaatcgcttaaacccagcaggcggaggttgcggtgagctgagatcatgccactggactccagcccaggtgacagagcgagactccatctcaaaaaaaaaaaaaaaaaaaaaagtcagtcttattattgaataaatacacagaagtcttttcaaaggtattagtaaattaagtccatcaagcttggtatatcccaagaaggctgttttgtttaaaatgttcaaaacttattaacataaatccatgtcattagcagattaaaggaggaaacaatttcagtagttatatgaaaagattttgataaaatttaaatccattcatgattaaaaactaccaacaggctaggcatggtggtcaggagtttgagaccagcctggacaatgtggtggaaccctgtctctactaaaaatacaaaaacaggccgggcactgtggctcacacctgtaatcccagcactttgggaggccgaggtgggcggatcacaagttcaggagatcgagaccatcctggccaacatggtgaaaccccagctctactaaaaatacaaaaattagctggacgtggtggcatatgcccgtaatcctagctactcagaaggctgaggcaggagaatcacttgaaccagtgagtcagaggttgcagtgagccgggatcgtgccactgcactccagcctggtgacagagagagactccgtctcaaaaaaaaaaaaaaaaatacaaaaacaaaaaattagctgggtgtggtgggtgcaggcctgtacacctagctatgcaggaggctgaagcaggagaatcacttgaacccaggaggcagaggttacagtgagccgagatcgcgccaccgcactctagcctgggcaacagatcaagattccatctcaaaaacaaacaaacaaacaaaaaaccctactaacaaactaggaatagagggaaacatcttaggaatagagggaaacttctttaatgtggtaaaaggtatttatcagaaacatacattaatcatcagacccagtggtggtaaaaaaaaaaaaaaaaaaaattcccagaaaaccaggaacaagacaagaatacctactattgctactttaattaacactgtactgcaaatcttagctagcagagaagacaaaaagaaataaagtacagatagctcttgacttacgatggtgcaactttaggatgatgcaaagaaactgtactttgagtacccatacaaccatgccgtttgtcagtttcagtacagtattcaataaattacatgagctggtgaatacctgatgataaaataggctttgtcttggataattttccccaactataagctaatgtaagtcttctgaatatatttaaagtaggctaagctaagctatgatgtttgccaggttagtttattaaatacatttttgactataatattttcagcctacagtataagtattgcaacagaagaaatcaaactgtcatttttcaagtgagcctcaattatttaaccaggttactagatacaaaatcaatatacaaaagtaattatatacccctgtatcagcagcaaacttaaaaagtcatttttaaaaaggatactactggagatagccagccaaaaaaaaaaaaaaaaaactatagctagaaatgaatgtaacaatacaagggaaatctttctagagaaagatgtaacatttatattgaaggatattaaaggagagttaaatggagagagagaaagtatacaaggagagaaatttccactactattgaagcgatcacttttctccagattgatcacagaatcagtcattgtagttccagtaaaaatcccaacaaaattttttttgttttgagacagagtctcgctctgtcacccaggctggaatacagtggcaccatttcagctcactgcaacctccacctcccggattcaaggttatctcctatttgatctaaaatcaaatttttctggttatccctaagatttcttttgtaacggccctccctgcagctgaggtccaatcaggttcacatattacatttgtgtaatcccaagtagctgggattacaggcgcctgccaccacacccagctaatttttgtgtttttagtaaagacggtttcgccaggctggtctcaaactcctgacctcaggcgatcagactgcctctgcctcccaaagtgctgggattacagtcatgagccaccgagcccggccccagcaagaatcttaatgaaacttttgaaaagctgattccagaatttttatacatatgcaagaacaaatggtaaataatagtgaagataatactgaaccactccaagttagaggaattgccctaccagattattaaagctgcagtagttggcagagaatgagataaataaaccaaaggaacacaataaagaaatcagaatctggccgagcgcgttggctcttacccgtaatcccagcactttgggaggccaaggcaggaggatcacttgaggtcaggagttccatacaccagcctgaccaatatggtgaaacttcgtctctactaaaaatacaaaaatcagcctggtgtggtcacgtgctcctgtagtcccagctacttgaaaggctgaggcaggagaattgcttgaacccgggaagcagaggtagcagtgagccgagattgtgccactgcagtccagcctggcccacagagtgagactccatctcaaaaaaacaagcaaacaaacaaaaaaaaaaaaaaacaccggaatctggcctatgcatatatatagaagctgaataaattgcaaagatggtatggatcagtgaggaaaggggggacttttcatggtcctctgacgattggcaaatccttatagattaaacgaagttgagaccgagtgcactggctgctatctgtaatcccagcactttgggaggctgaagcaagcagttcccttgagccctcgtgttagagactaacctgggcaacatggtgaaaccctgtctgtacaaaaacttacaaaaattagctgggtgtgatggcacacgcctgtagtcccagccacttggaaggctgaggtgggatgattgcttgagcccacaagttggagacttcagtgagctgttgatcgcgtgccactgcactacagcctggctgacagagcaagatcctgtctcaaacagacaggcaaacaattaactagagttggagccctaccttacaccgtgtggaaacacaaattacaaggagagtcttagatcaaagctttaaactttatagaataaaatataaaagatgatgactttgggctgggtagaatttctttcttttcttttctttttttttttttttgagacggagttttgttcttgttgcccaggctggaatgcaatggcacgatcttggctcaccacaacctctgcctcccgggttcaagtgattctcctgcctcagcctccagagtagctgggattacaagcatgcgccaccacgcccagctaattttgtatttttagtagagacagggtttctctgtgttggtcaggctggtctcgaactcccaacctcatgtgatccacccacctcggcttcccaaaatgctgggattacaggtgtgagccaccacgcccggccctgggctgggtagaatttcttaaacagaaaaccataaaagagattgttgcagtaaactaccttaaaatttttaaataggagcttttttcatggaaagataccctaaagaaagtggaaacatggccgggtgtggtggctcatgcctgtaatctcagcactttgggaggctgaggcaggcggatcacttgatgtcaggagtttgagaccagtctgggcaacatggtgaaaccctatctctgctgaaaatacaaaacttagctgggcatggtggcacatgcctgtagtctcagctactcgggagactgaggcacgagagttgcttgaacctgggaggtggaggctgcagtgagctgaaagcattgcagtccagcctgggcgacagagtgagactctgtctcaaaaaaaaaaaaagcagaaagataaggccagtacactgctagctccatggtatgttcatgtgaactagaaaaaaggtttgccgttctcaatacttttcacatcacctgttggaaacttgccataataaagattcatacttacctcagtgtttaccgtgatagattcagacatccagaatgtgaagcatactgtctagggctgtgcatcccaccgttgtatgtggggtaaccttggccatgatttacaaatctggaagaggtagttgtcacacctgtaattaacaatgttcacaagatattcaaaatgctcgcatgtcaatggggggagaaacccagtaaggaaatgagtacaagtcatgagcataattgtcagaacattggaatggtcagtagctatatgaaaagatgtctaggttgcataataaccagggatatgcagattaaaataactcatctgcaagttattcctcctgaccaagttggctaaaattaaaaagtcaagttaggagcataagttgatttaaactttttgaaagccaatttggcatctggtgataaagactcacctgtaccttgacgcggcagtttcactcctaaatatatacgctaaagaaacaagcatggcgggtgcggtggctcatgcctgtcatcctagtactttggcaggcagaggtgggagtggcgcttgagcccagaagtttgagaccagctgagcaacatagtgagacctccatcttgacaaaaaaatttaaaaagttacccaagcatggtggcacatgcctgtagtcccagctactcaggaggctgaggcaggaggatcacttgagcctgggagttggaggctttgatagcaacactgcaccccagcctaggagacagagccagaccctattttaaaagaaaattaaatagataaataaacttatttgccctggaaaaccagttcagaaattttgaaaatagttaacatatgaaaacaacccagccggccatcaacaggaaaaagaatatgataaaactttgttgtaacaaaagattaataaagaaaagcatatggatttatttgctgaaagttacgagctctgtatacccagggcctctccttcacgagcactaaataagtgtttattggatgggtggatggaagcatcgtcctcatcttacagataaaaggactaaacccgagagaggattccaagtcacacaggtcataatggcaggactggcctcgatcctggggccgtctggcatcccagaagtgctaaggttggtgtgctctgatactgcttgagcggggaggaagcagtgccttcagcccctccctgatctcagccaacctttccagtctttgactgacactttgagaggccgagacaggcggctcacttgagcctgggagctccagaccagccttggcaacgtagtgaaactccatctctacaaaaaaatgcaaacgttagccaagtgcggtatcatacacctgtagtcccagctacttgggaggctgatttgggaggatcatttgagcccaggaggttgaggctgcagtaacctatgatcacactgttgcactccagtctgggcaacagagcgagaccctgtctctatttcaaaaaaaaaaaaaaaaaaagattgatgttcatcttgcatacagtgctctgcaaaccctgcctgaagcccccttcccttctaaccagcccctcctagacaaattctggagcttggtgcattgtctcgtgtacatccataactgtgtccatgcgctttgctacaaccacgatctgcatcgttggaaggagtggagcccaggttaactgtgaatttcatcacagtatcacctgctgacatggcctgagggagggaccaaggaatgatctgaaacttccctttgtgctgaatgtctcccttacatgcagcgcgctggccacgttcagagctgcatgcaggacgtgctctcggaggctgggttttactctctggtcttcattcaacgcaaccttttcgggagcctcctgcttccagctatgggccaaacagttgctaaagatgtctcattgaatacagtcaactaggatcctgctattctaatgaagggaaactgatgataaacacaaaaggcaatgttagatggcgccaggcactgcgagggagacacactgggtcttggggtagagcgggaagaggtggtagtgacttcttcagtcatccagggaggcctctccagggaggatgacggaacatcagaggaaagaagcaaggagaaccagccacactcagagctgggaaagagcagcaggaagatgggggcagtgagtgccagggctctgcagggatgggcttgcctggcagggagcaataccaaggaagttagtagggcccgggtcatgccagggccttgtaggcagaacccttaagtctctttgtagggaccctttggtctcccctttgaactaggccctttcaaagacgtacagtagaaagcaaattccccatgggcaccggcaggatgatttgacagattctaatcaaataattggggaaataaagttgggtgaactacagcagtctatgaatgagttaaaagtgactacgagtctgctgcccatcttgcagcccatatctgttgagctgtaacatatttaagcattcagatctaaaggccattgctaaataaagccagggcgtccatgtggttcgctccaaagagcatttcacagggagccagtccaggcgctgccgcccaccacctctgtgaccttgggtgagtctcggggcctctttctgcccgactttgctcatctgtaaaacgagtgggttacccagatcctcccccaaggagctccgtagctctgaaacctcatgagactcactggagcagtactttggttgactatcgctagcagaaccgaaaaggacattctccagcaatgtaaatctgttcaaaaatgggatgagctggctgggcacagtggctcatgcctgtaataccagcactttgggaggctgaggcgggtggatcacaaggtcaggagttcaagaccagcctggccaacatagtgaaaccctgtctctactaaaaatacaaaaaaaaaacaaaaataaaaaaattagccaggcatggtggtggcaccagctacttgggaggttgaaacaggagaattgcttggacgaccacctgccagggagattgtcacctcttatccattctttttttttttttttttttttttttttgaaatagagtctctctgtgtcacccaggctggagtgcagtggctcaccataatctctgcttcctgggttcaagcgattctcctgccttagcctcctgagtagctgggatttcaggtgtgcgccaccatgtccggctaattttgtattattagaagagatggggttttaccatgttgttcaggctggtcttgaactcctggcctcaagtgatcaacccgccttggcctcccgaaatgctgagattacaagcatgagccaccatgcccttgccttatccatccttctaaatgccagatcctccaagtcttcccaaaatacccagccagaaacagattcttcctcttctcatctctaatagggcttcatttatatctcccttttgattttttttttttttttttttgagatggagtcttgttctgtcacccaggctggagtgcagtggatgatctcggctcactgcaacctccacctcccgggttcaagcgattctcctgcctcagcctcccaagtagctgggactacaggtgcacaccactatgcctggctaattttttgtatttttagtagagacgggattttgccatgttggccaggctggtgtcaaactcctagctcaggtgatccgcctagtggttaggatttggcgctatctctcccttttggttttgagcctaaagacattctgcccttatagtttgcttaccaaggccttatgcttctaaaatgtagaagggaggatgtgtgtgtgagtgtgagtgagtgtgtgagtgtgtgtgtgtgtgtatgtgtctttgtacctgtttctgtccccatcttaccagtacttgcctaaatactgcattaagcatcatgggtgaaataggattagagaaggttggaccagatcagtggctcccaaagctgctgctgggttggaccagtgctgcactggccctatgagaattgctcacatgtttccagaaatacagctccccaggctcctaccctgacattccggtgtagaaggcctggggtggaaccttagaatctgtcatttttcaaagcccacctctgatgctcatgcactgctagttgtaggaaccactgggctcggttccctgaaagagctctttctcctggtaacaagttctgtgactctctctgcccactcagtcttcttagattggcatgttagaagctccatgacttgcctttgaaatatttttccagcttcaaagtcctggacttctactctggccgaactggcctgtgtattatgagtcacctgaacatactttttgatttcctgaaggctctgttattgttaagacccttttgctgttccctacctataaaactcatttccatcctttagggctgaaccgaaaagtctatctcctttgatcattttcctgaccatctcaacctatttctaactttttccctctttttttatcctcagctctattaaagtatcattaacaaagaaaagttgtatatatttatagtgtataatgtgatggtttggggtttttattttttgagacaggatctccctctgtcacccaggctggagtgcagtggcataatcagggctcactgcagccttgacctcccgggctcaagcaatcttcctgcttcagcctcccaagcagttaggactataggctcctggccaggctaattttatattttttcgattttagtaaagccgaagtctggctgcgttgcccaggctggtcttgaactccagcagcacagtctcagctcactgcaacctccacctcctgggttcaagcctcagcctcctgattagcagggactgtggacgtgtgccaccacgcctggctaatttttttattttttgtagagacgaggttttgccacgttggctaggctggtcttgaactcctgacctcaagcgatcctcccacctcattctcccaaagtggtgggattacaggcgtgatccaccacacccagcccaatgtgatgttttgatacatgcatacattacgaagtgatttccacaatctgacaacatacccattagctcactgtgtgtgtgtgtgtgtgtgtgtgtgtgtgtgtgtgtgtgtgtgtgttgagaacacttgagatctactgccttagcaaatgtcatatatatgattacaagattattaactatagtcaccatgctgtaccttggaaaagaaaacctacttttcttgcttaagtaaaacttttacccttttcaaggactgggggaccttgagtatgtgcagattttggtacacgcagggggtcctagcaccaatctcctgcgtgtaccaagggatgaccgtgtgtatagaaaatcacatgtttattacccatgtatttgttgttggatgcttagtctgtttccatatctttctattgtaaatagtgccgcagtatacatgagtgtgcagataactcttaacaatactgatttcaatccctttgtggtgttgctggatcgtattaattttggggggaacctccgtactgtttcccataatggctgtaccaatttacattcccaccaacagtgtacaaagatgcccatttctccatgtctcactagcactcgtgtgtctttttggtaatagcccttctaacaggtatcaggtgatacctcatcgtggttttgagtcaaattttccagatgattaaagatgttgagcagcttttcatatacctgtcagccgtttgcatgtctttttttagagagagacagggtctcactctgttgtgcagactggcgtgcggtggtgcgatcatggctcactgtagccttgaactcctggcctcaggtgatcctcctgtcttggcctcccaaagtttttgggattacgtgagccactgcgccaggccttatgtgttttcttttgagatccttagcccattttccgtttttttgttttttttggaaagagtcttgctctgtcgcccaggctggagaggctggagtgcagtggtgccatcttggctcactgcaacctccacctcctaggttccagcgattctcctgcctcagcctcccaagtagctggggttacaggtgtgtgccaccacacccagcaaatttttgtatttttagtagagatggggtttcactatgttgtccaggctggtctcgaactcctgacctcaggtgatctgcctgccttggcctcccaaagtgccgggattacaggtgtgagccactgcgcccggccaccttagcccattttctaaacagggtgcctgttttcttgttattgcattaacttttcccctctttccagcctgctcttaagattgtacatgctttgagggcccgtatcttgtcttagatgctttatctattctttgccttatggaagtggttacataaaacattcttagctgaatttccccctgcttctcgccttctccttgttaatgagtacttattgagtgtgatgtgcgagcatctactttggttcctagacgcccacaagcaaaataggtcagtgccctgctgggagtagggaggggttgtcagggtcttctttgggtttgtggccagacaggcgactgtggagcagaccaggcactctggggacaggatgatgcgttctggctggaagatacagggaggcttcccagggaccctaacacagcctgctgccctggacctttgctggggaactgacttctcagccagtatgtctgtccgcaggctcttgggccttctgcagtggtggaggtgacagtggtgttagccgtggtggtcactgtggtgatgtggctgctgtactgtcattatcttatggcaaaacccgcaagcctgacacacacagtgtctccctgtaagttcgcgccatgatggctcaattagggacccgtcggactgcggctcaacatccaggccagctgcataattgaaagcacattttctcctccaaagctgcagctggtttggttctgctcatgcagaaagggatctaaccttgcataacataggaaatgaacagttgagagagaagccaaattcaatttcagtcagatatgttgaggctaagtccatgatctatggaagccggggcaggagccgtgcgcctgtggaaaggggcgctctcagcagtctattaatcacggccgcccgcccggcgctgccgccactgccgggtgccactgcgcccgcgcgccccctccgatgtgggctggagcgcagccaagcactccagaagttaacctcttaaagacccggagctgctttctgttgaataaatgtaattttgtggtcagaaataaatgcttgtgatatagcaggagctttgaaaacaacggcaagctggagcgattacaaattgctccatgttgtacaagtcaacagcagacatcaaaattccacgtggagggcaaattgatttcggcccagagctctgcagctattcaataaaagtcctattaaaccattgtatgtaatgaacaatccagagcaaatctaatattttcagtggataattatttttaacatcctctcggtaactgctggtagatttcttggatgtttacagctcgaactcgggcagagtgggccttcccagctgtcatttggcatctccgccaggggacccgctccagggacccagctgcgtacatggctcctgaacatggggctctggccttggggttcaggttgccaaggaagggtgcatggggtttctgaatctcccagtgcctgggatgtagtaggtgcctgggaaatgtttgttgaattgagctgaactgagttgaaatgcacaagaggaagctctaagaaccccagaatgacttaggaaaatgatattgtggcaaagttgactcaaaacctgaggctgaagagaccagtgggttgcaggtaaggaaattgaggtcccttgtgatagaccaatgtcagcccctatgggagtcgggacagagctggcaccccgggaaaccccaggacttacccaattcacttcccgtttttggagatggactcttgctttgtcacccaggctggagtgtagggatgcgattgcagctcactgccacctccgcctcccaggttcaagtgattctcctgcctcagcctctgaagtagctgggattacaggcacgcaccaccacacctggctaatttttatatgtttagtagagacagggtttcgtcacgttagccaggctggtctcgaactcctcacttcaagtgatccacctgcctcagtctccctaactgctgggattacaggcgtaagccactgtgcccagcccccatttcactcctgttctgttttggtttggtttggatttttttttttttttttttttttttttgagacagtctcactctgtcacccaggctggagtgcagttgcacgatcacagctcactgcagcctggacctcctgggctcaagcagccctccagcctcagcctcctgagtggctgggactacaggtacacaccactacacccagctaatttttgcattttttttttgaagagatgagggcttgctacgttgcccaagacggtcttgaactcctggcctcaagcagtcctcccacaaaggcctcccaaagtgttgggattacaggcatgagccaccacacccagctcacttctgttcttgacagcttgcgaagtgcattctttgtcagggaggccacactgggagagtcgccaaagcgatcttgttgctcatctagtgttcccacccccaggatgctcccctaccttgctcatgacagggctgtaaccctgtccccttccagaccaagagcttctcagggaaggtctgttcattcattgattcattaaatatttgtggagcatgtatgccaggctagaccagaactagaccctggttagtggtggtaggtgaatgaatgtagccgttgccttcatgaagcttaacagtttagcaagatctgtatccccatgtggcacagtgcttggcgctctgttaagtgatggtggatgggtggatggattggtggatgaatgggtggatggtgggtgtgtgggtggatggatgatttgttagataaatgggaatggatagatggttgattgcatggagggagggtgaataggggatagatggatggatgattggatagaaggatggatggatagatgattggatagagggatggatggctggatgattggataaagggatagatggatgggtgataggatagagctatggatggatgaagggagagatggagggagggagggaaggagggagggagagatggatggatggataactggatagagggatggatggatgattagtctagaggtagggagggagggagggatggatggatggatggatgattagaaagcagtatgtgtctgtaagaatagattgactcttactcattttcgtctcctggagtaaaatcatccaacttgtaatgctcagtcatacagtatttatttgactatcgtggaatttaaatttctagggtattttattttctgcagatctcccttcccttggaaaaactcaatatggatgttaattaggttttactaaagttccatcaatttaatgcagtcgttctttaaatgaaactgacaccaaggaccacatggccaaaggaagcccacgttcctgtgtgtggttctgaggagggagcataggatgcagtttgataacagctgagagccctgaggagtttgttgctggatgtggagtattccatgtctcgtccctcccccagtctttttccagttgtgtcacaactccctttgctaataatattttgcacagcattttacgtctacaaagcaccatttccatgatgtcgctcacccttcgacaccaccctgtgctgggggcatcatcatcattctgagttaccaacaggaggggtagcagacagtccaaggggcaaggcagggactcccagctccaggctccagcctctcctcccctccaccctctcctggtcctgtcctgaaatctttggctcccttgaaacttgttatgcccgggcaaatgccaccctcgtgccactgtattcccaccacctccaatgagtgtcccccacctgatggggtcacacacttgtccagccacctgcacagaaaagcctcatggacacagccctgtgaggtcagaaatagaccgaacagggtcactcggttggaaggcgtggtagtgttagaacccaggtgtttgaactcggtctaatattcattccactctttcacacacacgtaagggcacatgaccactattaatcaaattttcaaaaaaaaatcagctgggcacaatggctcatgcctgtaatcccagcaatttgggaggccaaggcgggtggattacctgaggtcaggagtttgagaccagcctggccagcatggtgaaaccccgtctctactaaaaatacaaaaattagctatgcatggtggcacacgcctgtcatcccagctactcgagaggctgaggcaggggaatcacttgaacctgggaggcagaggttgccatgaactgagattgcgccactgcactccagcctgggcaacagagcgagactccatctcaaaaataaataaataaagggaatttgacataaaatcgttaatgttgactgtttcagcctgggtgacagagcgagactctatctcaaaaaaacaaacaaacaaacatgagctccatgtctgtttcatctgttcccctctaagtataaacttcctgagccttctaagtccagccaggtgggccagcggtcaccgagatccttcctcgctgggggatggaataggcctcccctgctttgctgctgttctttggccttgtcccctgcctcttttcttggaccacctacaaggacctagggggacacagtactgggggcaggagctgggaaaggcctgccatggttcactgatagtaagaaatagagactcactcggagaaatttcctctgaaatacagcagactcagcgcagccctttgggcagatgaaggaggctgagaagagcatcccttcagcaacagctgcgtgccagaagcttcgttccgttctgccatttcatctgcacagcagctcagcccggaggggagaggagtaaatgggcccagagagatcaagtaacttccttggagcttgtcagccttgagctgaaacttggactctgatgtcgaactccgaagcccatgcttattctgtaaagcctgaagagtgtcttataattgatttagaagtaggagaagagggggaacctgtgagattacactgtcttccagcataacaagaaaagagaaaccagttggatgcggtggctcacacctgtaatcccaggtgtgatggagaggccgaggcaggaggatcacttgagcccaggagtttgagtccagctggggcaacatagtgagatcccatctctaccaaaaaaaacaaaaacaaaaaaagaaaaacggaaacccatgaaatgatccatgggtacataggaagggagagaaactggttcctagggctgtgggaggaatgaccgcaggcctgccctgggaaaaagctttgcttttcagggagccccttgatgtttggggacttaggagagcaagtctggccctgagatgtgggaccaggcatccccacagagcacacatcagcagataagggctgccgctctaggaacagtcttgtcccagcgcaggcacgaggagggctcaggaatctggctgggagcattcctgccgtccctactgaggagctgccactgtggaccagaacacccccctgataggagcagactcccggggtgtagacactgcttcccttttcacaccgtctcctgaattttctcctgggttcctgcttaaaggagcggagaaaaccaaactgacaaatcactgatcttggagtcagatctggatttgaatcctgacatcatcatttgccagcgtgaccttgaatatctcatgtccgcttctctgtcccatccatataacaggaaatctctctcgcagagcagcgacgttatatgcacatgtttaaagatgatggcataaaagcagtgctggatgggagctggtagctagttattgattataggatcctctaggtcctttaacttcttcaatagccgtagtccccaggatttaaccttctggggctttccctgtatctctgtcccatccacactccagagtaacctcatctgggccgtttggggctggtggttccaaatttttgcctctggcctgggcccgtcatccaacgccaggcctccctggggctcccactgtgggtacctcgctaactaataatcttcatttcccatgtaaacacaggcacctgcgtatgccccatttcgggagaggtaaccagcccctagttgccctggccagaactctgggagaagctatgttcagtattagaccctgtgaattctttttattattattattattattattattatttactgttgtgttgggctctcgctctgctgcccaggctggagtgcatttgtgtgatcatagctcactgcagcctcaaattcccgggctcaagtgatcctcccgcctcaacctctcgagtagctgggactatgggcacatgccaccactccctgctaagaccctgtgaattctatttccctaacctcgctggaatcagctccctccttcccagcagttggctttctccctctctttcctggtctggtctgtctaccaccagttgccatcctgtcctgagtgatcgcttcatttcccaccctgattgacatcctcagggattccccttcagcataagctgcccccaccccgggcgtggtcccttgcacctccctccacaggctggcccctgcctgcctcctcacctcacgtatccccagtcacctcctctgctccaaggcacggcaggtccctgcccttctctgagcaggccactttgtttgaacacgtctctgtgtctttgaatagccctcctctccccactgaagccttctgcctcccaccacgaataaagatgatctttgtcttctttaaaacttgccctaagtttgcaaaacacaggatgtagagcagcatctaatagactatcatttgtgtttgaaaaaaaaaaaaatagggccgggcgcagtggctcatgcctgtaatcccaacactttgagagactgacgcgggcgtatcacctgagctcaggagtttgagaccagcctggccaacatgttgaaagcccgtctttaccaaaatacagaaaattagccaggcatgatggtgcgcaactgtagtcccagctacttagggtaggaaaatcagaggcagcagaatcgtttgaacctgggaggcagaggttgcagtgagccaagatcgtgcctctgcactccagcctgggtgacagagcgagactctgtctcaaaaaaaaaaaaaaaggaacacagtgcatgtctataggtgcttgtaaatgcataaatacctctgggaggatgcccaagactatctttacctccagaccaggcagctggatgacaggtggatgtggatgggaggaagacctacttttcactgtcaactttgttttcgctttgcttttctttttacaattaaatgacttttagtgtattcaccaagtcatgcagccatcaccctaattccagaacattttcgtcagctcaaaaagaaacctcatactggccgggcgcggtggctcacatctgtaatcccagcactttgggaggccaagtcaggcaggtcacttgaggtcaggagtttgagaacagcctggccaacatggcgaaaccccgtctctactaaaaaaacgaagtacaaaaaaattagccaagcgtggtggtgggcgcctgtaatcccagctactcaggagactgaggcaggagaatcacttgaacctgggaggcagaggttgcagtaagccgagattgcaccactgcactccagcctgggtaacagagtgagactccatctaaaaagaaagaaagaaacgtaatacccattagtggtcactcctcatttatcccaaccccaacccttggcaaccatgaatcccccttctgtagatttggccattccccccatgtctctgtagatttggccattcttaacatttcatatcaatgagatcaaataatatattagttttttgttcccggcttcttttacttaaccatggtttcgatattcatctatgctgtagcatataccagtacttgctttcattctttttatggctgaataatattccattgtatggatgtcccatgttttatttatccaattatcagctgatggccatttggagttttgtttccccactttttggctattatgaataatgcttctatgaacatccatatacataagtttttgtgcaggtaaacacttttgtctttcttgcctacctaggagtagaattgctgagtaatagggtaactctatttttaacattttgaggaatggccaaactgttttccaaggtggctgtgtaattttacatttctgtcagcaatgtaggagggttccagttcagtttctcgacatcctttctaacacttagtatcatcttttttttgggagacagggtctcgctctcttgcccaggctggaatgcggtagtgtgatctcggctcagtgcaacctctgcctcgcaggttcaagcgattctcctgcctcggcctcctgagtagctgggattacaggcacgtgccaccatgcccagctaatttttttgtatttttagtggagacagggtttcaccatgttggccaggctggtctcgaactcctgacctcaggtgatctgcccgcctcggcctcctaaagtgctgggattataggcgtgagccaccgcagccggccccattatatgtctttttgatgctagtcatcccagtggatgttgtggtatctcattgtggttttgatttgcatttccctaatgagtattggcattgagcatcttttcatgtgcctattggccatttgtatctttggagaaacatctattcatatcctttgcccatattctaattcagttacttttattaaatatttttaatttttgtggggatgtatatatatatttatggggtggagcacatgagatgttttgatacaggcatgctacgtgtaataatctcatatggaaatggagtatccatcacctgaagcatttatcctttgtgttacaaataatccgattatacttctttaattgcttttaaatgtacaattaagttattgactgtaatcaccctgtcgtgctatcaaataataggtcttaattcattcctcctggcttttttggtacccattaaccataccacctttccagccccactacccctcccagcctctggtaaccatccttctactttctatgtccaagagttaaaaattgtttttatgtttatatcccacaaatatgtcagaatatgagatgtttgtctttctatgcctggctaattgtttttttatttaatgagttgtaagagggcttatatattctggagtatcttttcaaaacttccattctgtgggttgtcttctcacttttttttttttttttttttttgagacagagtctcaccctgttgcccagggtggctgcagtgtcacgatctcggctcactgcaacctgtgcctcccaggtttgagccattctcctgcctcagactcctgagtagctgggatcacagttgtgtgtgccaccatgcccagctaatttttgtatttttagtagaaacagagtttcgccatgttggccaggctggtcccgaactcctgacctcaggtgatccacctgcctcagcctcccaaagtgctgggattacaggtgtaagccactgcacccagcctctcttttcagtttcttggtagcgtctttagaagcgcagaagttttatatttgatgaaatccaatttgtcgatttttcttctggtatttgtgcttttggcatcatacctaagaaaccattgcctaatccaaggtcataaaggtttacacctgtgttttcttttaagaggttttatagttttagctcatatattttggtctttgatttattttgagttaatttttgcatatggtgtgaggtagggatcaaactttgctcttttgcatgtggatatctggtcgtcccagcaacatttgttgaaacactgttcttttacccttgaattgtcatgtcactcttgtcaaaaatcagttgatcataatatgagggttcctttctgggctgtattgatctgtgtgtttatccttatgcccctaccagttcaggtcaatgtagttttgtatttagtattgaaattgggaagtgtgactcctccaaccttgtttcctttttcaaaattattttggttatttggggtcattgcattttcatatgaatcttagaatcaacttgtcaatttctgcaaagaagccagctgggtctaggcacaggggctcttgtctgtgattctaacactttgggaggccaagacgggaggatcacttgaacctaataattcaagaccagcctggacaatataatgagatctcatctctacaagaaaaaagttaaagattagccaagcatggtggcgcgttcctgtagtctcagttactccggaggctgtggcaggaggatcacttcagcctgggaattggaggttgcagtgagctgaggttgtgacagtgcactccaaccagagtgacagagtgagaccctgtctccaaaaaaaaaaaagccagctggaattttgataggcattaccttgaatgtgtaaatcaacttcgtgactattgccatcttaaaaatattaagtcttccaatccataagcattggccatctttccatttagtttagtgtctttcagcagtgttttgtggtttttagagcacaagttttgtatttcttttgccaaatttattcgtaagtattttatactttttgtgatgctattataaatggattttttttttttactttcactttcagatcatttattgcaaacatgtagaaagacaaatgtttttttacagggatactttgttgcattgagctccacttttttatgctttgaagatagtgtgtttcttcaaaaatggaagtctgtagcaaccctgagtcaaacaagtgtgtcagcattatttttccaactgcaggtgctcacttcctttctctttgtcacactttggtaattcccacaatatttccaattattcactattattatatctgatatggtgatctgcagtcagggagctttgatattactatcataattgtttggggacaccacaaactgtgccccatataagatggcagacttaattgataaatattgtgtgtgttctgactactccaccaaccagctgtttcccatctcttcctgtctttgggtttccctatttcttgagacacaacaatattgaaattaggcaaattaataatcctgcaatggcctattaagtgaaaggaacagtcacatgtctttcactttaagtcaaaagctagaaatgattaagctcagtgagaaaggcgtgttgaaagctgaggtaggttaaaagctggacttcttgcaccagttagcccagtcattagtgcaaaggaaaagttcatcaaggatatgaaaagtgctgctccagtgaacacatgaatgataagaaagccttatttctgatagggagaaaattttggtgatctgcatagacgatcaaaccagccacaacattctcttaagccaaagtctaattctcttaattgggtcttaattgtctcaagccaaagccctgactcttcaattctatgaaggctgacagaggtggggaagctaccgaataaaagttggaagctagcggaggttgattcatgatgtttaaggaaagaatttatctccataatacaaaagtgcaaagtaaagcagcaaatgctttggtggaagctgcagcaagttatccaggagatctagctaagataatcaacgaagatgatggcgctacacaacagattttcaatgtaggtaaaataaccttctcttggaagaagatataatctaggacttgcataggtaaagagaagtcagtgtcttgtctttaaagcttccaaatgcaggccgactctcgttaggggataatgcagctggtgacttgaagttgaagccattgctcatttaccattcggaaaaatcctagggccttcagaattaagctacacctactctgcctgtgcactagaaatggaatcataaagcctagatcacagcatctgtttatagcatgttttactgaatattttaagcacactgttgagacctactgcccagaataaaaaaaggttcttttcttttctgagacagtcttgctcttgtcacccaggctgaagtgcaatggcatgacttcagcacactgcaacctctgcttcccaaattcaagtgattcttctgccttagcctcctgagtagctgggattacaggctcccaccaccatgctcggctactttttgtatttttagaagagatggggtttcactatgttggccaggccagtcttgaactcctgacctcgtgatccgcctgcctcagcctcccaaagtactgggattacaggcatgagccaccacactcggctgataaaaagattttttgttttttgttttttgttttctggttttttttttttgagacagagtctcgctctgtcacccaggctggagtctagtggtgcgatctcggctcactgcaacctctgcctcctgggttcaagtgattctcctgcctcagcctcccgagtagctgggattacaggtgtgtgctaccacgcctggctaattttttgtatttttattagagatggagtttcactgtgttagccaggatggtctcgatctcctgacctcgtgatccgcccgccgcagcctcccaaagtgctgggattacaggcatgagccaccgcgcctagccgaaaggttcttttcaaaatatgactgctcattgacagtgcacctggtcaacaagagctctggtggagatgtacaagatgaatgttgtttccatgcctgctaacacaacctgcattctacagcacatggatcagggagtaattctgacactcaagtcttattttttaagaaatacattttgtaaggctatagctgccatagatggtgattcctctgatagatctaggcaaattaaatagaaatcctttccttctggaaaggagtcaccattttagattccatgaagaacatttgtgattcatgggagggggttgaaatagcaacatgaacaggagtttggaagaaatggattccaaccctcatggatgactttgaggggttcaaggcttcagtggaggaaggaactgcagatgcgggggaaatagcaagagaactagaattagaaatggagcctgaagatgtgactgaattgctgcaacctcatgatcaaacttgaatggatgaggggttgcttcttatgatgagcaaagaaagtggtttcttgagatggaaactactcttggtgaagatgctgtgaatattgttgaaatgacaacaaaggatttagaatattccataaactgagttgataaagcagtgactgggtttgagaggattgactcctattttttaagaagttctactgtgggtaaaaatctatcaaacagcaatgcatgatacacagaaatcttgtgttaacgaaagagtcaatcaagctagccaatttcattgttgccttaacaaattgccacagtcaccccaagcttcagtaaccacaaccctgatcagtctagcagccatccaacaccaaggcaagactctccaccagcaaaaagattacaactccctgaaagctcagataatcgttagcatattttggcaataaagcattttttaattaagatatgtacatttttgagacatagagctattacatacttaatagactatgatacaaacataacttttatattcactggaaaatcaaaaaatttatgtgacttgcttcattgcaatatttgctctttttgtcatatttgccttttttgttctatttttgagacagtctccgtcactcaggctggagtacagtggcacaatctcggctcactgcaacctccacctccagggttcaagcgattctcatgcctcagcctcccgagtagctggaattagcaggcatgtgccactacacctggctaatttttttttttttgtatttttagtagagacagggtttcacgatggtggccaggctggtctcaaactcctgacctcaggtgatctgcctttctcagcctcccaaagtgctaggattacaagtgtgagccaccgtacctggtctgtttttactttcttatggtggtctggaaccaaacctgcattatctttgaggtatacccgtatattgatcttgcattgtgaaagtcttgctgaatgtgtatgtttttatacatctacaatttttttattgtacacatatattatctactcacaacaatggtgatgtgaaaatctcaggtaggcatttatcccctaggaagcctgccccactcccccaccgggatttacccgagggaggtaggagaggggagcattaccccatcttaaactttttgggagcagcagtaggaatctgtgtctcccataggctggaatagaacatagcctagcacatcttagcctccttaaatgactttattgacagaatgaaggaagaagtgaagcgggggtgagcaagcagccagcacctccttcctctgaagagcctgctgcaggcaggtttccctgttgtctaagctgtgatctgctgtcctggagcatttacctgctcatgctggttttgcactgtggggagagagaagacagctaatctttcttccccaagacagcctttcagatagatgttgacagccagaatggcagatgtacttggaagggctttgtaaactcaaggagaatagagatgcttgttgctgtttttatcatcttggcttttaatcttgtgctgtcccctgccacaaatctcctctatggatcccacaccctttctccaagccagcggcttcttcggggcctctctagttttcctcttagaaactttactaagtgggaccgggtacagtggctcacacctgtaatcccagcactttgggaggccaaggcgggtggatcacttgaggtcaggagttcgagaccagcctggccaacgtggtgaaaccccatctactaaaaatacaaaaattagctgggcgtggtggcaggtgcctgtagtcccagctactcgggaggctaaggcaggagaatcacttgaacccgggaggtggaggttgcagtgagctgagatcgtgccacctcactccagcctgagtgacagagtgagacttcatctcaaaaaaaaaaaaaaaaaaaaatttaaaaccctcaagatttggcctgcgtacgtgtctgttttggacagcatccgactcagtcttagctgacttctagtgtttaatgtggcccttcaaaccatgctttgctcttgaaaacattctacagccagacttcgagtgagacaaaactaccctatcatatccctgcagttttgttgatttttattgtcctatagtccgacagagctcatcgatttgaaaattcttttaatggcctgtgtttatttctaaatcattagcttgtaaactcccagggcatagaggctagtggattgttcttgaatatgccgtcttcactgtggtcttaaatgttgcttaggggccaggcgcagtggctcacgcctgtaatcccagcactttgggaggccgaggtgggcggatcatgaggtcaggggatcgagaccatcctggctaacatggtgaaaccctgtctttactaaaaaaatacaaaaaaagtagctgggcgtggtagtgggcgcctgtagtcctagctacttgggaggctcaggcgggagaatggtgtgaacctgggaggcggagcttgcagtgagccgagatcacaccactgcactccagcctgggagacagagcgagactctgtctcaaaaaaaaaaaatgttgcttagggtcctggtcctccaggactttccacatcttggcttcctgcttgatttgatcacgacggggaataacctatggtgtggtggaaagaaaggtgctgactttggatttattagcgaaggttagtgctgttgacccggtttctatccagatggtgtcagatacttaatgtaggaggttcccacatttataatcacaacagctcaacaaggagggagttactaccctcacttaatggacgaagagatcaaggcttcagtatatatatacacacacacatatatacatatatatatatacacacacacaaataaacacacacacacacacacacacacacacacacacactttgctgcccagtcctggagtgcagtggcatggtcttgggtcactgcaacctccaccttctgggttcaagcaattctcctgcctcagcctcccaaatagctgggattacaggtgcctgccaccacacctggctgattttttgtatttttagtagagatggggtttcaccatgttggccaggctggtcttgaattcctgaccttgtgatctgcccacctcagcctccaaaagcactgcgattacaggtgtgaaccaccgcgcctggccttttttttttttttttttttttggagacagactctcactgtgtctcactctagcccaggctagagtgcagtggcatgatctcagctcactgcaacctccgcctccagggttccagtgattctcctgccccagcctccccagtagctgggattacaggtgtccaccaccatgcctggctaatttttgtattttcaatagagacaggtttcaccatgttggccaggctggtctcgaactcctgacctcaggtgatccatctgctttggcctcccaaagtgctgggatttacaggcgtgagtcactgtgcccagccaaagacttcagcatttaagtaacctgcctcccggtcacccagccagtgtgtgctggaactaggattcaaacccaagtctgtcttttgatcaaaccacacactctttccattgaccatgtggcccccagccccagtgcgcaatgctggatgttatcatatccctaggaggggccaggagccagggtccaagtaacttggtgggtttctgcgtctgagaaatgaagctggtgagacggcggttccttcactgttttccaagggctgccacggctttgatcttgacagcaaccaagatgtatctccccactttgcagatgaaaaaactgaggcccagagaggttaattcaatggttcaggcagagcacctgttttatgttggagctggaaatcaaaccctcatgtgccaacagcatgcccaggcccttggctgtgtgtggcgtggacttgcctaccacatgggcatggccaggcccctgtggtgcagtggagagatgagccttttttatttcaaaatacacagcacttcttggccggtcacagtggctcatgcctgtaatcccagcacttcggaaggctgaggcgggtagatcacttgagctcaggagtgagccactgtgcccggcactgtatgttactctcttagagatatggccaactcgtgagatctgtaaccatcagcttttactagattatgctgcagtaacaaacaaactgctacaaatctcagtggcctgtggcaaccaaagatcatttcttgttcatgtgtcatgttgactagggctggctgtgactgtgccccagccccgtgggtggtcctcattctaggatctcagtggaggaagtaggtcctataaggtccttgcagcagagggagggagcacactggctcttaaatcttaatgctcagataagacaccatcacttacataccattggccaaagcatttcgtgtggctatgcctgacatcactgaggagggaaagcacccagggggaagttgctgttacaccacaagtcacgtggcagtgggcagcgatgtgtgacgcctcctccagggagcctagatggtagttgggagcggcagcagcatattccatgtgactccgggaacccacagcacagccgtgctggcactcacatggttgggcactttctcaccccttccatatctcagagatctggtggatttctatgaaacttgttttctaaacctagactgagtttttatactatcataagcggatactgattgagagctagattaaaataccttcctatagacatttgtctttctcttattttatttgagacagggtctcactgtcacccaggctggagtgcagtggtgcaatcatagctcattggagccttgacctcctgagctcaagggatcctcccaaagaggtgggaccacaggcatacaccaccacacccacccagccaattttttattttttgtagagacaggatcttgctacactgcccaggttgatctcgaactcctgcactcaaacgatcctcccaccttggcctcccaaagtgctgggattataggcgtgagccactgcactacacatttgtctttaaatgtaacacttagccgggtgcggtggctcatgcctgtaatcccagcactttgggaggccgaggcgggcggatcacctgaggtcgggagttcaagaccagcctggccaacatggagaaaccccgtctctattaaaaatacgaaaattagctgggcatggtggcaggcacctgtaatcccagctactcgggaagctgatacagaagaatctcttgaacctgggcggggaggttgcagtgagccaagatcgcaccattgcactccagcctgggtgacagagcgagattccgtctctaaataaataaataaatgtaacactacattaaaaaaaaaaaaactcagccttatgaaagtgatgttgctgaaaacataaccgtggaatccagtagcggccattagtgcagatgtgcgggtcactgcaggaagacagctggagagcgctgttgggtgtgtacagtggagaaagacacctcccaggagctactgccagccaagtggctgtcatcatctcacagcacacaaaacagatgcttactacacagagaactctttacatattaagtatttccttttctttttttttttttttttttttttgagacggagtctcactctgtcgcccaggctgaagtgcaatggcacgatcttggctcactgcaagcgcggcctcccgagttcacgccattctcctgcctcagcctcccaagtagctggaattacaggcgcctgccaccacacccagctaatttttatagttttagtcaagagagacgaggtttcaccatgttggccaggctggtctcgaactcctgacctcaagtgatccacccaccttggcctcccaaagtgctgggattacaggcgtgagccaccgtgccttgtcaagaaccctttacatattgagcattttcataaatatttaaacctggattcctgaacccttgggtcacatctgcagaccatgcagttggccattgcggaagatattaaaagcatattaaacacccactgcgtgcccgtggtcgggaggaaaaacagttgatgctacagcttagttttccaggaattcagtatccctgagtcaggcagccttatctgtcatcctagaactccaggacagccccaggtggtggtgggaggggccgcggctgggagatggagctgctctgagcctgcagatcagggtagcattcctgggaggcgccttccaggcggaggggaaattgctcatgtgttctgggaactgggagtgactgggtgtggcaggagtgtgaggcatggcaggaggtgagcctgaaaaagaggctgatccctcagagcaggacaggttttacccaaggctgcaggccagtgtctaaccgtctctagatccgtcctggtttagcttcttccaaatagttttgtgtctgtgtgagagtgtgtgtgaaacggagttttgctgtgttgcccaggttggtcttgaactcctgggctcaagcgactctcccaccttggcctcccaaagtgctgggattacaggcatgagcaacggtgccggctctaaatggttttaagggcacggtacctacctcaagctaacgtgcaggcaggcacgaggtagctggaattctagcctaggattctctcttcagcaattcttgccttaagacctcaccttagacgtttgctcattcacagatccctccccttctcagagggagctgtgttaccaagccttggcttgtacctccaaggcatgcagtggatgggctgagctccctgcagggagtcaggcgggtgtgtggggggcatgaaggtgagcaggacactgtcccttcctccctccctcccacggatgctcttcctggctggtagccatgtggacacctggggggaagctgttctgtgtggcagagtcactgtgttgtgtctggtactggggcccttgccagggtaggtcagtgactcgtccaggccctggaggctgctgctgtcccctcctcgtgcagaggaggtggggctggcagtcaaagcccaggctccctccctccctctagactcagaacagcccaggaacccagctcgaggtctggaggaagtgatgtgtgcattgggtcttgcagcatagataggttttgagtggacggagaggttagcgaagggtgttccaagtaagcaaagcacggaactaggaagtcactggctgcagcagggaagtcacacaaagggacaacctaccacagactgggtgagctgcagagggaggatggactaaactccaacttcagggtcattctggttgtttttttttaagacagggtctcacttggtcatccaggctggagtgcagtggctcaatcatagctcactccagccttgaacccctgggcccaagcgatcctcccacctcagcctccgaggagctgggactacaggcgtgtaccaccgtgcctgtctaatttgtatttttttgtagagatagggtctcactatgctgcccaagctggtcttgaattcctaggctcaagccctcctcccacctcagtttcccaaagtgctgggattacaggtgcatgccaccatgcccagctaatttttatttttggtagagatagggtctcactctgctgcccaggctggtcttgaactcctgcctccatttcctaaattgttgggattacaggcctgagccactgcgcccagccttgaggcccattcttgtctgcggagcggaggggactttatcatttagaaaaggatcttttaagtcatctcttttaagaaacctcatggtccatttgcatactgaattcattaaactcatcggcctgaccgtgttcctcaggactgggctggaatttccctgtgttagtggaagagggcacggggagaggactgagagtcttggtccctgtgatacagctctgatgagtggaggaacactggggtttttggtttttatgccggtttagataaaatgacatggatacacgtggagtggttttttttttgttttgttctgagatggagtctcgctctgtcgccaggctggagtgcagtggcgtgatctcggctcactgcaacctccgcctcctgggttcaagcaattctcctgtctcagcctcctgagtagctggcattacaggcgcctgccaccatgcccagctaatttttgtatttttagtagagacagggtttcaccatgttgaccaggctggtctgcatctcctgaccttgtgatccacctgccttggcctcccaaagtgctgggattacatgtgtcagccaccacgcccggctcagtggagtggttttaaaaccccgatgtccacggggctggttccttctgctggctgtaggggagaatctactgtgtccctgtcccagcttctggtggtttcctggtcatcttcttctttgtagatcatcagcccagtctctccttcatcgctctgtgacatcctacctgtctacatgtctgtttctgtgtccaggtttctcctccttattggatccaactggacgagggcccaggctaatgaccttgccttaccttgatcacctgcagagaccctagctccaaataaggtcaccttcacaggtattgggggtcaggacttcatcatctttcaagagacacaattcaacccattatagccccgaagtgtgccgtgcaaattaccaaaccccacatcctggggaataacccaaacaggagacaggaggacagagttcaggatccttccagatcccagcccttgcctccaggagacgcagccacccggtaccctgagtcggaatacctcggaagtgaggggccctccctaggcagatcctaagccagaaagagaagcctctgtgtggccatcaagcggtacggacagcagccagggcgtctgcccagcttcctggacagactctgctacccacctgcctctcttagaagagccccaggttgcgttccaattcatctggagaagcaactccaaatccgttgcttactctagacatctataatatgtgggcttaggtacagttgaaacagtgccatttagacagttcccaaaatttgtaatagatactgagaaagatacatgatacgacagggaaagaaaacacaacacactatcttacgtataggctgatttcaagtacgtacatacacacacgcgttttaagcagcttgattgagatataattcacataccatataattcacccatttaaagtctggagttcattgacttttaggatattcacaaagttgcacagctgtcaccacagacaattgtaaaatgttttcatcaccccaaaaggaaatcccacacccttcagttggcatccaccagcccctccttcccacccacccccagtctgagaccactcttaatgtataatacatctgtctcttgtttgcctgtgtgtctgcatttcatgtaacttttttttttttttttttttttgagacggagtcttgctctgttgccaggctggagtacagtggtgtgatctcagctcactgcatcctccacctccggagtacaaatgaagcaattctcctgcctcagcctcctgagtagctgagattacaggtgcacgccaccatgcccggctaatttttatatttttagtagagatggggtttcatcatcttgaccaggctggtcttaaactcttgacctcatgatctgcccacctcggcctcccaaagtgctgggattacaggtgtgagccaccgcacctgaccacaactctattttttttttatataattaggaaaaaaaaatagaaataaagacctgatagtctgactcctgccggtgagtggaggatttcaattatacttttaaattttttttctatatttttgatatttttctgatcacacaatgagcatgagttgctaataatgggggagggggttattttaaaaacaaggcatggtcttgtcatattaatagtccttgtaggcaaggcatggtggctcatgcctgtaatctcgcctgacccctgaggtcaggagttcaagaccagcctggccaacatgacgaaaccccgtctccactaaaaatacaaaaaaaaattagctgggcatggtagcacactcctgtagtctcagctacttgggaagctgaggcaggagaattgtttgaacccgggaggtggaggctgcagtgagctgagactgcgccactgcactccagcctgggcaacagagcgagcctccatctcaaaaaaaagtccttgcatattgttctgagattctactcaacaccaaattcacaaccttgttttttgttgttgttgttgttgtttaatttgagacatggtctcgctgtgttgcccaggctggagtgcagttgtacgaacacagctcactgcagcctcgaactgctaggctcaggcagtcctcccacctcagcctcccaagtagctggtattacaggtgcattgccaccccgcccagctaatttttttgttttttgtaaaatttttatttttaaattttaatttgtagatagctcattattttgcccaggctggtcttgaactcccgggctcaagccatcctcctgtctctggctcccaaagtgctatgattacaggcgtgagccaccacacctggcccagaatcacagccttatcttatcgggttgagggggtggaaatgtgtctgagttccaaacaattgacttcaaattggaatcttggtgcacagcttgttagaagttggaaatgcttgcattgcgctaggctgctatgtgttcgattttctaggcccagctcccactagccatcgtcccccagttctgagcgccccacatccttaatcaggagacctctctcagcccttaacaaactgcccggtggctcaggtgagaggccctgtaattaaaccgcatcctttgcctctgtaataacatcggagacagcatagttctaggaggggacagacggaatatataatttcctgtcctttgcctgagccagtatgacattggtacatgtgcagtcttgcgtgtttcggctgtaaagtgcgatctgttgtctcagcaagtgtgtaggtaagctaaatattctaacaagtcagtccaaccatggcaggctctttgcatatgcgtccagcatagttgatgaacagacgtctacactagaggaaactggctcagttagtcagttcacaaaaccaatcctggccaccatcgcaaaaccttgccagttgcctaatctggaatccccgggaccgtcctcaattcacctggttcttctgggcctcacgtcaactgtgtgtgtcgctgatctctccagccgccctctcctcctcctcgacacccacaaccactgcccagcgcatctcactcggatgaaagcagtgacgtccgagggttctcttcctccctgccccctcctgtgctctttccaccctgaccgctgctcaggtgatgagggtctccctgcaccatgcacccttgtgcccctcaaaatctcaccccacttgattgtccagctgcgtcacccacagctcctgcatatgtatccgcgttcccacctggcagactctcgtgggtcccctatgccccatggtgtgttgtagccgtgttggtggactcttaatctggactccaggaatagagcacaagctgacatgcaaatgagtgtcttaaaacagaacacataggccagacgcagtggctcacgcctgtaatccccgcactttgggaggctgaggcgggcagatcacctgaggtcaggagtttgagaccagcctggccaacatgataaaacctcgtctctactaaaaatacaaaaattagtctggcatggtggtaggcacctgtaattccagctacttgggaggctgagggcaagaatcgcttgaacctgggaggcagaggttgcagtgagctgagatcgtgctactgcactccagtctgggcgacagagcaagactctgtctcaaaaaaaggagaattttatgaaattctttgctcctgggatttgaatgtgttcgtccgtttacatgcagcatcttacccgtccacctgggtgaaatgctttttaagactctgctctaaggtcacaactttactgcctgaagttcccttctgcatgtccccagggatttaattacttgttaattacatacctgtttccctcctagaccctgagcttctgggggtaggaactgtctcttcccacccacctctgatccccagcagtgtctagcacatggccagctcttaagtcagcatttggagaagacaaaagaccaggaagggcacgccagaccattctctatggaagacccacccagtgttccctgctgtatagtgaatggctccatactcccaaatctctgctcctcccttgtttaccttcatgaacagggtccttttgtgtttgcaggcatttcctctaagaggctgaagcccagttgtcaagcatctcccttgctacgggaattcactagatgtgtaatgctttgtaaattacctcttgacaaatgttgagctctttgtttttcttttctttctttccttccctttcagattgatgcactgagtaaaagaagcaaggaagctgaagcagctttcttgaatgtctacaaaagattgattgacgtcccaggtaagccccggcagtaatggcccaccagtggggggcgttgtgtctggtgagtcggtgggtttttggctcattcttcttggctttcctaaggaaaataaatacaccatcagtggcaacttccccccaagaaaccagggagtgcaggacacatgaattcttcacaacccagactttgggtacggagggaaattggatgcacttgttgaagtactcacgtaatctctaggggatgacttcgtaaaagcagagatccaaatctctggggctacagcataaaaccctgcacgtactgcagagaagatgcagacctgatgtgtgtatgctgtgtggaagtccctcatattgcccaaagccacctttaagactttaggaatggccctactaagacacctggagtgtcccgctcccctgccaggtcatccaagatcagtggcccctggacaagcccttcacttaagggttatgggcagagggtaactgataatccttgcagctacaaccaagtatatcagttgtttcttttattttttttttctaattttatttatttatttttgagacagggtctcgctctgtcgcccaggctggagtgcagtggcacaatctccgctcactgcaacctgcacctcccgggctcaagcgatcctcccacctcaacctcccaagtggctgggaggtacgtgccaccacattcagctaatttttgtattttttgtacaatgagtgcgatgaggtctcactttattgcccaggctggtctcgaactcctgggctcaagctatcctcccacctcagcctcctaaagtgctgtgaggttacatgcaggagccaccacgcctggccctgtttcttcttttagagggattgaagaattaaaatttaaatatgtttgtgaggcattctaagaggtgatggcttccgattctttattctggaaaagtgagaaggcaggtagagtgccttgaactctctggtcctgtttgtgggtcctcgattgccttagaatctggagtaaggtgatggacataactatgtggggcccagctcagccctggagagatgctgatcagaaaattaggaaagtcacttgatgcctttttctgccaagcaaagaattggaattaccaccaccctcccctccccacccattacagttgtgcccttgcccttgttagcaattctctgaatatcattgacatcattagagctacattaacagagcgaggcagactcaggtctcctttgtacctgtacttgtgttctgattcaggtctaccacgggctttgctgtcccctcttggagctgggattaatagaggtcacaccaaacacgggatggcagaaagcacttcggacagggaatgaggagacccagattctccttccctggatgacattccttttcctctctggacttcagtgttctcatctgtaaaatggaacagggtcagggaacagcctaatcgtagagaatggtttgctttgttctaaacttttgctgtcttaggagcttatctagttattggttccaaattctagccttttggttttctgtgagagtttgtatctgactaggagttccctgaagaacctgactgagcttcacgaggaggctccttcacagtaaaatggatcagagtgttaccactggagggtgtccaggttcttggcgttttgagcaatgaattggacaaaatgcacaaagcaaggaaagaatgaagcaacaaaagcagatatttactgaaaatgaaagtacactccacagggtgagagtgggctgagcagccgctcaagggcccagatacagattcttctcgggtctaaatatccccttgaggtttcccattggcaattggtgttcaccccatgtaaatgaagtggtggccctcattcagtctgatcagttgcagaaagcaaccaaccagaggctgaagtgaagttataaaggtcacactcctatgcaaacatcttgattggttgcggaaagtaaccaatcagaggctaaattgaagttacaaagttgtacttctatgcgaacgaagacttggccctgcaatcagtctggttggttgcaaccaatcagaggctgaagttacaaagttacgcttctctgcaaacatctgattggttgcagaaagcaactaatcaaaggtactttcaatttcccatctgcagggcagaaaaggtggaggtttgcaaaggaagtagacgctggtccttttgttacttaggcgtggcaagtgggggtttttccttcgatttagttctaggaagtcagggtgaatcagcctttggttccctgcctgcagaccctattttcctgcctcaagagcactgtccctcgggcatcagcagcctggcgggcatcactggcattttcttgtgcataaggtagtgactgagaattttctctctggactatgtcatgtccatactgacgcagggataaagaatttacagaaaaagcatgacctgggctttgagaaattttattttgtgtttcgaaagagttcattctttgactttttgttggttcctcaggctcaggaaggttctgctccattctattccaagaagttcttgctaccacttctgggagcaggatcccagaaggggagtgttttccagctgagaactttgtccagttggtgatttagtcggaagaagactggcttacttcatctttgccagagacccaaagactgtttagctgctgttttctaaataatatgtaatctcttttctttcttttttttttttttttttttttttctgagacagagtcgcactctgtcaaagaggctggagtgcagtgacgtgatcttggctcactgcaaccttcgcctcccaggttcaagcaattctcctgcctcagcctcccacatagctgtgattacaggcacccatcacgacacccagctaatttttgtactttagtagagacggggtttcgccatgttggccaggctggtctcaaactcctgacctcaggtgatccgcctgcctcagcctcccaaagcgctaggattacaggcgtgagccaccatgcccagcctagctgctgttttctaaataacctataatctcttttcaaaaagtcaaatttgtacctcaatttttccctagtgaaattttccaactgggcagtcactttaaaacattgctaggtttctttctctgcagttacgttctgtgttaatttcccatagaaaaaagaccgtttttctcatcaacgtttcctctttacctgagccaaccttgtccatgtacatgtacaaattttatagaattttgatcatagcatgggtatatattcatattctgcctttctcacttaatattatgattcttattattaccataagcattttcctatattggtaatattcttcacaatttttatttctggccagagaattgaagtttgcagtttaaattgatggatggtgggagcaaagaatgtttgatgttttctgtaatactaaaagtcaatcagaatacatctacattccacatagatccctttcacccaccgcttcccaggtatttcttacaaatgctgtgatctgccacatctaacaagttacttgcaaagcaggaatggtgctcggagcactctccctgtgttttgaagtctgattattgctcagatgcaatcattctgtggctgaggcttacaggaagggcccggtcaatagtgatgatgcatttactgacagtcactcagtcgaggggagtcggggtgccttaactgtctgcatacttcaggccttaatccagtggaatccagaaacattagtagggtgcagtaagttctgctagttgcaagagacagcaactcacactgtcacaggaaaagggaggaagcccttgggaataatgcaacaggcattccagctatatgccacacagccctgctcctggatcacagggagagccgccaagctggccccaggaacagcggagccagagtctcacccagcccaggagtgacaggcacctgaccgcaccagctcccacctgcttccccttcctgaagttttatttatttgtgcatttccttgttgcttatctctgggtctcattagagtgacagctccatgaggatagggctttgcattgtggctctctgcccagtgcctggcacacaacaggtgggacatagtgaatgactgaaggagtcaatggacccaaattcccgccactcccactgagtcctcagcagcggagttcaccaagggttgcactggtgactctcagagctttgtccctggtccaggtctcactcctgagtgccagcttgcatatctgactgccgcctggactttcccactgggatggctggtgggcacccacctgatgtgtccggcagaagccgtcttcttactgcctgccttcttttggcgggtagcatcacctcccaccttactgctcatgttctgagctttttgtttttcttgagatggggtcttgctctatcacctgggctcaagtgcaatggtgtgatctccgcacactgcaacctctgccttctgggttcaagcgattctcgtgcctcagcctcccaagtagctgggattacaggcgtgcgccaccacacctggctaatttttgtatttttagtagagatgagttttcaccatgttggccgggctggtctcgaactcctgacctcagatgatccgcccccctcagcctccaaaagtgctgggattacaggcgtgagcaccatgcctggcctgtgttctgagcattttgtcaccaactctggccatccaacctctaggatgtctcaattccagccacttgccttcacccaaactcctgccctacagtctgcagttcacggtggcatgagtctaagtgcttacagggcggccagactcttcctggctaatcgccaccgacccctctggattaacctgttgagacgccacttcctgacagagaggtcttcctggcctccccagctggtttaggggacccttcccatgcacacacacaccctggccggggaccctgccattcacttcatcataattccttggtaactgtttggccgagagactggttcagtgcggttttgtccctatttcctttatatccaccccagtgcctgccatgtggcagaaactccataaatattgctaaatgaatgcagaaattaatgaatcaaattatttcttcaaaatgctgagtgtttttttggtctcaggctcctactgttcccactgaaccaccctcccgaggttgaagcttcccagtgagggcgagcactgcagagcactaagacaagtcaattgcaggagaacagaatgtatcttttattgagttgtagcagtttaatagctgtctgaactctcattttactttgttgtcattctataaagatttacatgcctgcatggacatttatacagcacttagcattcggagttgcccaaaccagcacatgtgcatctgaggacttcggctctggggccggcccttggtgtctgggatctgtgtttggtttaccagacgtcccgccggcgccccaagcccagcacacagggtaggatctccctccaccccagcttatcccccaccatccccacccgccccacttctcccttggtgttctggctcctccctcttcttcatcttccaccttctataatttccttcacattaaagacacaaaggccaggcatggtggttcacgcctgtaaccccagcactttgggaggccgaagcaggcagatcacctgagatcacgactttgcaactagcctggccacatggtgaaacctcgtctctactaaaaaaatacaagacattaggtgggcgtggtggtgggcacctgtaatcccagctacttgggaggctgtggcaggacagtcggttgaacccaagaggtggaggttgcagtgagccgagattgtactactgcactccagcctgggtgacagagcaagactgtctaaaaaataaataaaattaaaaaaaaaagacaccaaataagcatttagcaatacagtagcattgaaccctcatggtcctcatgtacctctgagtaggtttggtagttcataccttggtgtttgttcttttcatttgccaccagatcgcttcttatttcttagtcagtttcgcgagtactatcagacttgtcttcctgggtattactcgggtcaatgcctgagaccccagcacccctcatgccccacaccacacccccagggcatcaagaaccaggctgagccccagggatacaacagccagctcagttcctgccctcagactatagaggctggtgggaatatgggcattaaaaagtaattgcgaccgggtgcagtggctcacacctgtaatcccagcactttgggaggctgaggtagctgaattacctgaattacttgagcccaggggttgaagaccagcctgggcaacacggtaaaaccccgtctctacaaaagatacaaaagttagctgggcatggtggcgttcgcctgtagtcccagctgctcaggaggctgcggtgggtggatcacctgagcccaggagatcaaggctgcagtgagccaagatcacgccactgcacttcagcctgggtgacagagtgggaccctgtcaaattaaaaaaaaaaaaaaattagaaaaaagaagaagaaaaagtaattgcacaaataactgaattttaggtgcgataagcaaagcccactgggcaatgagagtatagaataaggtgaatcaagcaggacagaggcagctgccctcaggtggcaccaactggggccaggagaagaagccacaggaagcagttttctgaccagagaaagcagcagcagggaggagctgggacaggaaggagaccagcaggtggggagaatgtcgggtcaatggggcttagtgagcagaagaggaaaaggacccagcagcagccaagccctgcagcagccagacggagacactgaagtagtcagaggggctgtgaataatgactctggggatcgggcgcagtggcttactcctataatcactgtactttgggaggctgaggcaggagaggtatttgaggccaggagttcgagaccagcctgggcaacatagcaaaaccccccatctctttaaaaaaaaaaaaaaaaaaaaagatgaacaagtaaaatatgcagcctctgtctctagttcaagaccagcctggcaacatagcaagaccctcccatctctttaagaaaaaaataaacaagtaaaataggcagcttctgtcccttactgtaatgaaatgagaaatgtctctgctcttaaaatgtaatgtgaccctctcaggtagctgggaatattctggaatgaccgcttctaacaggctcttgcatagctggaattttactgagttctaagcaaaattatgacagtatgcataattcgtcagtaattaaccttgtgtgggtgacttgctcttgcttcttgatacttttcatttttttttttttttacaatgagtatgtatttatttctacaatggtggagaacataaattagtaaaatattcaacttgcaatcttagtttctgaataggccttattaatgtattgcagataagaacttagtcaactagttgtagggtaaaacacaagtgtgacttctctgttccagaaacatcttagtaatgtttttgggggtttttgtttgttttttattttttagcagcggggtctctgttgcccaacctggagtgcactggtaccatcatagctcatttaaccgcctcctggctcaagtgatccccctgcctcagcctcctgagtagcaggaactacaggcacacgccaccacacctggctaatttttaaattttttgtagagatggggtcttgccatgttgccaaggctggtctcaaactcctaggctcaagcaatcctcccgcctcggcctcccaaagtgctgagattacaggcgtgagccaccacacccagcctagtaatggtgtattttaaagagttcctaggtagaagaaaaagactaggcactccagaacttctgtgctttggttgcaaagttcactggaagcatctctttgcaagttgtccttgcctctgtctgtgacctgctatcagaaccgtattttactgcttgctgagatgcagtttagttcctacagacacaaacccttcaaatataaaggcagtgcctggaagggtttattttaagatttaaatcttaggaagcacattaccagtgatataaaatattcattgactcatgaaacactgctagaagtcgctgtttcgtgactgactcgtctccctttatttccataggttaactggtctgcctttgtgaaaagtagatgtaggtttttcggaagtcctaaaagagagctggctggaaagagtgcatttgtaggccattccattttcagagcctgctcccaaatgcctgtgctctgaggtcctccccctgggagaggtttcattttggatgtaggaaaaccatctctcctggtgactatccttgtcggcctagcatctgagaatctagaaataaaatggaatgtcatcatttttgagaactgctttttaatgctcctccaggagaataaaatagcagtctggttcttggtgcctgctactttcaagtgaggacacattacaggttaaaattagaaaacactgttcttttatacttctttctccactgcctgcccctcactcaaagatcccacattaagactcctggaaaaaaagttgaagaaatcagcctggcgtggtgactcacgcctataatgccagcactttgggaggccgaggcaggcggatcacctgaggtcaggagttcaagaccagtgtgacaaacatggtgaaaccccgtctctactaaaaatagaaaaattggccgagcatggtggcgtgcacctataatctcagctactcgggatgctgagtcacgagaatcgcttgaacctgggaggcggaggtggcagtgagcctagatcatgccactgcactttagcctgggcaacagagtgagactctgtctcaaaaaaaaaaaaatgacaaaatcttatgatttcgttagaaatagcccctggttttcatgccaagaagttcatcaatgtgccacttggtagccttctcgaaggtgatagaaatgtggccattgcagcctgattctgtacggtgactccagtccacgtattccaggtctccaggtgttggcaaacaagacctgggacccagggcccctccggagagctccctgtaacttcagtagcaggagacatgcgggatccctttacaaatcctcagtttgccttcataaaacattttcattcatgtgattaagaagtaatcacaggccccaaacaaaacaggacagaaagaggaactgggtctggaagaataaagccctgtgggtggcggataatgtgctgactcctgtccaggatacaggtccctggccctaagctggtcctgaaacagcctcgggggacgaggctgtatgctctgtcccagttacactcaggctccggcattagggaaattggaaaccaggcatggaagcagcgtccctaccttcctcggccaggttcataaacctggggctcaatccgcctctccatgtaggacactgtatgtttgcaggctgaggaattggccaccactgttctaaagacaagcaggcatgacaagatgggcgttaggcctgttgccgccaggttttgccggctgccgtccttcccaaggctttcccttctccatccatcctcccccggtccctcgacacagcactagagtgagaacaccctggatgtgacttggggactcctcctcggtgtgcttgcgtggagagtggagaggtgcgtcgtttgtgccccgctttgccatgaccggggtggtcctggcacgccgggtatctagacagcttttcatcagtcgctcatcagcatgctaattgccgtatgactaattatgccctgaattccagttgattttcttaatgagacagctgggttaattatgtaatcgtatgattacattagcctagagtgccctggcgaaaagtagcgtctgccgcattgtgatgtcatcgcggggacggtgctcacaagggggacattcatcctcaggctggtggcaggggacagcccccatcgcccgcagagcgcactgtgcaaacatgagcctcatgtctattaagattggctttttcagccctcacaacctacaagaaaagcagttcaccaccagcagtctcctcgccaccctgcgccctctccacgcccccagccgaatccaaaagccgcctgcaggcctctgcagctcttctgagatccagccatgtgtcctttcttctcacaggacctctctgcaccgaggctgttgggctttatcagggcacaccagcacttccttcagagtgatccgaagaactcaaagcaaaatgtttgcattaaagtcccagagcgacttagttgacgataacatataaacaagccctagactggccccgaccttagatcccactgcgcacgccagatatgctgtttcattccttctttctgcccaatctctaacacacatcatatttactaggaaaatacatgaccgataccttctggtttctggccacttcgctactccccatcacagcagaactcccctgggaggtgactgcctgctgaatcacttcttcacctatttacactcttcctccttagacttttgtggccttctcctcttcctctgccagggctctaaatgttggagtatgccaggacgttattcttagccttttccttttcatttgcattccctccctatctaaaactccacatgaccaaaagagaatgatcatttccccccacgtgctcccaagatagtcagtgacatcaccattcacgcaggtgctttggccactgatatggtttggctctgtgtccccacccaaatctcacctcaaattgtaatctccacatgtcgagggaggtgattggatcatgggggcagtttccccgtggctgttttcatgatagtgagtgagttctcacgagatccgatggttttataagtgtttggcagttccaccttcgctcatctctctcctgccactttgtgaagaaggtgcttgcttctccttcaccttccgccacaactgtttcctgaggcctccccagccatgtggaactgtgattccattaaacccctttgctttataaattacgcagtctcaggtatttcttttttgttttttttgagatggagtctcaccatcgcccaagctggagtgcagtggcataatcttggctcgctgcaacctcctcctcctgggttcaagcgattctcctccctcagcctccctgggattacaggcgcctgccaccatgcccaattaatttttgtatttctagtagagacagagtttcaccgtgttggccaagctgatctcgatctcctgacctcgggtgatgcgtccgcctccgcctcccaaagtgttgggattagaggcatgagccaccatgcctggcccaggtatttctttatagcagtgtgaaaatggactcatacagccataatgcacaactcagcctgggttcccttctttctttcacacccaatagccaggctgtcagtaagtcctagtgagccagcagcctccagaatgtatcccagattcgcccacttacccttcagccactgtcacctagtccaagccaccagtctctgtcacctcactgcactcacacctccacctaacgtcctttgcacagcaggcagacgggtctacgtcagtggtctccaaactacttttgcttatgcaccccaagagtaaaaaagtttgaattgggccaggcacggtggctcacgcctgtaatcccaccactttgggaggctgagggcaggcggatcacctgaggtcaggagttcgagaccagcctggccaacatggtgaaaccccgtctctactaaaaatacaaaaattagctggtgtaatggcaggcgcctgtaatcccagctactcaggaggctgacgcaggagaattacttgaacccaggaggtacagtgagccaagatcgcgccactgcactccagcctgggcaacagagcgagactgtctaaaaataaatacatacataaacacatacaatgaaatgcgctcatttcaagtgtgcagtgtgatagcgtggccaccttcacagtcaagatgtagaacatttctatcacctcaaaagttcccttctgatcccagtacccagcaactgctgttctgctctttgtcacttctggagttgtatagaagtggaatcatttggtctgtggtcctacatctggcctctttcactcagcgcggtgttttgggattcatctaagttactggtgtcattagtcctttcctttttattgatgaatgatattccactgtgtggatatataccaatttgtttatccaacagttatgttgacagacatttggttggttgtgggtattatgaatcagtctataaacattcatggagaagttgttacataggtatatgtttttatttcccttaggcaaatacttaggatgagggtcagggaacctgtacattttacctgataagaaatgccaagctgcttttcaatgtagatgtatctttttttattaatttttttcattttcttttcctcaggatagcaaagttacagttgtattattttatcccctcataagaaattgagaggagttccagttgctccatgtcttctgtttcatcggttattttctaattttagacattcctagtgaatgcgtaatgtatttcacaacgattttagtttgcattttcctgatgattaatgatgcagaatattttttcatgtgcatttttgctttcatagatttttatttataaaggtttcaatcccttgcacatttgaattttggagacagggtcttgctctgttgcccaggctggagtgtagtgatatagtcatagctcactacagcctcagtcttccaggctcaagcgatcctcccacctcagtctctcgagtagctgggactacaggcatgtgccaccacacccgattaattttttgttttttctagacatgaggtctagctgtgttgcccagactggtctcaaactcctgggctcaagcagtcctcccaccttggcctcacgaagtgctgggattatgggcatgagccaccgtgcctggcttctgtatacgttttagattcagcttgtcagtttttacaaaggagttttctgtgattttgattaggattccactgtatttgtagatcaatttgaggaaaattgacaacactatttattcttccataatatatttatttagttcatctttaatttctctgagcagtattttacagttttgatgtataaacctggcacagattatgttcagtttatttctaagtttaagtcatgtttttgaatgttatattaaaggatattttcttttttaaaaaatctacaatgtttattttattattattatttttaatctcgcttcatcaccaaggctggagtaaagtgacgcgatctcagctcagtgcaaccaccgcctcccagattcaagcaattctcctgtctcagcctcccaaatagctgggactacaggtgcctgccaccacacccagctaatttttgtatttttagtagagacagagtttcaccatgttggccaggctggtcccaaactcctgacttcaagtgatctgcccacctcagcctcccaaagtgctaggattacaggtgcgagattaaagtttattttcttttgaaatttgttttccaattgtttgttgcttttatacagaaatataatgaatttcatatattatataatttttacattttaacaaataataaaatatataaatatatattttatattatgtaatgtttatataataataatataggtgacctcttaatgctcacctattagctctagaaatttttttgaagttttcttgaattgtccatatgcccttgaagacaatatatacttttttcttttttttttttttgagacagagtctcgctctgtcaccctggctggagtgcagtggcacaatcttggctcagtgcaacctccgccttctgggtttaagcaattccctgcctcagcctcccaagtagctgggattacaggtgcccgccaccacgcctggctaatttttttggatttttagtggagacggggtttcagcatcttggccaggctggtcttgaactcctgacctcgtgatctacccgccttggcctcccaaagtactgggattacaggtgtgagccaacgcacccggccacaatatatactttattgatgttggatggaatgttctgtaaacatcagttaggtcaagttggttgatagtgttgttcatgtttcctgtatccatcctgatttctgatctataatgctgtatatttattttccttgcttttttttttttttttttttttttggcacttgctacctgtataaaatgttgactagaagtagagaaagcagacatccttgccttggacccaacattagggaaaagcattcagactttgataattaagtataatatcaactgtagatttttttgtagttgccgtttataagatggaaattctctcctattcctagcttgcggagaatttttgtcataaatggtattgaattttctcatattgttttcggcatctttcgagatgatcatatgattttcctcctttattctcttaacatggtaaaataatttgattctcaaatgttaaacaaatcttgcattcctaggataaatcttacttagccatgcattttatgcataatatgcattttataatatattttgtgcattttaaaatttgctggattcaatttgctactgttttactgaggacttttgccgttaaatttatgaggaacgatatggtttggctgtgttcccatgctatctcatcttgaattgtagttcccataaaacccacatgtcgtgggagggaccagtgggaggtaattgaatcatgggggtggttatccccatgctgttcttgggatagtgagtgagttctcacaagatctgatggttttataaggagcttttcccgctttgcttgtcactccttcctgctgccatgtgaggaaggacatgtttgcttccccttctgccatgactgtaagtttcctgaggtctcctcagccacgctcaactgtgagtcaagtaaacctctttcctttacaaattacccagtctagggtatgtctttattagcagtatgagagcagactaatacagaaatatacaactatagttttctggtttttttcctttgaatatccatatagggttttcactttaaggttgcactggtcttgtaaaataagttagaaagtgctccccctttcctctatttgctgaaagagtttgtataagattgcagttattttttcgtaaaattcaattcatcagtgttgccatccaggcctggaattttctttatggcaagtttttaaattacaaattaacttctttaacagatgcaaggctattaagttttttaaatttcttcttgagtcagttttggtaatttggaatttttaaaggaatgatccatttcatctaaattatcaaatttgttggcataatattgtacataatattttattaacttttaaatatctgtaggatgtgtagtgatgtcctttcttatacttcctgacattagaatttgtgaatcctccccccgggcttttttccttgattagtctggctagaggcttatcaattttaaagttatttaaaaatagaaccagcttttgtttgcattgatttttctcttttttttttttttccttgttttcagttttgttgctttctgttcttattagctactttctacttactttgggtttaatttgctcttctttatgagttttactaagtgggcattgttttatttcattgtggtcagagtacatgtttgtatgatttctgttcttttgaatttatcaaaagttgttttctcatcctgtacatcgatgaatgttccatgtgtacttaaagagaatgtgtattctgtagttgtttgaatggcatgttctagaaaagtgagctctgtttagttagtggtgttcttcaagtctcttatatccatattgactatataaaaatcataatattaattaatgtgaatggcttttttcgttgtttttttttttgagacagagtctcgctctgtcgcccagagttgagtgcagtgacacgactttggctcactgcaacctctgcctcccgggtttatgcaattctcctgaatgtggatggcgttttgaaatctaattattattttggatttttcttttttctttcagttctgtcagtttttgatttgcatagtttaaagctttgttttggggcaaatatacctttaagattattatatcgtctctcaattgtttgattcttttaagtttatacaatgaccttcattattcctggaaatattccatatcgtaaagtattctttttctgattttaatataagcactctggctttcttttgatgagagtttttatgttatatatttttctatacttttactattaacctgtctgtatctttatgtttaagttatgtaaatacctacatcttgcttttttatccatcctatctgcctcttaactggaatgttagatcatttacatttaatgcaattatggataaagttggattgaagtctaccatcttactttttctatttgtcttgcctgttttttcttgtatttttcctgcttttgattaactgatttttttaatgtttttatctccccaattatcttattagctataactcttattttcttaagggttactttaaagtgaaaagtaagccagccatgatggctcacacctgtaatcccagcactttgggaggccaaggcaggcagatcacctgaggtcagcagttttagaccagcctgaccaacatggagaaaccctatctctactaaaaatacaaaattagctgggcgtggtggcacatgcctgtaatcctagctactcaggaggctgaggcaggaaaatctctcgaacccgggagacaaaggttgcggcgagctgagttcgtgccgttgcattccagcctgggcaacaagagcaaaactccatctcaaaaaaaaagtgaaaagtaaccatctttaacttatcattttataccttcaaataatacaccatttcacatacaatataagaatcttataatacattgtcactttctcactcttgttcttttgtgcatttttactgattttacttctacctatactacaacgctataatacatggttactattttttctttaaaccattaacttttaaagaaattaaaaatgaaattataatattttatttttactcatctatttaccatttccagtgttgtttattcccttgcgtggattcaagtatgcacgtgaaatcattttcttttggtctatagatctccttttaacatttattatgatataggcacactggcaatgaattctgttagctttcattcatctggggaaaaaataccttaatctcacccttttttttttttttaagacagagtcttgctctgtcacccaggctggagtgcagtggtgcaatcttggctcactgcaacctccatctcccaggttcaagtgattctgctgactcagcctccccagtaactgggattacaggtgtgtgccaccatgcctggctaatttttgtatttttagtagagacggggtttctccatgttggccaggctggtttcaaactcctgacctcaggtgatctgcctgccttggcttcccaaagtgctgggattacaagcgtgagccaccgcgtccagccaccttcatttttaaagagtattttttgtcagatataaaatagtttcttgggtctgccagtcatggtggcttatgcctgtaatcccaacactttgggaggctgaggcgggcagatcgcttgaggtctggagctggagaccagcctggccaatatggttaaagccctgtctctactagaaaaacaagaattagctgggtgtgatggtgcacacctgtaatcccagctactcgggaggctgaggcaggagattctcttgaatccagtaagcagaggttgcagtgagctgagatcgtgccgctgcactccagcctgggtgacagagcaagactctatctcaaaagagaaataaaataaataaaatgaaatagtttgttggtggtttgggttctggttttttctctctctggactgactgtttctgagacaggcgatctccagtaattcatatatatttttttaacctatatacaattaatctttttctcttcaccatttaagattttccttttctaattttgatttcagaaactctcttacgcttactggtgttctttgggtttatcctgcatggagtttgtagagtttcttgaatttttaggtttatagcttttatgaagtttggaacattttgccactgtttcttcaaatacaccctttccctctttctgggaaatgtatgtttggttgcttaattttgtttcataggttgccgagggtttactaactttttttttcaatctttctgtgtatttctgtttggtttgtttctgtgactatatctttaaattcactgatctttttctttcactgtgtctaatctattgttcagccaatcaagtgaattttttccatttcacatactttaagcttcagaattcgatttgattctttatgttttctgttcctctctgtattgtattcatatttttctttaaatccttggacatgctgataatagatgttctagtctgcttcttccattatctcttgtcatttctggttctgtttttatgaagtgatttttcccctgatcatcctgctgctttgcatgtctagtaatttcctattgaattttagacatcatgagctttaactggattttgttgtcttatttaagtttgggcaggcagttaagttacttgcaggtcagtttgatcatcctgagacttgtttgtagctttttggagtggatatgggcaagccttgaagatgagtttagccctccactcaggtgggacacttccagtgtctttactcttcaacaagtccttgctcttcaacaagtgtgtcctctctggctggttgcagttggaaagtcctccagccctcaaactgtgggaggttttcagctcagactttcctttctattcttgcctggccttaggagtttcaccctgtgcataggcactttagctcttggcaaaagatcgcctctctgcagatttctgtagctcttgtccctccttttcacactctgccttgcaaattccaattgctgcagccacccaatcttgtgatgtgtgtccttcaatggacagggagaccatcacactccgcttgggtttttttcttcattgtgatgcaatccagagagttcttcctgccaggaagggtaacatagagctcatctcatttgcttcccttccttcagggaagtcttgttccaccagttgtccagcgtctgtaaatagttgtttcattgactttgcctagttttctagttgtttatgaccagagcacaagttgagtatcagtagatctgtcatggccagaagcagagactccaagttctgttaattttgatttttggttttcatggaaatggctggaaaaaataacttacaaagataaatagattcaaaccaaagaaacacattattggctatctttacaaaaataggattcatatttatgaaatctaggtataggttgagtgtcttttatccaaaatgcttggaatcagagtgttttggatttgggatttttgaattagggatattcagcttgtactaattatgagaaggtatttgttgaaactcagctagtcaattttcattttccatgataccgtttttttttttgtttttttgttttgttttgttttttttgagatggagtctcgctctgtcacccaggctggagtgcagtggcgcaatctcagctcactgcaagctccacctcccaggttcatgccattctcctgcctcagcctcccgagtagctgggactacaggagcccgccaccacgcccagctaatatttctgtattttcagtagaaacaaggtttcactgtgttagccaggacggtctcgatctcctgacctcatgatccaccacctcagcctcccaaagtgctgggattacaggcgtgagccaccgcaccccgcctctttttttttttttttcctagcttttcagaagatcctgcatttcttatattaattaacaaacgatttgaaacttcttttggcaaatgtttactcagatttgagttggtaaataatagtagataacatttattgagtgttaactctgtgtatggcaattttcttaagttaatcctcacggcagcaccatgacatatgcacagttagtatgcccaatttatgcatgaagaaactaaggcacagaggggttaagtaacttgtccaagattgcacaaccaataaatgagagagctgagacttgaacacatgcagcctggctcatactgcagaccattacactacactccctcttgtgtgatataaggcattgaaccatttttgtaaaaggtgctgtctttgcccatcagtatatagatgatggaaacatttccaaatattcacttttagaatgctgtcactgtagcataaaatagttattttcctcaacaagcattaaagcaccacatttattgcaacaacttagagtatgtgtttattttttcaaaagtatctgtcaagcggcatgttactgatatgatagccatttaccatcacaaaacagggcaggtaatttggatcccttagcttgctttttttttcttttctttttttctctctgttttgaggacagggtctcgctctgttgctgaggctggagtacagtggcatgatcatagttcactgcagcctctaactcctggcctcaagcaatcctcccacctcagcctccctagtaactgggactacaggtgtgttcccaccatgcccagctaattttttatcttttatttgctgagacgaggtcttgctatgctgccccagctggtcttgaactgctggcctcaagtgatcctcccacctcagcctcccaaagcactgggattacaggcacgcaccaccccacccggccaggatcacttagcttttctaaagaaaattatatagctcatctttaagcttaaaactcttacatgcttttgccaagagaaaaccaacaaaccattgtgtgggttgaagtactacagttttggtttggtttggtttggtttgaaatggagtcttgctctatcacccaggctggagtgtagtggtgtgacctcggctcactgcaacctccacctcccaggctcaagcaattctcctgcctcagcctcccaaatagctgggactacaggtacgtgccactacacccagctaatttttgtatttttcctggggacagagtttcaccgtattggccaggctggtctcaaactcctgacctcaggtgatccacctgccttggcctcccaaagtgctgggattacaggcgtgcgccatgccgtccatctctggccacttcttgacaggaaaagaattgcatccaaaatctgaccattggctcatttcagacattgtactttcagctctagcatttagtttgcttctttttatatcttctttttctctcctccttgcactcctatttttcttaaaatccttgtgcacaggctccctctcccagatctcttttcccttcctgttctgcctctccttccctgggaccacactggcttctcactatgccttgaccatgccctgttcacagctaccacgggacctttcactgggcgctgcctctgactggggtgaatccttgcgctgcctggcattaccatccagatcttcatccccactcacttcttcagaggccttccctgtccccttgtctctaggacccatttccctcactccctgtgcctctcctctccatgctcagcagcgcaaacgctcctcactcacagtggggctgtgccccagtcaacccatcacaagtggaaaatatcataagtcaaaaatatattcaatacccctaacctaccaaacatcataagttgaaaatatcatgagtcaaaaatgcatttaggccgggtgtggtggctcatgcctgtaatcccagcgcttggggaggccaaggtgagcagattgcttgaggccgggggttgaagaccagcctgggcaatggggtgtgaatccctatctatactaaaaatacaaaattatcctggcatggtcgtgtgcgcctgcaatctcagatacttgggaggctgaggcaggagaattgcttgaacacgggaggcagaggatgtagtgagccaagatagcgccactgcactcccgtctgggtgacacagtgagactccgtctcaaaaaaaaaaaaaaaaaaaagaaagaaagaaaagaaaaaaagagctccttttcccggtttctccaggagcgctcttccactcatctggtctcctgccttgcgtttgtcatttacatgcatggcttatctctgctatgaggctgagcctttcccagagcagctagttggttccgttgcttaggaaatatttgttaaattagtactgaaagagattttctttggctgctggttaagaaaacagaagcttttttttttttttttctgagacagggtctcactctgtccctcaggctggagtgagaccctatctctttaaaaaaaaaaaaaaaaaaagaaagtcatagctctctgcaacctccacctcccaggctcaagcaatcctcctaccttagcctcccaaggagctgggactacaggcatgcaccaccatgcccggctaatttttgtattttttccagagacagggtctcacttatgttgtccaggctggcctcaaactcctgggctcaaacaatgttccctcctcggcctcccaaagtgctgagattacaggtgtgagccactgtgcctggccagtaagcagaaatcatactgagaatttttcaaagtcgtttgcctggcgggcttctttcctttttctttccctccctgggtgagatgcatccaccccatacattgcagagcgggctccgccagcctctgactgtaatggctggaattaacgagataatattgcgtgcacttaggaaaaggtgctgaatatgtacagtattgttgtttgtaataattatgttccttgagccctgtgttgcataacaagctatataatacctccaagattgctttaggaattaagtatcagatgattgtaaaacactttacaagattgtcgcattgggtgggcggagctggcaggaaagcgtgttgaatcggaggaggaggaggctgggaagacaggggttaccggattttgtgtgttcctgttttatatatgggtgtgtcctcttcgcctcctccagacaattccctaattgagctgctaagatcggaggcatctgacgttcgcataagacctgacaatccttgtgtggggtttaaatggcattggaaatcattaacaagacaaaaagctattatttccgtagattaacacacaggttgggttttggcacgccaaaattcattgttttggtctttagcccaaacatgctagagtcattatattgtcatgcagtaattagctgttcctttaatacaagtaataaaaattaagcctaagaagttctttagcaatgcctcttacatatcccaaaacaatattcaaatgctgtaggcatttagccattcaactgtgctgtagtaaagtttggagtttaatgcacagagatgtttgaacatttagctcatcctttagtctgtgaccagctttgctacataggcattaacctttaatagtgtcagactaaatatacatgccatgatgaatgattatgagattgcctgaattttcatttacagtataaggctctgaaaattggtgtaaaggtctggttcctcctcacttgataatgtgcgtgtcattttcatatgtcaccggattccttgcttaaccgcatgggagaagctattttttaattcgaagcagatacagtggggtcctggccttttgaaaagaatgaactggaaatgttgacagaacttttagggagggcaggcagtatactaggtgtgttctttaaagatataatttgctggcacttgtgctagaaagcctacgtgagcaactcttaatagaattttatacgtgatcaaaggttcctctctttacctcctcttccctgacctctatgtcaagtttaaatcgtggttctgtacaaaggaggctgtgaacgggctgttcactttcttgaaaccatttgcccagcacaaggtcgtgaaggtggggaagaggggcaggctgagaaggtgaaggtatccagagaagttatggaaattttttttacaaacagcacctggaatcttttcaggaattctgtttttttgtgttatcacgactcctgcttacaaagaaccatctccccaagatagcatttttttttttttccaagacaggatttcgctctgttgccccggctggagtgcagtggctcaatcacagctcaatgcaacctcgacctcaagggctcaaggacttctcatgccttaagccccccagtagctgggactacaggggtatgccaccatgcctggctagttttttggtttgtgtttttgttttgtagagacaggctttcaccatgttgcccaggctggtctcgaactcctgagctcaagcaatccggccaccctcggcctcccaaagtgctgggattacaggcatgagccactgcagccggcctccaaaatagcttttggagtcaaatttaacataaatattttgatgctgattaaaataataatgaaaagccatgcaccagaaagagatgcaattataggctgtgtatacgtgcagagtaagtgcccagcagccagggattctgcatgatggactgtgttgctgtgaaaccccagcacccgggatctgctgacgttgagcccaacatatcccagcgcctgccttttgtaaactctgcaaagacgctggcatcctaaagagtccctggctcctgctggatacgttaaccgaggcatggtagacctggccctcgattccaggaacctagggtggtctgaaaaattaatgactctggcatttgaaaattaagtgagctcttgaatatatactcttgttgatccgctgggcatggtgtttggcattcttcgactggagactaaatctctgcagccatctcacaagtgacactggcgcccataccagaaatatattcaataatctttctaagccctgtggacttgggtattcttccactctgacggagcctgagaattccaaaggaagtatgccccaggtacccagcaggcggaatataattgcctcttaggcagcagaaagaaaactaaagatcacattgatgcggaagaacatttaaggtctctctatcctgtgttgaattcacagtaaaggcgagagccgtgagtttgtactgtaaattccaggtctgtgacttctgactttggattaaaatccagttttctggaagtgaatctgatggcagatatgaccttgaattggctgcaagaccccagcgctggcctggctgccgtgcagcgcgcgctgctctgcacttagttatcatcaggagtgtggtggcctcctggccagctggtctacgacagggccatgccgggtcaccagctgtgcctctgcaggggtctccagccttgggacctgcggccgctaacccctgactcttctgaacacccttcattagtgaaggaggatcgtaatggaaagtggtcatgtcatgaaatggggtggctttataaagcctaagtgtttctttcctctgcttcacctctgcttcattctttaccttgttgtaaagaatggtcactcagggctgggtggggtggctcacgcctgtaatcctttgggaggctgaggcggtcagatcccttgagtccagtttgagactggcctaggcaacataggaagaccctatctttaccaaaaaatacaaaaattagcccagcgtgcttgtgcatgcctgtagtcccagctacttgggaggctgaggtgggaggattgcttgagcccaggaggtggaggctgcagtgagccatgatcatgccactgcactccagcctgggcgacagagtgagaccctgtcttaaacaaacaaacaaacaaaaaagcatgatcacttggagttaacagacttaggtgtgcattctccatgccaaccaactagctgggtgacctcaggtgagtcattctgcttccctgggctttagtttctgaggcctctttctcgagattgttgtaaggctcaaaagacacaatctccataaagtgtcccgtgaactgtgtggcgttctcaggcatcaggtgtcacttccagcctcataatcactggacccttaaacatcccggcacctgtccacggacttgtccgtcctccacgtgcagctccggggatgtgattgacctcctggggctgctacctggtgtatttctctacttatctgatcaaagaatgaaaatcatgaaagtgtcacaccaggcaggagtaatcggcaaataccagtgaatctcatggctattgccaccccattttcacacctcgaggaccccgggctgggtccatcctttgtaaagcactggagaattctcccacccagcaagggggctggctgcaggggcatgactgtggcctctggggagcccccggagctgatgtcccaggagccccactctgagcctgtgtaccgccgtggagggggcctgtttgctggccgagtggggtgatggctgttttcctgttgtgcagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaaggttggtggaaaatgcgttctttgctttttcttttcttcttttttttctcttctttttattttaattggcttttcccatacttttgagaccagctctccttgtaatatacacgtcataaagtcagggtggggcaggaatctgagtcgttaaagagagatgataatcatgctgagctatttcgaagtaaaacttttcctctgcacaacaacgacgtaagattttattgccctctgatgagaccgatcaggattctttgaaaattcttcccgtatcattacgtgattgggtctgcctcttgaaaggcccatgcattgcctccaggcgacacctgtcagagagccagctcatgatcaaagggtcacacacagtaagtcatttaataattgctgtggatacattaaggcttcagacacatcttaaaggctgcatgcttaagccccgctgttgccttgtcagtatcgcctattcattaggaatttaatgaaagaaaacaacctcttggtgtgtttgcccagccgtcaacaagacagagagggcaaaggttgcctggcttttcccgtcagggaagaacaaaggaatctctcctttacctaaaatccagaggcactcaggatccaggagcctgttggcttccttggcttgaaggaaaatcacagctcccgtctgacagcagcagcagcaggcttttcagccagctccaaagaataattcggccagtttgttttggtttgggaatgtgagtacggaattaaattgaaaggggaggctgcccattcctagtggccttccattgaccatttgtagagacttcaataaagagttaattggggccacgtgcggtggttcacacctgtaatcccagcgctttgagaggccaaggtgggaggactgcttgaggccagaagttcgagaccagcctcggaaacgtagcaatactctgtctctacagaacatcagaaattagctgggcatggtggtgcacacccgtggtcccagccactcaagaggctgaggcgggaggatcgcttgaacccaggaggtcaagcctgcagtgagccatgattgtgacactgcactcagtctgagtgacagagcaagatccagtctttaacaacaacagaaaaagttaattggcaaagacttcttttttttttttttgagatggagtctcgctctgtcgcccaggctggagtgcagtgcacgatctcggctcactgcaagctctgcctcccgggttcacgccattctcctgcctcagcctcccgaatagctgggactacaggagcccgccaccacgcccaactaattttttttttttttttttttttttttttttttaagtagagacgggatttcaccgtgttagccaggatggtctcgatctcctgacctcatgatccacccccctcagcctcccaaagtgctgggattacaggcgtgagccaccgcacccagccaattggcaaagactttctaaaagtgtcctttggctttaaaaacactgcagatagaccagggaagaagaattgtccatgggaatgatccagaaagcatctgtgatgatgtgtgaagagccagaggtagaggcatgggctgtgagggcggcggtgcctaagacctccgagcacacctccctgtagtgtgggcatgggggtactcaagccctcaggccagcatagcttccttgctgaaatttgggggcacgaggtgacaggcagctggggaagccagaccccgcttctttctggctttgcagagagtggtgagcctttaggactagaagggacaactctgtcctgctagagagcgaggcattgggcttactagggctggaactgctgtgagggaaggtattaccttcccttgtaggaagcatttcttgccagaatcacgccagtattgcagtaaaaggtaacctgcaaatctgcacattgagttttcatagatacgctaccctaaaggggagtatcctggttttttttttttttccccttcattgtcctctggtatctaattttgatagatccactctctggtttgtttggtgagtgttttttatttatttatttattttagattcagggtctcgccctgtcacccaggctggagtgcagttgcatgatcatagctcactgcaacaaccttgacctcctggactcaagtagtcctcccgcctcagcctcctgagtagctgggactacaggcatgtgtaccaccgtgcccagcctctttctggcttattttatttttttgagtttgcttttgttttgttggagggtggtgcaggtggggcctggtgggctgtgcaggattgtccttcccttctccttctatcactggtgcctaaattaccagcttcccagtggccagggctttgcacaggggctgaccaggagccaagctgggtgtggatgttctctccccaaagatctcatccacactcaggagtggcttttcacaatgagttatagagcccaagatttaagaacagctccaggccaggtgcagcgactcacgcctataatcccagcacttaaggaggccaaggtgggcagatcacttgaggtcatgagttcgagaccagcctggccaacatgacgaaaccccatctgtactaaaaatacaaaaattacaggcatggttgggcacgcctgtaatcccagctactcagaagactgaggtggaagaatgacttgaacctgggaggtggaggttgcagtgagctaagatcacaccactgtactccagtctgggcaacagagcgagactccatctctaaaaaagaatggctctggaggcagacagacagacctggtttgagtccttttattgctaccacctagctatgtgaccttgggcaaattatctcactttgctaaaagcctctttctcttgggaggcaattctgatacttaccaggtagggttggtgtgagcttaaatatgcatatacacacagcatttggcactcaatagtacctgctacttattcagcagtgtggtttttgaaagaaatttaccctcctttatttggataacaagttttcccaagctccagaaaaatgtcatttcctctcccccacttccaagaataaaagtgattataatttgggaaggtgggcggtgcacatcacttcttgtaattatcacaccagtagtgtaaatgattaaaaagttagagcaggggccagcacaatggctcatgcctataatcctagcactttgggagaccaagtcgggaggatctcttgaggccaggagttcgagaccagcctggacaacataacaagacctatctcttaaaaaaagaaaaaaaaaaagatggtgtgagtccattgtgtgttgctgtaaagaaataccttagtctgggtaattgatgaagaaaagaggtttatttgcctcatggttctgcaggctgtatgagcacgatgccagcctctgcccagcttctgagggtcctcaggaagcttttactcatggcagaaggtgaaagaggatcaggcatgccacaggacaagagaggagggggcatcccagacgtcttaaccaaatctcagtgactcatcaccagagagaggccaccaagccattcatgagggattcgcccccatgacccagacacctcccacttggccccacttccaacactggagatcagatttcaacctgagatttggaggagacaaacatctaaactatatcaggtacataataaaagttagagcaaagagggaacttctgcctcatgggccacagccccacccatcccgcaatgatgagtaaatggaggccccaggtaatgccaagccctttagattcctctctgttatgctggccccgtcctcccctacacatgcctgggaggcctgctgagacacccagcatctgcccgggatacagcctgggccagaaggccagaggcgctaggataaagtggcctctggctgaggttgggctggtccgtgagcactcacccgggtccagggggtggcaaagagacctcatcaggcacagcacactgtcgaggtcacacactgtgatgtgtcactgaggagccccactggagcaagcgttagcgtccaagtgctgtacagccacttccagccggtccttaaaggcaaaaatgaggccaggcatggtggctcatgcctgtaatcccagcactttaggaggccgaggtgagcagatcatttgaggtcaggagttcgagaccagcctcgccaacatggtgaaaccccgtctctacttaaaaaatacaagaattagccaggtgtgatggcacacgcctgtaatcccagctcttcgggagactgaggcacgagaattgtgtgaacctgggaggcagaggttgcagtgggccgagattgcgccactgcactccagcctgggtgacagagcgagtatctgtctcaataaaaaaaaaaaaaaagacaaaaatgctgtatgtttacacgagagtgtagaccattgacgtagcagagcagttcaggctttttcagagctgacctgtctggagtccattctggaagtgtccagctcttgcctcactttggcctcgtccgtatggcttgagagagacgtatcaccaaccactgtgtgcacagagcatttcttccaggacctgaacagccaaaccaaaaggcggaaagttgcccagtcccctctgctgtgccctgatgggatcgttggtggaattccacctctctacggaaagcactctgggacacacctcatgaaaaaggccaacctcttaacaaaagagcctttcacacaaaaattagccaggtgtggtgcgcgcctgtaatctcagctactcgggaggctgaggcaggagaattgcttgaacccaggaagcagaggttacagtgagccaagactgcaccactgcatgtcagtctgggccactgagcgagactccgcctcaaaaaaaaaaaaaaaaaaaaaaagcctttagcttgtatgcactaagccgcgtgggtgttaatcgcccaggtgttttgctcctgctctggccagcgcatgtccgtgcagctcagggagcaggaatggatgtgagttacacacctggcaggtgcccttgctgcaccagagggagctccattgccacaagccctgtctgggcttcccccagctctgcccggcctcggctccttcagtcattcatgccacagtgctttcctgagcacacgtctgtttgccagcactgggaacacaaagaaaatgagcctcgcctgctaagaggtagatctgtagcagcgggcgacaattcctaagagctcccctctcttgggggctggggccacagtgcttttccacaaagcatccagcatgcggagtggcataggcgtatctggaggagggcgcacgtggagttgtcctgccccagagccacccacacacaaagcatccagcatgcggagtggcataggcgtatctggaggagggcgcaggtgtagttgtcctgccccagagccacccacaggtctgttccattcatcaaatccgctttgatattccccatttgggcagttgaggtgatgtctgtgaacctgcagttggtggtaccagagccgtctggacctgcgctttcccaagacagccctgcctcccaaggggcccctcgctgccccacatccttggtgctcacacctcactctaggactcctccaggccacatgccagtcaccggagcatcttcccccaggctacggcaccctctgctctgcacacagcccatgaccaccagagtggtgggcactccagggtgggtcccttccagcccactccctccatgctttatccacctagcaccacatgtttcttgtcacttgtgaaccagcagagctgcagggccaggcctgcttgcttgcttccttccttccttttctgtctccctctctttcttttgctctccgtttctctctctctctctctcactcactcactcactcactcactcacactctgtcacccaggttggagtacagtggcgcaatcatagctcactgcagcttcaaactcctgggttcaagacatccttccacctcagcctcccaagtccctaagctgggactgcaggtgtgtgctaccacgtccagctaattcttgccctttttgtagaggcggggctcgctgtgtttctggggttggtgtcaaactgctgggctcaagggatcctctcacgttggcctcctaaagttctgggattacagatgtgagccactgtgcttggcctgtagactttcatctttttttttttttaatttatttgtaatttgtgtgggtacatagtaggtgtctatatttataggctacatgagacgttttgatacaggcatgcaatgtgaaacatcacatcatagagaatggggtaccgtagactttcttgactccacttcgattgcttcttccaaaatgcacacactattatgaactattttttttctgagaaagtacttaaacccacctaaaactttattaatcatccctcagttacaggactaatttaagactcatcaataagatgatatgatattttaccattgatttccatctccccccacccttttttttctttaactggtactacagaaaccaaagctcttcttttcagcaaaatccattgatcctcctcagcctaaacgtttaaagttcaatttaacatttagggagtaaaaggtctctgaagggactcataaccattgattttgtgtcagagttgaagagctaaggtttaaaacacaccgatcctaccaggttatgagagccttgtacctacagccatatggaattgtatgcttctcttactgtaggtttttttttttcttttctgcagaggttacgataaaagcacttaaagagaaaatccgagaatatgaacagacactgaagaaccaagccgaaaccatagctcttgagaaggaacagaagttacagaatgactttgcagaaaaggagaggtgagcatgacttccaggcacacacagactgacatagcatttgcccctgaacttcacatcatcagacatgttgataaatggatctgcaaaataagcccaggttgtaaccccaaatctataaggggtaaaatgtttcaaaaatgatattctggctgggtgtggtggctcacgcctgtaatctcagcactttgggaggccgaggtgggtggatcatgaggtcaggagttcgagaccagcatgaccaacatggtgaaaccccgtctctactaaaaaatacaaaaaaaaattagccaggcatggtggcgcacgtctgtaatcccagctacttaggctgaggcaggagactcacttgaacccgggaggcagaggttgcagtgagccgagatcgcgccactgcactccagcctgggcaacagagtgagactccatctccaaaaaaagatattctacatttgtgaggtttccttgagcgaaatgcatctgtctttcccaatcggtggatggtgtcaggcagccagtgggcccaagactatccaagccgtgcaggtgcagaggtgaagctcaaggcatgagtcgttagcaaggcggcacctggcagctggacctgggctgagaccagagaggaaagcccatttcccagtgtgtgtcctctggggacaagccctgggctagtgctaaactctttctgccttctcaagcaaattgatatttaatattacacacacacacacacacacacacacacacacacacacagactctctgatgtatttaatattacacacacgcgcacacacacaatctcagtgggttttttggtattgcctctttcattacctcacatatcagggagttagtatcagtaaaatatgttaatgccctatgtaactgatgtgagttttagatttctaatgacttacattaccaaaaacgtttcccacaaataatgagttggttttcccctagtgtgatgagttaatgaaagttagattccttgtaacaacaataaggactattgagcttacggatcccaaccatatagatctttttttttttttttttttttttttaagacagagtttcactctcattgcccaggctggagtgcaatggcgcaatctcggctcactgcaacctccgcctcctgggttcaagtgattctcctgcctcagcctcccaagaagctgggattacaggcatgcgccaccacgcctggctgacttttgtatttttagtagagttggggtttcaccatgttggccaggctggtcttgaactcctgacctcaggtgatccacccacctcagcctttcaaagtgctgagattacaggtgtgagccaccacggctggcctagattggatttttttaaactcatgggttaaattaaggtattaagttttatacccgctcccatcaagtaaaagaaaagcaaaaaagggaaaaaaaagatactgaattttaactctagtatgaagaaatgtatgtatccatcaacaggaagcactaaatttatgactacaggtaaggggccaagtgggactgtggctggtgtgggattttgttgttttattttcagttgacttcctatgctgaatacttggtgaacttttcttttttcttttttttttttttttttttttttttgagatggagtctcactctgtcacccaggcttgagtgcagtgtcgcaatcttggctcactgcaacctccgcctcccaggttcaagtgattctcctgcctcagcctcctgagaagctgggactacaggtgtgcacgccaccacgcccagctaatttttgcatttttagtagagacggggtttcactatgtcggccaggatggtctcgatctcttgaccttgtgatctgcccgcctcggcctcccaaagtgctgggattacaggcgtgagccaccgcacccggctcttggtgaatttttctaaggtgggctctgtaacaatatcattgggttaggaggtggggcttagacactggaccaaattgaagactagctaaaacagggcctggagagaagcagctttctataaaacatgcccaccagtgtgccacatcagtttaccattgccttggcaacacccaggagttaccacccctttccacagcaatgatctcacagcccaaaaggtactacccattccctagaaatttctgtataaactgcctcttaatctgagtacagattatgagtacaaaatatgagtacaaaactgtcctcagctgctactggcagcacacggcctatggggcagtcctacctcacgagaccagtcacagagctgtaacgctgccacctccataaagctgccttcttcagccctaccaccagctcgcctttgaattccctcctggctgaagcccagagcccttgccagctaagccctcctttggggctcgcctgccctgcagcatcatgaaggcctctgaggaatgccattaagctgacttcattcaaaaagaaaactggctgggcacagtggctcacatctgtaatcccagcactttgagaggctgaggcaggaggatcccttgaactcaggagttcgagaccagcctgggcaatatagagatatgccatctctatggcatgaatgaatgtatgaatgcgccatgcatgtcagcatgtgcctatagtctcagctacttgggaggctgaggcaggaggattacttgaggtcaggagttccaggctgcagtgagctatgatcaggccactgcaatccaacatgggtaacagagcaagaccttgtctcaaaaaagaaaagaaaagaaaagaggctgggcgcagtggctcacacctgtaatcccagcactttgggagggtgaggtgggtggatcacttgaggtcaggagttcaagaccagcctgaccaagatggtgaaaccccatctctactgaaaaaatacaaaataagccaggcgtggtggcacatgcctgtaatcccagctactcgggaggctgaggcaggagaattgcttgaacccaggaagcaaaggtttgcagtaagccgagatcacaccattgcattctagcctgggcaacaagagcaaaactctgtctccaaataaaaaataaataaaagaaaagagaactgccagctcccgcccacccggggccctccctgcatcagaacttggccgtaggctttcagtacattctctcactaattgcccagaatggatctgcaatgtagaccatctcttttcatagagggagaaagcaggtcgtgggtgaggtacctcctacagcttttgcggctaatcagggccagaggtgggactttgcaactccagactggcacctgcccatctctgcagcccttgcctccccgtctgctccattgtggccacctggagccctggttgccggaccaaggccagtcccttggggccacgcccaactctgcaggtggaggccgcatccatcgtccctgggggagcgcggcagggcacagactccaggaaaggagtgcgcatcacagagtcaaggctcggacagatgggcagacccttgaccccgttgatacggatttggtcctaagtaaatgccttttaggaaagcactcctcaccagtgagtgatcaagggggaaaacgcgagcaatctcagtgccctgccatggagaaatgggttagtaaaaagaacggaccatccctaactgggatgttatgtcaccgttaaaatattaataatagttatggagaattcatagtaacatgagaaacgtacctaatataatatgaagtcaaaacatgcaccgtacaaaattatttacagtgcagtatgattgtacatcttcctacagcaaactcatgcattaccacaatgtggaaataaacacatatgggaattaaatattattaagttgacttttcttgttttttgagacagagtcttgctctgtcacccaggctggaatgcagtctcacaatctcagctcactgcaaccctccgctccaggttgaagtgattctcctgcttcagcctcctgagtagctgggattacaggtgtgtgccaccaagcctggctaatttttcagtagagataggttttctccatgttgctcaggctggtttcaaactcctgacttcaggttatctgcccgcctcacctcctgatgtgctaggattacagacataagtcactgtgcccagctcttgacttttcaaattaggtaaagggattagctatattaaaatatacaataactgattcttagagggaagggctgaagctagaatttacttcattcattttgtgtgtgtgtgtgtgtgtgtgtgtgtgtgtgtgttttgagacaaagtctctctgtcacctaggctgcagtgcagtgacacgatctcagctcactgcaacctccacctcctgggttcaagcaattctcctgcttcagcctcccaaatagctggggttacaggtgcccaacatcacacccagctaatttttatatttttagtagaacaggatttcaccatgttggccatgctggtcttgaactcctgaccacaagtgacctgcccaccttagcttcccaaactgctgggattacaggcgtcattctttataacaaaaaattgttgatggatctaggatttaaatattataattttttgtcacaaacatactggaagaaaactggggtgcatatttgtttttattaatatgactatataaaacttaaaacagattctcaaaaacaaataataacattttaaaaacatcaacaaactgaagaaatatttgtaccatgtaagacaaaaggctaattttctttatatacaaagaggacttctaaattaataagaacaaaatccgctctacaaaaataggcaaaggagataagtaggcatgtcatacaaagagaaataacatagctttactcagcagtaaaaatttaaatttgattttatcttgtgttggcagagtatacgaaaacacacttacatattgttggtgggagtttaaattggtgaaagttttttgttgggaagtttttcactatctatcaaaacaagaaaagtggccaggcgaggtggctcatgcctgcaatttcagcactttgggaggctaaggcaggcggatcacttgaggccaggagttcgagaccagcctggccaacatggtgaaaccccatctctactaaaaatacaaaaaacagccagacttggtggtgcacacctgtaattccagcttcttgggaggctaaggtatgagaattgctcgaaccctggagcagatgttgcagtcagccgagatcatgccattgctctccagcctgggtgacagaacaagaccctgtctccaaaaaaaaaaaaagaaaaaagaaaaaattgcagatactctttggccattgtaattcctctgttagcatttcatctccaacagattcactctcaaaattatacagcagtatctccacaatgatcgttgagggactgttcagtagaaagaaacctagaaacaatctgagtgtccacagaggcttaagttaattatttaataagaatgagggagaactatgtttgctggaatagaacatttccaaaatacagagaaaagtgaataagggaccccagaatgtggtgcacgttgtgatcacctttgtattaaaagaacagggcagggagattatattatactatactatattaaacacttctatttcagtagcctatttcatattcatattacactatagtatattacattacttcattattacactatagtatcctgcatattagttcgtactatgctatagtatatttcattcatattttgctatactatgtgacatattaatttatattgtgctatagtgtgttacatattcacattatgttatagcatgttacatattagttcatattaagccgtagtatattacattagttcacattccactataatgttacatattaattcatattatgctatagcatgttacatattagtttgtattacactatagcttgttacgtgttagttcatgttacgctctagtgtgttacgcattcgttcatattacgctgtagtgtgttatgtattagttcatattaccctataacgtgttacatagtagtttatgttacactatagtgtgttacgtattagttcatattatgctatagcttattacatattagttcatagtacactatcatttgttatgcattaatttctattatgctatagtgtgttatgtgtttgcttatattacactataggctgttacatatcatatgttacatattcatattttgctatagtatgttacatatttgtttatattacactttagactgttacatatgatgtcgtatttctgtacatgcagaaacattttagaaaaatacaaatgaactccatctgaggagcggaaatgagccaaggaatagtaagactctttcacttcccatgctcttgtcatatttgattacatccctgagtgtccataattgaaatacatgaaaatattaacagtgcttttctagaggtgatgagaattgggttgactttgtaaactgtgtcatttctacttttctgtatcccagtttattattatgagagcatatgttaaattcatatgatataaaaataatcaacttatttttggaggggtttttttttttcccccagattaagaggaaggaatgctatttattgaccagggaattcacttagagatcctgggaaatctgaatctgtggaatgcagttgcgagcattcacaatgtccccattaggtattgcagttgcgtttgcattccattataacagagacggaacagctgccacatctatttagtgcatcctttattccaacaaactccttcattgtgtcagcagaatgtaaatggatcattcttcttgcgctaacttcagaaaacaatgagtgcatgatgatgatttttttttttctttttaaaatctggcatttcaagaacaaattacatttaggataaccttctacgccagttaccacccatcaagccccacgggttgcacacttgccgtgatgtgacacgcagttacaaagttggggtgtggaagctgcgggagcggggcccacggcacacgtgtcgttgcgggcgataccccgtggtgcgcctgccgccagctgagcgcagggagggagctgagctcagccgaaaggcacacgtgcatttcagttggtaaaggagatgaccaatttggcttcgtcctcttcctttgcagaaagctgcaggagacacagatgtccaccacctcaaagctggaggaagctgagcataaggttcagagcctacaaacaggtttgatactctccttcctagtaccatggatgtggggaggacccagggggagagttgggtcagcccctgaccgccccggtccccgcggatacctgttgctcttcggggccgtgggagctgccgggagcccacgctgaagaattccgcagcacgcccgccagctgctgcgcctcattcctcactgactttgagttgttaatgtagaggtgggaggatctcgattccattttcatcccttccacacgccatccttgcttcctgctctttttccaacaaacacttctaaatcaccaaactgtcaaggactgacatttcatttggaacaataatagaaaaaaaaaaaaaaactcacttctaccctaagtgaagttaaggagaacagtaatttcagacctttaaaatttaaaagccaccaaaaaaggttatgctcaagtttttacagtatctttaaacttctttctctctctctttttttttttttttttgagacggagtctcgctctgtcacccaggctggagtgcagtggcacgatcttgactcactgcaagctccgcctcctgggttaatgccattctcctgcctcagcctcccgagtagctggggctacaggcgcccaccaccatgcctggctgattttttgtatttttagtagagacgaggtttcatcatgttagccaggatggtctcgatctcttgacctcatgatccgcccacctcaggctcccaaagtgctgggattacaggcgtgagccaccgcgcccagccctctctctatttctttttttgttttgttttgtttttgttttttttttgagacagggtcttgctctgtcacccaggctggggtgcagtggtgtgatctcaggtcactgaaacctttacctctgtgggctcaagcaatcctcccacctcagcctccccagtaggtcggattacagatgcccgccataatacccgcctaatttttgtgtttttagtagagatgaggtttcaccacattggccagtccggtctgtatctcctgagctcaagtgagccaccacacccagcctctcttttttatttctgaaagagaagcatcaccatgtatttcatttaaatgtatttttaaatttttattattttttttgatgacccagaactgagcagattatttaaatgtagacagacatcagaagtcataattcaacttaaaacacaaatgacgagagtgggagaaaataatcaccacaaatttgacaaacggataattaaaaaatgtaaaggctgtaaatcaatccattaaaggagagaaacagtgcagtcgaacaataagcaagggatatgaacagtcagttcacagaagaaatgcaaatggaaactacacatatgaaaaaatgcaaagttttttttacagtcagggagatgcagattcaattagtgaaagactgttttgcctgtcagactgacagcattttttaattatttatttatttatttttgagacggagtcttgctctgttgcccaggctggagtgaagtggcacaatctcggctcactgcaacctctgctccccgggttcaagtgattcttctgccccaggttcaagtgattttcctgcctcagcctcccgagtagctggcgttacaggcgcatgccaccatgcccggttaatttttgtatttttacgaggtttcgccatgttggccaagctggtctcgaactcctgacctcaagtgatccacctgcctcagcctccgaaagtgctaggattacaggcatgagccactgcacccagcctaattttttatttcattttagagacatggtctctctctgtcgctcaggttggagagcagtgatacaatcatagctcattgcagcctcaaactcctgggctgaagtgatcctcctgcctcagcctcccaagtagctgggactgcaggcaaacaccaccacacatggctactttttttttcattatttcttttatggacatggagtctcactgtgttgcccaggctggtcttgaagttctggcctccagtgatcctcccacctcagtgtcccaaaatgctgggggattacaggtgtgggctaccgcacctggcctttaaaaaaaatatagcaattctggcctgacaaagacttgtcaaaaattattgaaacatccagtgttggtgacggtgaagtggcacttatggaatggatgggcatggaaggagcctcttgggaggccagctgggtggcatttatgtaaagctccagtgcccaagctgttcagccagcagcttcacttccaggtatcctgatgagagaactgaaggttattgccactgcctgggtccacatgtggaaggactcccataccatactgcccagggaaaaaggctagtctcaagaaatattcataccgtcccatttatgggggtagaaaataaaaaaagatatatacacacacatatatacatgcaattatgtatggaaaattttttcttaacgtaaaatacactttcttttattttgttacacttttttgaaatgagtctcgctctgtcacccaggcctggagtgcagtggcatgatctcggctcactgcaacctgcatctccagggttcaagtgattctcctgccttatcctcccaagtagccgggattacaggctatgcgccaccatgcttggctaatttttgtatttttagtagagacagagtttcgccattttggccaggctggtctcaaactcctgacctcaggtgatctgcccgtgtcagcctcccaaagtgtgagccacctcgcccaaccagaaataataaaatacaccttaaaacatgaaatcatccaggtacagtggcccacacctgtaatcccagccctttgggaggccaaggtgggaggatgacttcaggccaggagttccagaccagcctgggcgacatagcaaaaccctgtctctacaacagtgttttaaaatattagccaagcgtagtggcttgcacctgtagtcccagctacttgggaggctgaggcaagaggatggcttgagcccaggagttaaaggttgcagtaagctgtgattgtgccattatactccagcctgggtgacagagtgagaaaacttgtctcttaaaaatggaagggaaagaaagaaagaaggaagggagagtgggaaagaagaaaggaagggagggagggagggaggaaactattaacattggttctgtctttgtaggtgcttgggattagatgaggcagaaatgaagggggatttcctattccattttttgtattttcatcatcttggcctcttttgtgtgtttttaatctttatttttccacgcacctcgctcctcacagaaatctttgcctcttttgaaatgggaatagattacctgtgtatgcattcttttaaaatttcatttaaatagttagtaattctttgcctttcagccctggaaaaaactcgaacagaattatttgacctgaaaaccaaatacgatgaagaaactactgcaaagtaagtctctctgcttggcctcccttatccgtacacatttctcacctgattttgcttgagtagggcaggatcgagaaggttcttgacctctgtgctgctgcagggacacagtgtatttcccatgagttacttgcgtcggttcaatgcacgttctagcactcactgggtaatccttccaacaaacttctttccttctttattgtgaaggctggtcactgctatgccttctgccatgaaaatttgggagttagtttatataagatgtgacacatgggacattttttgtgtggagttgagtctgggtaaatcacatgtctttttcgctgggccacagttcttcatttctcccagggccctttaggaaggcctgccccagaataagcacattcccacgcaggcataggggttcatgtcacacctaacaacgctaggtgtggatatacggatagacacagattcgggcaggcagagtcacaaaaggccaattcctacccagctcttgtccaaaggaaattagaggtgtccactacaagtgtactttttacccgcccatctttcatgcagaacaccagcaaggaagaaataataattgacataaatcatgaaaagatgaagaaatggcagaaattgctcctagccattgcctcctctaccaaactcccggggagcaatgccaggctagagtttgaaccactttttcctgttctggaaggctcttcccatcttccgcggaaacacacacgcgtgcttactgccatgtctcttgggtttccctattccagttacaaaggtccccgcactctgctcacacagtgcctccgtgggcatcggcaagaagacgggtacttctgaatggcgccgctgtcccaccaggctccacctctgtatggggtgccggcacttactgtccctctgccccatctcacgtgaccttgggctttgagggtgctgctgggtctgttgctttcaggatgctgtgtggggttcttggccctttgctctgggtcatttagtagcctgagacctcgagagcccagcttcgtagcctggtggtcagaatggattctgatcatgagtatgaaacttacaaagactaaaacatcaccactagatcagctactctcttctctcaattactgcttggacctgattaagcaacttacttacttgcactaagtaggttgtttttctcagtaaatctgatttttaaaacttactatatttcaccgagcatggcagtgtgcacctgtagtcccagctacttgggagcctgaggtgggaggatcacgtgaacccaggagttgaggctgcagtgagctgtgatcgtaccagtgcactccagcctgggcaacagagcaagaccctgcccctaaaaaaatttttaaaatattgttttagttttaaaaaacatgtcaggggctgattgtccttcacataaaaattagccctgtctcaggactgtagctgagagggcagtggctctcttggggtgcgccccacctgccctctgaagtaagaaacattcttgtctccccagtggtgagccaggccgaggggtgtggtgtgcatgaagggagagagactcactcggttagatgataggcatggctcagagataatagattcattcattgattcaacagacattcacagaggcttcctctgtgcctcgccctgtgcaaattctgagactgttacggctccatggggagacaggccattgcaatccagcatgcccagtgctgcaatcaaggggacagggcgctgacggtcagcaggtcagacagggagcctgcaggtggcaggcagggcactcccattgggatagtcagaagaaagtttggcagggtgcagtgactcacgcctgtaatcccagcactttgggaggccgaggcaggtggatcacctgaggtcaggtgttcgagaccagcctggccaacatggcaaaaccccatctctactaaaaatataaaaatcagctgggcatggtggcgtgcgcctgtaaccccagctactgaggtggctgaggcaggagaatcgcttgaactctggaggcagagattgcaatgagccgagatagcaccactgcaccccagcctgggctacagagccagactccatcgcaaaaaaaaaaaaaaaaaaaaaaggtcaatattgggcctatttgcagaggtgcagttcctaggctcatagtaccggcagggtttccacgcctgggtttgaatgagccagagcggggaaaggtagctagagactgaaggtgagggccccctcgaggggagccgtggccttggggagggaagagggacccagggcagcgccagggaccccttaactgatcccctctctcctcccaccagccaggggagctggggaagggcatagtacatccctagcatcaggggagcgcagggaaagaattgtcgaggaagccttcctaaagagggtggtatgggattcgggattggaagatgagtcaagtcaggttttgcagaggtttgtgaagatgcaagcctggcgaagcctgtcttggggaggacctgccagaggttccgaacgatttgcctgtggggtaggatggggcagcctggtggggcatttcccacatcagaaacggtctggacactgacaaaggcagcctaggaccaaccacgtaatgtaatagttcccagagtaagtcatcccccaaaaatgcagagaatggcctgagagaattggatcttggctactttcttttaactttggaggccatgggctcattctgagacctcccccactgcctttgcctccccttttattttccaggacagatttgtcactattccgtctgcttcaagtccaacctacatgtattttattagaccagacacgttttcattcatgtttgtgaatataagccccttggggcaaatcttttcacatatggtcttacagcatttcaaaaacaatttattttccctcttctgaaggagggattcttagggccaggcgcggtggctcacacctgtaatcccagcactttgggagcctgaggcgggcggctcacttgagcccaggagttcaagaccagcctgggcaacatggcaaaagcctgtctctacaaaaaatacaaaaattatcctggcatggtagctcctaactgtagtcctggatacttatgagtctgaagtgggaggatcgcttgagcccaggaggtcgaggctgcagtgagcctaattataccactgcactgcgacctgggtgacagagcaagaccctgtctaaaaaaaaagggattcttaaatatttgttgacgggaattggagaggcatgaaggaagatgggttttggagaaagactgacttgggattgattcactagggtccactacgagctctctgcgtgaccctgaatgagctatgagctgtccacctccctttctgacctgtacaatgggcataccggaagtcaagtcactgggtggtttttgttgttgttgttgttgttgttttgttttgagatggaatcttgctctgtcgtctaggctggagtgcagtggcacgatcttggctcactacaacctccacctcctgggttcaagcgattctcctgcctcagcctaccaagtagctgggattacaggcgtgcgccaccacatccagctaatttttgtatttttagtagagacggggtttcaccatgttagccaggatggtcttgatctcctgacctcatgattcgcccacctcagcctcccaaagtgctgggattacaggcgtgagccactgcacccagcatgctaggtggttttgaagaggcaggaatgggatgtgtgtgtatagcacctggcatggtgagagtctgaggctaagctgtcgagagatagaagctattcccagcaagctcagagcagggcgtggtatgcgtttctgaaattaacggccttggaggaaattgactttcaccgcatcaccacgacggactgggcccacattgtctgtctgtcgtggggagatgtcacagggtacccatccctctcccgttttggagagaagcccgcaggtctgtggtactgaggctgctccgagaccccggtttatcgtgagcagtcatcgccatgcgtcagctgggacagcacgggctgactgtggcagacaacggcagtaaagttttccatgtgtaggcttgaagcaaaatgtaattagcctttatgtgcagaacaagggcccattgatgaatacagctggtctttgttttgtcctgtcgttgagagtgggaggtaaaagtgttcttcttcatgtttattaatgcaagattccttagacaaatggcaagcacagtttaatatttgttggaacatgggggctttgccaaaacagttgttgtgtaagaggattgcaaggtttccgattataaccatttctgggttaaataaatgaattatttctgccctttttttcttttttgaaatttttttagagtcagggtctcactgtgttgcccagagtggtctcaaactcctggcctcaggtgatcctcccgtcttagcctctcaaagtgctgggattacaggcatgagccactacgcctgacattcttttttctttagttaaaaacatagctccttctcagatggtcaccctgtgtacggatcttcccgcttctcttagcaaatggagatttaccaccctaatagccttaaccttggagactctagcaaaggaacgtgctgtggattttaacatctaaacaattccttgggatggatggccgtggaggtggcagatccctggaatcacgcagcagtaggcagcccagagagaggcctgggcatccctcactgccccaagttcctgcatccgtctcctgcagctgttcacttacttgatcttgggtttgggttgctactgcaccctccagcaggaatgtcgccctcccagccaagcggctagtgttctgggcaaaaatgcaggaattcccatttttgctgaagtccacgatcctatgccctgtccccaagaatctggattggaaaaggagttccagctgcaatacacacagtcagcttcttgcattcctccccactcgtgggccgaggcactgagcctcgatgaaagaaaatattgaatcgcactgaaatactacattttttatagctaatgttagtcttaggagaatttgcacctcccaaacctttcctgccagtaaaattcgtatttcttaaggttactcatgttgtattcctagcctatatgcttttttcaaagaacgacattgtgtatacacatacttacatagtacggttacaaaagagacatttacgaggaacttcacttaggttaattttagagtattttctttataacatgtatataaccagtactttatcacaaaatacaacgtgctctgaaacagcagaaaactttcccgtagctaactcagcactggggagcctctacgcttctttggagggatagagaactccagatcccaaaggaggacataagacagaatttgaaaaggggaggaggctgggcatggtggctcacgcctatcatcccagcactctgggagactgaggtgggaggatcacttgagcccaagagtttgagaccagcctgggcaacatagtgagaccccacctctaccaaaaaatacaaaaattatctgggcatggtgttgtgcctttagttccatttacttgggaggctgagttggaaggttcgcttgagcctggaagttccagcctgtagtaagctatgattgcatcactgtactccagcctgagtgacaaaacgagagcccatctctaaaaataataataataatttttaaaaggaggggaggaggataccagcagttcaagacacaagtctgcatggcaaatgtgggtgggatggatactttctttttattttattttttatttttttgagatagggtctctgttagttattcaggctggagtgcagtggtgcgatcatggctcactgcaacctccacctcccgggttcaagtgattcttctgcctcagctgctggaggagctgggattacaggcttgtgccaccatgcctggctaatttttgctttttggttttttttttttttggagactgagtctcgctctattgcccaggctggagtgcagtggcacgatcttggctcacggcatcctccgcctcccgggttcaagcgattctcctgcctcagtctcccaagtaactggaattgcaggcatctgccaccacacccagctaatttttgtatttttagtagagacgaggtttcaccatgttggccaggctggtctcgaactcccagactcaagtgatctgcccgccttggcctcctgaagtgctgggatgacaggtgtgagcagctgggatggatactttgtttacatactgttctggactatttcacaatgatttcctgagtgttatcttgtttgccctttcctgaagtcactggggcagcttttattgtgctcattgcatggatgaggaagcagtcccaggaacacgcagattcaggccctggacctggtcctttaggctcaaattccagtgctttttgcttgagaccacggcggtcttcaaagcccctttctggtgccagctttgtaatcaagcagcaaaggtgagggctagtcaggtgaaggcaggcgttcctggggggttcagcctttcccagcctcacaagcccccgttgtatttaccatagcagattgatttttccctttttgaacaataattcctcatgaaagactcacagaactggggccaggtagagcccggttgagtaaacctgagaatcacccagctgtcttgaccatcatatttagacaaatattgcatcccctgattgaatttgaaagggacaacttaagcatcctgaaaacagagtctgtctgctgtacctttaagaatgtaaaattttctatttcctgtctttttgatgagtcatcagtttccagtacgagttgctgtaattaccctggttggattaatttccctaaaaatagagaagcagccacttttatggttttcagagtatggacttgaataaagaacctcctgtcctttaaaccttagagagcactaaatcagacttgcagggaaaaaccgatggccttttttttttttcttcctgtgtcttatctccaaaaggggcttgtggattttgtagaattcttgggatttttcatctctgtacaagtattttgctccacacctaaaaattgatgcctgggtgagccctgaaggattttccttgtcttttgtagtaacaccagctgtcttggccccctctgaatagtacaaccatgacctggtgtctccccaggttgggggctagacaaaaacaagggggtggcttcatagttccaagtccaggtagaaattcctctgagcgctgacgattctttgccagttctgtggcccccagacatggctaggaaatgtaattgacatgtaatagacatgtctattgcaaagcatcagtgagaattgccaaactttactcctctccttcattgatgtttagggaagggctgctttactgtggtaggtgtggtgtcaggtgctggaacgatagagtaaggacagggtgggagggggcttacagacgtcacatgcacacacacaggctcacacactctgtactcaaaaacacgtacacataaatagagaggcagccgggcacggtggctcatacctgtaatcccagaactctgggaggccgagatgggtggatcacctgaggtcagaagttcaagaccagaccagccaacatggtgaaaccccgtctctactaaaaatacaaaaattagctgggtgtggtggcgcatgcctgtaatcccagctacacgggaggctaaggtaggataattgcttgaacttaggaggcagaggttgcagtgagctgagatcgcgccactacactccagcctgggcaatagagttagactctgtctcaaaaataaaaaaaaaagagaggcactgtgcatgtggccatgtatataaacatgtttgtgaatataaacatgcaatcagtttttaaaaaatttttatcggccgggcgcagtggctcatgcctgtaatcccagcactttgggaggccgaggcgggcgaatcatgaggtcaggagattgagaccatcctggctaacacagtgaaaccccatctctactaaaaatataaaaaatgagccaggcgtggtggcgggtgcctatagtcccagctactcgggaggctgaggcaggagaatggcgtgaacccgggaggcagagcttgcagtgagccgagattgtgccactgcactccagcctgggtggcagagtgagactccgtctcaaaaaaaaaaaaaaaaaaattatcatacagtctctcaaccagtcctactgcttttttttatttattgattttgagacagggtctcactctgtcacccaggctagagtacagtgatgcgatcttggctcactacaacttctacctcccggtttcaaacgattttcccacctcagccacccaagtagctggtatcacaggtgtgtaccaccacacctggctaatttttgtatttttagtagagatgggggtttcaccatgttacctaggcgggtcttgaactcctgagctcaagtgatccactcatctcggcctcccaaagtatgggattacaggcatgagccaccgcgcctggccaataaagcaatcatattcatccagcatcctttgagagggtagagaaaatcattattcacagactgtcacctgggtttggcgtgcattcctacagattttacctatttaagagatccttaaagtttttctgattcactgttaaggtaagcctagggatcttgcagtgtatatgtgaaggaaatgggtaacggactgttgagtgaatacagtgtatagattgtagcacatatggtgatctgtgaaacgggggtgtcatgacacaccccttcctgcatcccaaaattgtgggggtcagggtggataacgggcatttctgcagcctgcacagcagtgccgaatgcaggctgcaatccagcaatgtcactgctgggtatttatccaaagaaaggaaatggctgtgttgcaggcatacctgcactcacacgtttatcacagcgctgttcacacagcagcctaggtgaggaagtgacctatgtgcccagcttcagatgaatggatgaagaaaatgtgtagatccacagtggaatatgatggagccttacaaaaggaaatcctgccatttgcaacaacaacgtggattcatctgggggatgttacattaagtgaaatgaaccaggcacagaaagacgaataccacaagatctcactcatgtaaaacgttgatcacataaaagttaagaagaatggtggttaccagggggtgaggagaggttggttaaatgatacatatttataggtagacaggaggaataagtttgagagatgtattagacagtgactatagttaatgccggtatattgtaaaattggttagtagaaattttttttttttttttgagacagagtctcccctctgttgcccaggctggagtgcagtggcatgatctcggctcactgcaacctccgcctcctgggttcaagcaatttttatgtctcagcctcccaagtatctgggagtacaggcacagggcaccacgcccagctaatttttgtatttttaacagagacagggtttcgccatgttggccaggctggtctcgatctcctgacctcaggtgatctgcccacctcagccttctaaagtgctggatttacaggcatgagccaccgcgtctggccccattttttaagtgttgactgaaaactacctcaaaagaccggctttatcccacactctgtacaccacaggcttagcacgtcgtggctctccaggaactcttgagccttccccatgatgatgagtgggtcagggttaccgcagagctgaacggcctctgtagcgttcagcctgcagcctgcccaatgaggacgtttgcgctctggaaaggtaaactcaggatgctgttggctcctaagcagaaagcaggcgccacccagccttcaagtgcttcaacagtgaagagttaggacggaggcccagcctggaacattcacgccaccttctgcccccagtaaaattccttaaagctatgaggttctgactcaccacggggagtccctggccgccgctgggagggccttggccatgcaaatctcagtgacatagcacgtcttatttgcttcagaagtggcagaggagaaagtgacttgcctcacgctgcccggttccacccagggaccttgtgaagagacgcgggaaggctggcagaaaggagaaccgtccttcctgtggaatactcccgagatcgcaccactccactccagcctgggtgacaagagcaaaactccatctcaaaaaaaaaaaaaaaaaggcactgtacatgtgtccatgtatataaacatgtttatgaatatacataaataattttttaaaaaattttgtcatgcagtctcagccagtcctgctgtttttattttattttattttattttatttatttttttgagacaaggtctcactctatcacccaggctggagtgcggtgatatgatcttggctcactacaacctccgcctcctgggttcaagcaatcttcccacctcagccacccaagtagctggaattataggctgtttccttttacatgacattattttcccttttttatgttttattttattttatttttgagatagagtctcactctgttgcccaggctggagtacagtggtgcgatctcagctcactgcaacctctgcctcttgggttcaagcgattctccagcctcagcctcccgagtacctgggactacaagtgtgcaccaccatttccggctgtgtgtgtgtgtgtgtgtgtgtgtgtgtgtgtgtattttttgtagagacggggttttatcatgttggccaggctggtcttgaactcctggtctcaagtgatccacccgcctcggcctcccaaagtgctgagattagaagtgtgaggtaccacgcccggcccgtgacattatttttaagtacaaaagccatacatgtttactatacaaagtttagaaaattctcaaagattttttttaaaggaagcagatcatcactcataatcccacagcaaagatgatcattgttaacattttggcctatttccatagtctttttttctatacagattgttccttacaatggcattatgtcccctaaacccatcgtaacttgtaaataccttaagtctaaaatgtgtttagcacacctaacctaaatgtcatagcttagcctcgcctattttaagcgtgctcagaacacccacgttaattagtctacagttaggcaaaatcatctaacacagctgtccccaaccttgttggcaacagggaccagttttgtgaaagataatttttccatggaccagtgcagtggggggcgcggttcaggatgattcaagcacgttctatttattgtgcactttattattatgacattgtaatatataatgaaataattctacaactcaccatcatgtagaatcagtgggagccctgagcttgtttttctgcaactacacagtcccatctgggggtgatgggagacagtgacagatcatcaggcattagattctcataaggagtgtgcagcctagatccctcgcatgcgcagttcacagtagggtttgcactcctatgagaatctaatgctgctgctcatctgacgggaggcagagctcaagcagtcatgagagcaatggggagcagctgtaaatacagacgaagcttccctcctgcagcgcatctcctgctgtgcggcccagttcctagcaggccacagatgtggccaagggactggggacccctgatctatatagtgctttcttttttcttttttttctttttacgagatagggtctcaccctgtcacccagcctgcagggcagttgcactatcatagctcactgcagcctccaactcctgggcttgagcgatcctcccacctcagcctcccgagtagctaggactgcaggtgtgcaccccacaccaggccagttttgtattttttgtagagacagggtcttgccgtgttgcccaggctggttttgaactcctgggctcaaacaatcctcccaccttggcctcccaaagtgctgagtgggattataggcatgagctgcttcgcccaaactcgtctgttttttaccagtggcatagactgataacatgattttgatttctagggtttgttttttgtttttgtttttttttttacctgacatgttgtaaatatttcttgcttatcattaaatattcttcagaaacacagtgcatactgcataacattccatcacgtaggtgagccctaagacttaccacttatttccctgctgttcaggagcctgatttattacactgctttcattgccctttggggtttaatctggggagctttgtccctgttctttctatgccttcatgttctgccagtggctgtggcatctttttcgtgttttttgtttgtttgtttgtttgttttgttttgtttgagacggagtcctgctctgtcacccaggctggagtgccgtggcatgatctcggctcactgcaacctccacctcccagatttaagcgattcttctgcctcggcctcctgagtagctgggactacaggtgtgtgccaccacgcccagtgaatttttgtatttttagtagagacagggtttcgccagttggccaagctggtctgacctcaggtgatcggcccacttcagcctccagaagggctgggattacaggcgtgagccaccacgcccagccggctgtggcatcttgaggtagcctcccaaggccatcatcagacaagagcgtttggaagcccagaattctccaagggctcatggcagtactggcacggggcctctgttcctagactgctgctccatgacgtttgtagatgcctctagtgaaaagtcagggacagtggatgatatgcacggctcagagaccctgactctggtcccatctgtccccaggtgtgaccccacaaagcccctccctcggccgcagcaccggattgggccgggtgccaggcaggacggaggagctggcccttttgtcagcctcttgcactttcttgcccagttctacttcccagagacctggatctcggatgctgtcccccagcagggcctgtttgtggagtggccttcaggcagggctgcatccagggcaccgggcacagcatgagtcacggtgggaagaacctgggtcgcaacatcgtaaagacctgggtttaattcccaactccatgaattatgtaacctcaagcagggcaggaggtttccttactcagaccttagtattttcataagtgaaataaaagaatgccacgcctcacctgtaatcccagcactttgggagatcaaggcaggtggatcacttgaggccaagagtttgagaccagactggccaacatgaggaaaccctgtctctattaaaaatacaaaaatttgctgggcgtggtggcatgtgtctgtaattctagctactcgggaggctgaagtagaagaatcacttgaactggggaggtggaggttgcagtgagctgagatcccgccactgcactccagcctgggcaacagagactctgtttcaaaaaaaaaagagaaaagaatgccacattagtgcctggtacaggacctctataaagggtggctgacattgctgctcctgctgcctgcaaggcacctggcatcacctggcacattttaaaaaggtctgcttacctccccctgctcaaggtctcttcccactcttaagaattatgtcgctttccatgatgagtttgtaaaaatcattatccgcactgcaagacctactcatccatattagcgtgccacagctggggcacccaggtgtaaagctttgtttcccatcatcttcctcagggaccctaaattttaaaatctgcatcagtcaccattgaggtgccactaaatgtggtggccaaaagttccaagttcaaaccattgcacagctgcaaatgccttcatagatgggtctctaaaaaatcaaacaccagggctgggcacagtggctcacctctgtaatcccagcactttgggaggccaagatgggcagatcacttgaggtcaggagttcgagaccagcctggccaacatggtaaaaccctgtctctactaaaaatacaaaaattagctgggcgtggtagtgggtgcctgtaatcccagctactcgggaggctgaagcaggagaatggcttgaacctgggaggcagaggctgcagtgagccgagattgtgccattgcactccagcctgggaaacagagtgaggctccatctcaaagaaaaaatcaacaccagaggttaataatctagtaactaactgtcttctatgtgccacatttttgcaagatccaagttttaaagtgagaacaagttgttcggtccccgcccagctgactgtgacaccaaggtggcggcccgcattggagatctggttccatctgacttggaaaatttggggcaccgtgggctggtgtgaaacaaattaaaagaggtgccaaacagccaggcacccagcaaggatgcccagggctcttgttcggggatttcgttaaaaaactttttggaacccacctcaaagaatgaaaagtttcctataggaaggcaggagcgagcgagataattgaactcattgatttccttcacggcttgtttgccctttcattctcttcccgaggtgctatttgttgaggaatgtctccaattgccagaaagacagtggggtgtctcatatttcctcgccacctctcctttcagccagtgctgagttctaaggcaagcctgcaatatgaatttttaatgccgagctttatggcatcactcccgcacagcccgactgcatcactctcctgagccttcagatttaatgctccaatgaacagagcaaagactggggcattcaacatcagtgagaattaacccccacatgaccacagcagtgccctctgattttcctaaagagggttgggaaaaaataaaaattatgtagtgttggccgggtaaggtggctcacacctgtaactccatcactttgggaggctgagatgggtggatcacctgaggtcaggagttcgagaccagtctggccaacatagcaaaaccccatctctactaaaaacacaaaaattagctgggcgtggtgacgggagcttgtaatcccagctacttgggaggctgaggcaggagaatcgcttgaacccaggaggcagaggttgcagtgagctgaaatcacgccactgcactccagcctgggcaacagagcaagactccatcttataaaaaaaattatgtagtgttgagaatccttgctatccaaatagcctgaagcacaaaagcacagcttattcttgaaattttatggaatagcctatattttgacctttttgcttcttctaagttggacgatgtgtgcttcgaagcatttctgtgatcttcccacccttaaaaaaaaaatctctgcaggctgggagtggtggctcacgcctgtaatcccagcactttgggagactgtggtgggcagattgcctgaggtcaggagttcaagaccggcctggccaacatgatgaaaccctgtctctactgaaaatacgaaaattagccgggcgtggtggtacacgcctgtagtcccagctactcagaaagctgagtcagcgagatcatgccactgcatttcagcctggtcaacagagtgagactccatctcaaaaaaaaaaaaaaaaaactctccagtttgtaggatttaatgaatatatagatgaccggctgttctgcggtttccgtggaaagcccaaatgtaattagaaatccaatttccgatcgatttttccaatggaaaaaggaccagttgtgttaagtggctaattctttttttatgcagatggttgattgtcattttcttatagtagctttctgaatttttgcagacgtcaaaactaagaaaaagttgtatataaaaattgctcaattggccaggtgcagtggctcacgcctctaatcctaacattttgggaggccgaggcaggagggtcgtttgaggccaggaattcaagaccagcctgggcaaaacagcaagacataatttctgtttaaaaaaaaaaaaaaaagtttgaacataaaaactgctcaaatttaagtacattaaagaaggacagagtctttagtaaatggtagaataacaagccaactatgtagaagccagtagaatcagagctgagccccatgcaaaataaaatctatttagttatttttatttattttttattttatttatttattttttttttttgagacagggtcttgctgtctcacccaggctgaagtgcagtggcgtgatcttggctcactgcaacctctgcctcccaggttcaagcagttctcctgcctcagcctcctgagtagctgggattacaggcgcgcaccaccatgcctagccaatttttgtattttagtaaagatggggtttcaccatgttggctaggctggtcttgaactcctgacctcaagtgatccacccacctctgcctgccaaagtgctgggattacaggcgtgagccaccacgctcagtttagatgtttaaaacatttaaatgtgaccagaaagaaatccataaaaacactaggagcaattttaggtgtatatttatataataagggggtggaaaaacttttttttaagcatgatgccaaaagtagaaatcacaaagggaagaaattcagagctttgtggagatggatgggcgggtggatagatggatgggcgggtggatagatggatgggcgggtggatagatggatgggcgggtggatagatggatggatggacagacggatgggcagatggatttagacagactggcaaaaatatttgcaatatatatgagagagagagtgtgtgtgtgtgtgtgcgcgcgcgcgcgcgcacgccacgcacacacgcatctttacagaacaataagaaaaagtttcatttcccaatagtaaaacctctatattttcagtttcttactagacatttctactatgagcatctcaaactcagattaagttgttattctccgtaacttcccccttccctatagtcagcccccttctgctttcttcctctgcccgaccatacctgctcctccttcattccagaaactgagggtatttcgtcactcctttgtgagccctcctgtctaattcatgttagttccgccttcttgcaacattgtacattcccaacttcatcaccactctcactaccgtcattttaatttgtttttctttgcttttctttttttttttttttttttgagacagggtctcgctctgtcacttgcagtggcgcaatctctgctcactgcaacctccacctcccaggttcaagcgattctcctgcctcagcttcctgagtagctgggattacaggcacccgccactacacctggctaatttttgtatttttagtagtgacagggttcaccatgttggccaggctggtcgcaaactcctgacctcaagtgattcacctgcctcagcctcccaaagtgctgggattacaggcgtgagccaccgcacccggccttaatttgtttttcgtctcttggtctcacttcaagatcttctgaacttgaccctctgccaccagtatctccctggacaaaaccaccctccaagcatctgctaaagttatctttctaaaatctgtctgatcctgctaaaacctgtcccacttaaaatctctccgtggcaccctctctcatatctaagggaaagtccaaaatcacagcatgatgcacaaggcactttgggatgcagccctgccttcccagcctcatcttaggccaactcaaactccaccgtcctatagaatcccaggcctttctttccccagctcaccttgcagccggttctacctttcctgacaagctgatcctgccctgccttgcctgctcctatgcccacacttacctgctgtggtgaaagagggctctggtctccctcattctaggggctcttcatgtggggtctatagagagaacctgggggcttcatgaattggacccagaaaaaaatacatcttttttttttttttttttttttttttgagatggagtcttgccctgtcacccaggctggagtgcagtgatgcaattgtggctctctgcaacctccgcctcccgggttcaagcgattctcctgccttagcctaccaagtagttgggaccacaggcatgtgccaccacacccagataatttttgtagtttttagtagagacagggtttcaccatgttggccaggctggtcttgaactcctgacctcgtgatccacccgcctccgcctcccaaagtgctgggactacaggcgtgagccaccacactcggcctagaaaatacatctttatttccatcagtgtctaactgcaatgtagcatttccttccattgtaaatgaagcccccacaccggggtaattgcagactgtgacctcgttgcgagtggaaatcacagaggctttcacatctcattcccgttgttacggaggtcacaaacgctgtttggattcatcactacttcaaaatgtcagtggttcttagatttgttatttagtgcaacagtaaagaacagttgttcctgtatcacaaatctggttttaaaaaaagattgtcctggcgcgctggctcacacctgtaatcacagcaccttgagaggccaaggtgggcagatcactttgaggtcaggtgttcgaggccagtctggccaacatggtgaaacctcatatctcctaaaagtttaaaaaattagctgggagtggtggtgggcacctgtaatcccagctactctggtggctgaggcaggagaatcgcttgaacccgggaggtggaggttgcagttagctgagattgcaccactgcacttcagcctgggcaacagagctagactcagtctcaaaaataaaaattaaaaaaaattgcaataactgcacttcaaaataattgttttccttggtccttaaaacatgattagacttctgtccaataatggccttgtggacttacgtctttaaaacattccaaatagatgcctgtattcttgacaagacttccagaggggaccgtggcaaaggaagggttaagcatctgcgtcagactgacagtgtcttgaccggatcctcctccgtctttcccccaccgctttgcacagtgccacatgactttttatttgttttgagacaggatccagctctgttgcccagactggaatgcagtggcgcaatcacgactcactgcagccctgacctcctgggctcaagtgatcctcccacctcagcctcctgagtagctgggactataggcaagtgccaccacacccagctaattctttttatttttagagatggggtctcactgtgttacccaggctggtctcaaactcctgggctcaagcgatcctcccacctctccctcccgaagttctgggattacagacaggagtcacagcgccaggtccctatttattttactctttgtgtgtttccttatatcctgtaaaaatgggtacagtggaaactgggcagtaattctacacgtattctggattttagctactcacatttatggttacttttacctatcaattaattgcttttcttttcactcgagttttagtgattttcactgtccaaaagaatcgtgtatagttgacccttgaacaacacaggggttagaggcactgacccccgacacagtgaaaaatccaagtacaacttttgactcctcaaaagctttactgacagcctgctagtgaccggaagccttaccagttacatgaagtgccgattaagatgttttgtaagttacatatgttatatacaatattcttccaataaagtaaggcagagaaaagaaaatgttaagaaatcctaaggaagagaaaacacactttccgttcattaagtggaagtggatcatcaaaaaggtcttcatccctgttgtcttcacatcaagtaggccaaggaagaggagggttggtctcgctgtctcgggtgacagcggaggaggacgtggaggaggtgggaggggggccagacacactcagtgtaattttactgaaaaatattcaagttgaagtggaaccatattgttcagacccatatttgagggtcaacttgtgtgtgtgtgtgtttgtgtgtgtgtgtgtgtatgtacacacacacaaaaaataatatatataaaaacatgagtcccagcaatcttatccttaatcatttctaatgtggtttcagtgagagaaaatagtcttttcaggccaggcacggtggctcatgcctgtaattccagcactttgggaggccaaggcaggcggatcacttgaggtcacgagttcaagaccagcctggccaagatggtgtaaacccatctctactctaaatacaaaaattgtcctggtgtggtggcgcgtgcctatagtcctagctacttgggaggctgaggcaggagaatccttgaacccgggaggtggaggtcacagtgagctgagatcacgccaccacacaccagcctgggagacagagcaaggctctgtctcaaaaaaaaaagaaaatggttttttctcctcaatccattttcttatttttcaatgacctattatatctttaatgtgtctgaagtttattatatcatataaaataatatttgtttctgtttgttattctttaatactcagtttgcccaataatattgatgatttcttcccccaacatataatatctgacaaatcaggtataaatacatatagctctggatttctgtctataatttcattctatcagtctagtttttcactctaataagtgccacactcttgatgacgtctccttgttttctatttcagtatttgtatagccagtttactattgttgtttttagtttaaaagaaaaaaaaacaacaacctttagtattttggtcacctattttttctgtatgcatctcgtcattttaccaactttttttttttttatttgagatggagtcttgctctctcacccatgctggagtgcagtggcacgatctcagctcactgcaacctccacctcccaggttcaagcaattctcctgcctcagcctccccaatagctgggattacaggcaccgccaccacacccagctaatttttgtatttttaatggagacggggtttcaccatgttggtcaggctggtctgaaactcctgacgtcatgatccgcccaccttggcctcccaaagtgctgggattttagacgtgagccaccgtgcccggccattttaccaacttttataaattaacttgggagagaaatgtatgtttctttgtatttaatgcagctgcacataaatgtatcattctcttcctttgctccaagcattttgtaatccaatttttctacagatggagtttatgctatgttattttaattcccacgtgcttctgtgtttacctctgttgtaaatgagacagatcttttatttcattttgtggatgtttattactggtgtaggggagtttgttattttcttgtgtttaccaagaaacatagggctttgctgaacgcttgattgtcccagcccatttgctcaagtgaatccctgggatttggggagcacgggactgcattacctacaagtagtgaacgtgcaccctgtgtgacactcagaacttctgatcctcttctttcattcctgtgttcagaaggagcattctgttataggtctgggaagaatcgtggaggctcttggtttaagcctgtgtccctttccatgttaatcaaatgctccaatgatttcccctctgtaaattgaactgtgacctggtttttagatgccatgggatcaaagccccgcaactgtgttagatccttctagtggggtagttttctattaggtcggtgcaaaagtaattgcggtttttgccattaaaagtaatggcaggttgggcgcggtggctcacacctgtaatcccagcgctttgggaggttgaggcaggcggatcacctgaggtcacaagttcaagaccacactggccaacatggctaaaccctgcctctactgaaaatacaaaaattagccgggcgtggtggtggatgcctataatcccagctactcgggaggctgaggcatgagaattgcttgaaccctggaggtgaaggttacagtgagctgagatggcaccgctgcactccagcctgggcgagaagagtgaatctccgtcaaaaaagaaaaaggtaatggcaaaaccacagttacttttgcaccgacctaatagtaggattacacttttaaatagtacatttcattccatttttattttacatattttatagattttcttgcttatttaagacaagttgaagcttatgtttctatttactgtgccatttagcatttcttatttctccctaacattattatgctacatataatattgattagtctggcttcaaaccttaccttaattagccttaaaaaaaaaatctagttggccaagcacactggctcacacctgtagcctcaacactttgggaggccaaggcagaaggatcacttgaacccaggaactggagaccagcctgggcaacgtagtgagatcgtctcactaaaaaaagttaaaaattagctgggcatggtggtgctcactgtagtcttagctactttggagactgaggagggaggattgcttgagcccaggaggtcaaggctgcagtgagccaaaatcgtgccactgcaccccagcctgggcaacaaagtgagatcccgtctccaaaaacaaaaagtctagttaatcattgcctttttactcaaaatgtgtttctaccaccctttttggatttttaaaaaatatgtattttatttttatgggtaaatttggcctaattacattttactgatataactcttaacttaaatttctctttattgttgaattgttgatccttttcttttttctaattcacagtatctctgtcctaggctttctgatctatttaaggaagattgagtgaacagcctaattgaccctctgaatgtcccctgagccttctaatccgccctgccttgagcctcctcttgtaactgaaattcactttctgatgcagaaccattgagcccttctgaaaccttttcaaaactatatatttaaattttcttatcaaactgtactgttattagattacatgtctagcatagcagcaaattatacttcattatattaaccttgccacttccctctacaatgagacccgatcttttataagatactctggacctacaaattcctgctggtgaattctttaaagttatatggattttcaacgatcgtctactccctttacaaagcagctgctgtttagcaggattatccattagtggtaagaatcctttattccctagcatatggtaaatattttttaccaacttgaggtatgccacgtagatcccacgggatttacacacatagacaaaggcattcttctcatcacattgttttaaacaatccagctgccattttagctttcactaaacttagaaatgtatcagcttggccgggcattgtgggtcacacctctaatctcagcactttgggagatcaaggcaggcggatcatttgaggtcaggagtttgagaccagcctggccaacatggagaaaccccatctgtactaaaaatacaaaaattagctgggtgtggtggtatgcacctgtaattccagctactcaggaggctgagacccgggaatcacttgaacccgggaggcagagtttgcagtgagccgagatcgtgctgctgcactccagcctgggcaacagagagagactacatcttaaaaaaaaaaaaaaaaaaaaaaaggaatggtatcaactcgacacccagggtccttctgtaagttaaaacctgggaagtgccctaccctggcatttgaaaagtggctgaatccaatttcctgtccagaattacaatgacattgtattgatacattgatgatcaaaagcatagctaagctgtaaggctggttattggatatacatcttccaagtggagagattattaccacctgaaacagcttttggcttgtccattaagactcctttccagccaggcatggtggcccacccctgtaatcccagcactttgagaggccaagccgggggtactgcctgagcacagaaattcgagacaggctgggcaacatagcaagaactcatctctactaaaaattaaaaccactttccaaaatgaattttttttttaagacaggatcttgatctgtcacccaggctatagtgcaatggcacagtcatagctcactgcagcctcaaactcctgggatcaagccatcctcctgcctcacccccttaagtggctggttctacaggggcacaccagcacacccagctatttttttttttttaatttattgtagagacggggtcttgttacattgcccaggctggtctcaagctcttggcctcaagcgatcctccagcagtcctcccacctgagcctcccaaagtcctggaatgacaggtctaagccactctgctcagcccaaaacaaattctataaccaaaccagaaaagttgttttttgtttagctttttaccttaaaactttcattacccctacttccaacaaagtatttgaggtggatttaacacaagacacagcatcaataaagctcttaagtgaagtctgagatttaaaggagcatagctcagtggggaagatgacttctaaggcttggctttgaataaagcccaactcttcaatagcttggtgtgactaagacatgctctacctatgtgggtttgtttttttgtttgtttgtttgtttgtttgtttttggagacagagtcttgctctgtcacccagggtggagtgcaatggcacgatctcggctcactgcaacctccacctccgggttcaagcaattctcctgcctcagcctcccaagtagctggaactacaggtgcacaccaccatgcccagccagttttttgtattttagtagagacggggtttcaccatgtttgccaggctattctcaaactcctgaactcaggcaatccacctgccttagcctcccaaagtgctaggattacaggcatgagccactgcacccagcctctatgtgttttttttattgttaagagttcgaggctgggtgcagtgacacacacctgtaatcccagcactttgggaggccgaggcgggagaatcacttgaggtcaggagttcaagaccagcctggccaacatggtgaaaccccgtctctactaaaaatacaaaaaaaaatttagctgagcgtggtggtgcacgcctgtaatcccagctattggggaggctgaggcaggagaatctcttgaacccaggaggcagaggttgcggtgagccaagatcatgccactgtactccagcctgggggatggagcgagacttcgtctcaaaaaaaaaaaaaaacagcattactatgccaccctgatacactgcttggctaggagggaaaacttcttgttgcaattaacctttctatttttttcgctacgtctaagtattgtgaacttcctttgtggtattttagtgattagacaggatggagggcgttcttaaagattcatggccaaatccaatgatgtcagagtgaagggaacggacggtcttcgtggggccagcaagtctggccccatctgaattgtttgtctaacacttcacaagcagaataggaaccgctgaattattcattttcaagttgccctaaaaaaggtacttagcctgccgaaaggcagactttcggtgccagcgagaggaagaggaaggatgctgtctttcctatgaacgttctcgtgcctccactgcctgggtcttcagtttcacttcccagccctgcggggtacaggaaaccaccagctaacttaagtgcaaggcaattaagcggggagggaattgtggacaaatctatagaactctgaagccacaggtgagccaagcattgactttactggggaaaaaccaggtggaagaaggttgaaggagcttgggttggtcagaagatgccaggatttgggacctgagccagggaggtgggcccaggaagtgggattgggcttggggatggggaaggagaggaagctgagagcgataactagtatgcaatcagaaattttttttattcttagttttagcttctctgcctctgccaccaaagctttgttttggtttttgagacaggctctcactctgttgcccaggctgtagtgcagtggcacaatcttggctcacttcaacctgtgcctcccgggttcaagcaattctcccaccttagcctcccgagtagctgggattacaggtgcacaccaccactctcagctaatttttttttttttttttttttttgtatttttagtagagacggggtttctccatgttggtcaggctggtcttgaactcctgacctcaagtgatccacccgcctcagcctctcagagtgctgggattacaggcgtgagccaccatgcctggtcccaacctttccttaacacttcctaccacacagtacttaggggagaaagtcattagaaacccttgtacttgggagtaaaggccaggcttttagtagagacaggttgcctaccatgcccttgagcccatgcaccactgcgccgccctgcacctcagtttccccacttgtgaaatcctagcagtcttcctctgtaggtctgcactgctcccctgtggtgtgtcttttgtgcagcgcaggaggcagatgagagagagaagcccgcgtcttgtccaaaatatgatttggcgcattcttgggcagcgtctgttggaggtacaggcgggatgctcacaggtgaagtaaaccaggaatggcaaacagaacctgaaaggtggttctgaaagagagaatgcagaaactgggcaagcagtactcccacctgtaggaaggtttgctggcgaagtttcacactaaaacatgaaggagactgttaaaaacaatgggtatagatgacagaacagcatcccttcctaaacagcctttaaaagtctgaaactagggccaggtgtggtagttcacacctgtaagcccagctagttgggaggctgaggcaggaggatcacttgagcccaggaatttgaggctgcagtgagccatgatagtaccactgcactccagcctgggcaacagagcaagaccctgtctctacaaaaaataaattagccatgtgtaatggtgcacacctgtagtcccaggtattcaggggatcgagacaggaggatcacttgaagacaggagttcaagaccagcctggccaacatagtgagaccttgtttctgcaaaaaatttaaaaattagccgggagaggtgatgcacacttgtagtcccagctacttgggaggccgaggcaggaggatctcttgagcccatgagttcaaggctgcagtgagccatggtcaaaccactgcactccagcctgggcaacagagcaagacccatctattaaaaaataataataataataaaaacaaatctgaaagtaaagaagtaacaaccggtccccatttcctgccaggttgttgtctacccgtgattcctggcacagttggggcaagtccccggagtgcaggagccatgttgcctgcgtctttgtaactgtcccatggccagggggctcaatggatggcaggctgccggcccacgatgtcaacagcaggaacttgtgcctcagtttcctccatcacctaagtgtaggcctctcaccatgacagttcccttcctgggtcagatggtacttggggggttcccttccagaattcattttcttcccattctctgttcttggctaacaatctttttcttttttatgagacagagtcttgctctgtcacccaagctggagcacagaggcgcgatcatagctcactgcagcctccaactcctgggctcaaacgatccacccacatcagtctccaaagtagctgggaccacaagtgcataccaccatacccagctaatttttgtattaatgttttgtagagacggagcttcaccatgttgcccaggctggtctcgaattcctgggctcaagcgatcctcccaccttggcctcccaaagtgctgggattacaggtgtgagtcactgcgcctggcccaatcattttctgtgtcaaagaaaaacatatatatggtatattattttttaaagtcacattcttcttatagagatgtgctctttgtatacatttttttccccttggcaagtgggtaaacgggattccgggaaggtaactgtcttgactaaagttagcagagtctggcatcaggtggaccgcacaggacggccacttcttcttttgtttttttgttttgttttgtttgagacggagtctcaatctgtctcaccaagactggagtgccgtggtgcgatctcagctcactgtagcctccacctcctgggttcaagccatcctcctgtctcagcctcccgagtagctggaattacaggcatgcaccaccccacccggccaattttgtatttttagtagagacgagcctttaccatgttggccaggctggtctcgaactcctgacctcaggcaatccacccacctcagcctcccaaagtgctgggattacaggcgtgagccactgcgcccagccaggacggccacttctaatccatattcttttccacagctgcagccacagccatgcagcgtcctttagattctccttcttcttgagtatttttatgtcttgcttatcaccttgtttcattgcaaatggaatagtagcagtcagcatcagtgcacgctttacaattaatgagtgacgatggagggatacctgactactgtgatgctcttcactttttttgttgtcttattgggttttttgtttatgtttcatatgttaaatttccgacgtacgcgtgacctggtgtcagcatctcccgttcatggcccatcccgtctcacctgtccccactcctgttttgacttgaagctactcccagaatcctttcatttcctttctaaacattttaacacacatatcctcacaataaggactttctttttaatatagtcacagcgcaattagcacattcaaaaataatttttcacctgcagtcccagcaactcaggaggctgaggtgggaggattgcttgagcccgggaggttgaggctgcagtgagctatgatcacaccactacgctccagcctgggtgacaaagcaagaccctgtctcaaaaaaaaaaaaaaacagtaaaaataataatcataataattttttaatatgatcaggtaaatctagccagttttgaaatttctagttgcccccaaacttcataatggttttattttctaaaattattttaatttaggctgggcgcaatggctcacgtctgtaatcccagcactttgggaggccgaggtgggtggataacttgaggtcaggagcttgaaaacagcctggctaacatggcaaaacctcgtctctactaaaaacacaaaaattagctgggtgtggtggcacacacctgtagtcccagctactcaggaggctgaggcagtggaatcacctgaacggagaggcggaggttgcagtgagccgagatcgcaccactgcactccaacctgggcgacagagcaagactccgtcttaaaaaaaaaaaaaaaaaaaaaaatttgaatctcgattcaagtaagatccacacgttgcagttggctggtgtatctttaagtcttggtcattgtatagattccctcttcgtcactttttcttttccttgcaatgtatttgtgctagaaatggggtcatttgtccagaaaagattctccaccccactgctgagattttactgattgcctccccagaaatagtttatcatgctcctctgtcctcatgctttcctgaaaatttgtggttgaatctagaggcttgatcagattcaggctagaagtttttggccaaaagcccctttgtgggtgattgtgatgatctcgcgatggtgtcaggtactggaagtgagcgctcaccagaagagaaaggtcctgactttgatacacaatcataatgaatccaggcatggagcttggtggtttacaaaatcttttcctttctttttgtgttcttgttttatcctcatgctaatttctttgaatttcatggctcctcctgtataggtgactgtccagctcagaagtctgtccaaggtcaaacaactaaaagacaatgggagggccgggcgcggtggctcacgcctgtaatcccaacactttgggaggccgaggtgggtggatcatctgaggtcaggagttcaagaccagcctgaccaacatggtgaaaccctgcctctactaaaaatacaaaaattagctgggcatggtggcaggctcctgtaatcccagctactcatgagactgagggaggagaattgcttgaacctgggaggcagaggttgcggtgagtcgagatcgtgccattgcactccagcctgggcagtagagcaagactccatctcaaaaataaataaataaaaatttttacaaaataaaaatgcagtggagaagaattccaacccattttccaccagccacactcttttctgtagaccacaattttcctaatttcacttgattttaaagaacaaaggaacctgcacacccagcctgctctccacttctttgggtagagcagggctgttagaactctagagagatgcaggaagcagccgccgatgaacccagatgctcatccctggaggcactgtgcggtctcaggagcagaagccgaatgaattatgcaatatcagagcctcattccctgggccgcagctgtcccatgttccctgcctggagatgactgaagcccgagtgacagtcacaggctgttcccgatcacgctggggtcacacgctctggtgagcacccagccggccagagctgtgctattggtttggcacaggtagaaagttgaccccgcacgtgccgtagaaggtcatttcgttcggttcatcagctatactcggactggctaaaggaagattttattgaaatcgtttcccatgaacacgtcaacttgtggggcaggaagggaaattttcttcccgtttgggattgaaaagatgaggcttaaccaaactcgttcttatgttcgttggtttgttttttctttctttctttcttttttttaaacagactctcactctgttgcccaggctggagtacagtggcgtgatctcggctcactgtaacttccacctcccaggttcaagcaattctgccaccccagcctccttagtagctgggattacaggcgcacgccaccacacctagctaatttttgtatttttagtagagatggggtttcaccatgttggccaggctggtctcaaactcctgaactcaagtgatccacccaccttagcttcccaaagtgcttgggattacatgagtgagccactgcgcctggcctaaacttgtttttaatcattacttttgtatcatttaaattagtataatggtaatctacagagaacaaattctggttaatttctgagcagacagaggtgacatcctggccgtttaactgtctctcggcacagtgttacttccagcaaaaatgaaaaccgctatttccagaaggttatctgtagggataaagctccacagactggaccgactctctttccaggcctttgattggggaggggtggggccaccgtggagtgtgacacatttgatccggggcttggcagatgcaagatggcttcatcctcccctctacttctgccaaagcagaagtggtttaaccttgggtggaaaacgaaagatagggcaagtcatacagatgagggctgccaagaaaacctttccccgaaaaacactctctcctcccctcctccccttccccatcagcctccgtgtcttcagtcctgacctggttcacagatccgtgttgggcacggggatgagtgatgagtggtgagctgggccacctggttctgcactccaggacctcacggtccattggacaaaaagaagcctaattctgggtctttcaatacttctcccccaagactattattgccttgtttttcagaggctctgaaaagcgaatcattttccttctgcaataacatcttgtaggctctttccttaaaagttgtatttacaatttgccaaaagaattctaccctttctgccctttagaatactagccagtgaatggctgtctgtcaagaagacaggggacctcaggtatcacaggtgtcattaatttgcatatttgggccggtgcggtggctcatatctgtcatcccagcactttgggaggccaaggcaggtggatcactggagatcaggagttcgagaccagcctggccaacatgatgaaacctgatctctactaaaaaaatagaaaaattagccgggcatggtggcgcatgcctgtactcccagctactcgggaggctgaggaggcggaggttacagtgaaccgagatcgccccactgccctccagcctgggtgacagagcgagactccgtctcaaaaataaataaataaataaataaataaatttgcatatttggtcaaccagtattttgtgagtacctgctgtgttccctggaactatggcagtggataagcaagtaatcaatatatgaacaagagactttgagacgggaataaatgcaacagaaacaaaatgaatggacaatggagagtgtggctgtggagaggcctctcagaggagggccaggagggctgagacccaggcctgtaggtgggacaagcatggtgcttccaagaaacagaacaggactaaagaggctgggcacggtggctcacacctgtgatcctaacaccttgggaggccaaggcaggcagatcacctgaggtcaagagttcgagatcagcctgaccaacatggtgaaaccccgtctctactaaaaatacaaaaattagccaggcgtggtggtgcacacctgtaattccagctactagggaggctggggcattctcaagaatcacttgaaccccgaaggcagaggttgcagtgagctgagattgcaccagtgcactccagcttgggcaacagaccaagactccgtatcaaaaacaaacaaacaaaaaaacaaaaaacaaagaaatgcccatcttttattttaaaaatcttaataaaatagggatatagttggatatttcattaataaatgtatatatataatgtattttatatataactacacattaatgtatgtgttatatatatataatatattaatatatatatattatatattactcaagaacatgagtaagttcttgagtggtgatttgtgagatttaggtgcacccatcacctaagcagtatacactgcacccaatatatagtcttttttccctcacccccctcccaccctttccccgcaagtccccagagtcctttgcattttcatcgcttagctcccacttacgagtgagaacatacaatgtttggttttccattcctgagttacttcacttagaataatagtcttcactcccatgcaggttgttgtgaatgtcattaactcgttcctttttagggctgagtagtattctgtcgtgagataagaaatattcaaagggtgtgggaagagactctgccgtctttatttgcagatgtggtcacaggatgcctcgcaaccccgagagagccactgaaaagttgttacaaaattgaacaggcttccatttccctgtggcctctctctctagacagccgtacctctctatcccagtgtcccctgctcagtaaatctgtactcatcctccagggtacagactggatgtcccctactccgggatactgtttctcctggtgtctgcagaggcccttgtaccactttctgggatgtcactgtgctgaatcgctggtggctgccatttccttccgcctcccactgggtagacaggaagggggtccctgcccacccacccacccatgcccggtatatccctgctgagctcctaggatgtgcagggtgtattcctgtgtgctagcgagaagggagtcccagcgccactacgccattgcccactcctcccctgggacatttgtttcccttgggtgtggttcatggtaggtgccccatgggcgttattggtgggagacctccctgtctcagtctgagctgggcccatcgccatcagggcacgacagccacagcaggtgcctttgctgggagtaatcttgccctggctcgcatgagactgcagaccagcccttctccgtaagttcaggcgtttgtgctccgatcagcttttcctataggtttgtcccccaccccttgcccaactctttgaccccccgagttaaggggattccagacctagagccaagtgaccttcctcagagcctggccctgtctccaccgcttcagcaacctgctctttctggacagggtccagcgagccccacctctgtccgtttcctctaccccctgtgctaaggaagcctcacctgcagtgtaggttgtggtgaaaaatgtccccccttaaggacagagcaggtcatcacgtgcagccctggggtagaaggggagagttcgcttgatcaaacctaactggagcttttcttttaaagcaggaagaattaatctgtagatatttctcctttcaatgccaaagaactttatgatctggtattgagactattggtgggttttttttgttttctttgtttttttgttttgttttgtttgagacagggtctcgctctggtacccaggctggagtgcagtggcacgatctcagctcacttcaacctctgtgaccggggttcaagcgattcttccgcctcagcctcccgagtagctgggattacaggcgctcgccaccatgcccggctaatacttgtatttttagtagaggcagggtttcatcatgttagccaggctggtttcaaactcctggtctcaagtgatccacctacctcggcctcccaaagtgctaggattacaggcgtgagccactgggcccggccgagactattggcttatgaatcaagtctaagaagatacactagtctttgaaggccgctctgtatgtttttccaactgccttgtagatatactttgttttaacagctcgttttaacagctcctgatgccagcgtgcttatttgggtattgaaatatgcgccaacaccgtgccccgatgccacgcgttagcccccaggaggcttgcgtgaaagtaaatactagaatttccagcgtggatataatttcccttccatcgaccttgaccatgtccttttcagttcctcataaaaactgtgtgttagcccagagaataccctgaaatgatctgtggtgaactgattgaacgaactacatattctaggccaaactgaaattattcgctatttgaagtcagagctgagcataataccgggcaggttaatagatcagtggaagctgtttcgtcagctcataaaaacgtgagagatctaaatttttataataaatcattttgctgagcaaacaatatgtgcggttattacagactttggaaaataaatgattttagaccaatgtcaggctgcagatactgatgtggttagttgagccttcagcatgaagagaatgaaaaatctttggaatactgttgacactcacaccatgaaaccacatgccatttaattcattactgcgcttccaagattacatttacagttgtggtattaacccctgggcatttttgtattacttattgcagacagtttgtcaggcaggattaattcagtggggggaggaggcagcagtttggagagaaagtggatgattaagactggggtggggctgggcgcgtcggttcacgcctgtcatcccagcactttgggaggccgaggcgggtggatcacctgaggtcaggagttcgagaccagcctggccaacacgataaaaccccgtctctactaaaactacaaaaattagccgggtgtggtggcgcatacctgtaatcccagctactcggaaggctgaggcagggagaatcgcttgaacccaggagatggaggttgcagtgagctgagatcatgccattacactccagcctgggcaacaagagcgaaactccatctcagaaaataaaaataaaaatacaaaaattagctgtgattgggtgtgcctgtaattccagctacttgggagaggctaaggcaggagagtcacttgaactgggaaggcagaggctacagtgagttgagattgtgctactgcactccagcctgggcgacagagtgagactctgtctcaaaaaaaaaaaaaaaaaaaaaaaaaaaaaaacctggttgggaggtgccccaaagcaagacccgcctccttggtcctggtctgcaaacactgatggccacactcacatcttccaaagcccccgatcgcacttactcagctagttgtatttttctttcggcttttaaaaaagaatacctccttagaaaaattaataatgggccaggcacagtggctcaggcctgtaatctcagcattctgggaaactaaggcaggaggatcgcttcaggccatgagttcaagaccagcctcggcaacatagcaagatcaactttgtctctacaaaaaagaaaaaactagctaggtgtggcagtgcatacctgtagtcccagctactcgggaggccaaggcaggattgtttgagttcaggagtttaagaccagcttgggaagcattgtaagacccctgtctctaaaaaacaaatttttcttttaaattagctgggcttgctagtgcacacctataagtcccagctactcaagagactggggcaggaggatcacttgagctcaggacaagagttggaggctgcagtgagctatgatcgcaccactgcactccatcctgggcaacagaaccagaccctgtatcaaaaataaaaaagaattctcagaaaaatgagtaacaaacatacagatttttgtttgtttgtttttgtttgtttgtttttttgagacagggtctcactttgtcacctaggctggagtgtagtagcaccatcttggctcatgctcctcctgcctcagcccctcaagtagctgggactacaggcatgcaccaccacacccggctaatttttgtacttttagtagaaacggggtttcaccatgttggccaagctagtctcgaactcgcgacctcaggtgatccacctgccttgccctccccaagtgctgggattacaggcatgagccactgcatctggccgacttttaaaataataatcagagcgtttcctcgccaactgcatccctggttcctcccattgtctcctcctgtggtttctggtcccttctgtgaatggagacagcagcccctccgagcctggctgtcaccacaatccctggtatggaataggcctgccctgcaactgcagagtgtggtgtcgtcattgtcattcgaaagcctggggaaagagagttgcttttgtcatgaaaggtaagtgcagtccttgttatcacattcagtattttggtccgtttagcagttgcttagtaaccaaagcacaactgaccaggagatggaaaacttgaaattcacttccaggattgcctcacactgccaagtctgcaccttcccgcgtcagtgggactgatttttttataaatgatgtgaaatcttctggagatgaggcgtggttttccggatattcggtgtcctgatgaaaatccaaagccatgtgctatctgagaagaaatccagagagtgtgcactttccaggaggtgcccaagccccacccaggccccataaacctggcaggaactggactcgacccacatggaccccagccctgccaagccggcctctgtgtaaagctgggcccctggaactttgctcttctctatgcctgggcctttggccactggcaacaccaggtcgcaagtgaggagtggatgaaagcagccaggggcgggccagcacccccaggcagccacgcctccagcttttcagctccgcactcccaagatcagggagctgcacccagggagacggtgtcctcctgttgctgctgctcccggaagagtcaaggctaagtaagctacctggccagagggttttcctggttgccaagcagcagggaggagtcatcggcaaggcatctcagagatgggggccatccccttcccttccttcctatgttcggcagaaaggcattgaatgcctaccgtgtgtttttctccttcaattcgcttgagagacacgcagcagggctggcttctctgtcctcccaccgtgtacattgccagaaagagcggctggtatccctggaggacccaaacacacaagcaaaaacagctgggccccagaggagggcagtgcttctgaaagacacacccagaccccaacagtgggtgtgatatgaggcaggacagctgggccacaaagacaaagcaccacaaaggcactcagggaaacagaggaagatattggcagtgtgaagcgaaaccaacaggtaattttcaaatggaccaagtggaagtaacagcgtaaaaaaattgaataacttaggagcaaagaagaaaggatacattgccagctgggtctgatggctcatgcctggaatctcagcactttgggaggccaaggccagagggttgcttgagctcaggagttcgagaccagcctggcaacatagcaagaccccatctctataaacaaaatgtttttaagtaaataaataaaagaatcaacacaagcctggaaaataaagatgaagatatttcccagaaagtaactaaaaagatatagatgtagatgttagaaagaaaagaaaattagagatcaattcaggagctccaacatccacctaataggaattccagaaagaggaagtagaaaatagttcaggtgcagtggttcacacctataatcccagcactttgggaggctgaggtgggaggatcgcttgagcccaggagttcaagaccagcccggataacatggcaaacccccatctgtaccaaaaaaaaaaaacaaatagaaaaattagctaggcatggtgacatgcgcctgtagtcctagctgttagggaggctgaagtgggaggatcgcttgagcccaggagactgaggctgccttgagtcgtgatcacaccactgtactccagcttgtctccaaataaataaataaataaataaataaataaatagctaaagaccagttagatcaagttaaccttgatccagaaggcagcaagaaaaggataaagaaatagcaaaatataaaagaaaagttaaatgacatggaagacagaagtagctatgccaacaatatccaaataacagtagtctcaaacagaatagaagtattcaaatgaaaatagccagaattaaagaaagagagggcttatataggggcacactggagccattaggaaaagtgctcacctagacccacattcagtgtctcttcactcaccagccggaccagtccccatccacctcccaagttctgcagccagctctgctgatgcattcagaggaggatttaggcaattgtcaacctctgcacatcttgttgtgggtacgcagcagctatgtattttcattgtcatcttttaaatctatgacatagatgagatacgcaggacctaagcctgcatctctatgtgcccattccagcaccaggaaacttttaggggtctgaaacactagtggagctagtgaatgagtgaatgacggtagccagggcagttttgacctgtgtatgtggacattggaaatacacgataggtaactaactgaagtacaaaattgtgtttaaaacttgtgatttgggacaggcgcagtggctcatgtctatagtcgcagcactttgggaggccaaagcgggtggatggcttgagcccaggagtttaagaccagcctgggcaacatggtgaaaccttgtctctaccaaaaaaaaaaaaaaaaaaattaggtatgctggcgtacaccactagtcccagctactctggaggctgaagcgggaggactgcttgagcccaagaggcagaggttgcagtgagccaagatcacaccactgcactctagcctgggtgagagtgagaccctgtctcaaaaagaaaaaaaaaaacaacacaaaaaatccttgcaatttgccttaagtaaagtttgcaagcttttattttgtgtctgaaggagtttacgctctgaattcttcaacagggcgtcaaggtagcagctttctgcattgactggtgattatccttttctgatatgttttaagacccttaacacttttaatttttttaattaccatttgtagtattagactatctttgcacagcaatttttctgtcagatcttggaggtttcactttgagatgatacagaaggatgtttcatcatttaagaagccctgacccttccccactccctgcacccagcactgtattgcagaggcccagtttgggtatttatcttacagagacgctgccttcttcatgaaatcgtcctaaaaatagcttcatttaactaggccatttgacaggctttttcagactttttctcagaccagtctgaaagccggatattatttcaaacagatacaatgaacattgaacccgatcacaaggcatctgttaccctattcaggctgctgggagttgataagactacctcaaatcgctgtgtgtagttaaaggctgcaaaagcctcaggccacaaaaattccccagcccaggggcccggagacagtttttccaactctcagcgtccagggtgtaccttagcctgttttctgttgctgcaacagaacacctgaggccagggtgatttataaagaagataggtttatttggctcacagatctgcaggctgggaagttcaaggacatggccctggctcctggcgagggcttccatgctgcatcataacagtacggatagggtcaaaggggaggtggatgcgtgccaagagggacaacccagggaggttcctggcattatgataacccagtctcaagggaactcatccagtccctaaagtctggtcagagcaagaactcattcactgccaggagaatggcaccaagccattcatgagggcatccactgccatgacccaaacacctccctctagaccccacctcccaatgcccccacactggggatcaaatttcagtagcagttttggtggagacaaaccatagcagggtgggtgggtactctcacttggacgtgcctccttgggaccatggagcaggtttcggaaggatagaactctcattgtcaggcctgtccagcaccctgggctgtccccaggagtagacttgcccgtcacagacaggatgggccacatccaggactctggcatccaacgtgacgtgcagccctgtgaatacaggacaaattctagggatatagggcaaaagggacctatggcccagcattcagagagagctcacagcgtgggcacccagtgaaaactcaaacctggaaactaggactagggacagtgccacttcctgagacagagctgctgagagggtctgggaagggtggatggggtggaagtaggagatgaggttccctgggacgagaaggcattcaggcaggcggcgcaggtggaggcctagtgccgaggaaggcctggctctttggggtcccgcacgagatgggagttgttagagcacagggtcctgagaaagagtggcgggtaaggccaagaggaggaaggagccttggcatggaagggccttgcgtgtggctgagggagggattgcatcctgaaggcagcagagtgcaggtgcatgtggactcagagccacagcatgagagccctcaaccccaaccaggtccctgtggctgtaacattggctccatggcccttgggtatgctaaaaaaaaaaaccttccttgggtcacagacagttccagcctgtggccttctaacagagaccatcctcaggacctgcttgcagacattggggtggtggtctgcccgggtgtgctgctctaacctcccataggcttttggagttggccgtgcccttctcaaaaggactctccaggccgggcgcggtggcttatgcctgtaattccagcactttgggaggccaaggtgggtggattacctgaggtcaggagtttgagaccagcctggccaacatggcaaaaccttgtctgtactaaaaatacaaaaattagccgggcgtggtggtgcacgcctgtagtctcagctactcgggaggctgaggcaggagaattgcttgaacccaggaggcggaggttgcagtgagccgagatctcatcattgcactccagcctgggcgacagagctctgtctcaaaacaaacaaacatacaaacataaaagcactctccgcattcctctctcatgatgctctgtgttgggttcgcgtatttgccttcagattactcaaggaagtactttcaaaacagaaaaagggaaagacagaacctggacaattgcttttacgaccaggctgggccatagcaatgaacccaggctgtctgcactgcagcctgtacagtcccccaacctgtgtcaccatcctcacctgccctcctcacctccagttggccaccttctcctggtttcctcattcctggtgaggctttcactgccaagtgccttttcctaaagtagcctttccccagctcctcctctcacccccagcctggcaaacttctactcatccttcaaaaccccacttacctgtcacctcctctgcagccttccttgattccctcccacaaagagaatttatttctccctctttttttcagagcactctgctcagagctctttttgaacccttggcaggacatgctgtattttatatttttatggttatgtctccccaatgagattgggaccccatcaaaggcaggcaccccatacgcaccagacacatgattatcaaaagagcgcatggcatcagcaagcacatctcttcccccagtgtgagcccacctcctcctgctggacagcattgactcacgggtctgcacagcccttcccgagccctgagctaggaagctgtcccatcagtcaccccctgagccggtctccttgtgactaacctgctctctccctctcaccctcctagggccgacgagattgaaatgatcatgacggaccttgaaagggcaaaccaggtaggaccctggacgcttttagtcctaaaacccacaatagcgggcccgtttctggcatctcggaagatgcgtcacccgaagttagaaggccggttatccttccattttttactgacagctttcaacgtcgatgctccttctgttgtcatgagaagtaggaaaagacataaaaagtcctaggaaccatttccttggcaaagtctttgatgtggttccaacatctcagacatcccatggtgaacatcccctccaaagtggtaactgtctccttttccctactccatctctaaacacccgtctttgtagctgtggcatccatgacagtgtagacatctcaccatggaattatcctcggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctcggagagttccttagtgtagacatctcaccacggtgttatcctaggagagttccttagtgtagacatctcaccacggtgttatcctaggagagttccttaccgccacgttctcatgggtcgcagccacttgctccaaagagggctctcagctgacggcccctttttggctgacacttggtgctcagagaggccttatggcaagtacccagcacagtgtccggcccagatcaggcacaggacgcatcttaaccattagcgtacttttgggtgattctaaatactctgcttcctggaaaattcagccatccccaaaaccccttcctccccccaggagcccacagaacaggaaaacattttgctttagctggtgctgctgttgctctgaaaagaaagtggtcccccagccgggcacagtggctcacgcctgtaatcccagcagtctggggggccaaggtgggaggatcacttgaggtcaggagtttgagaccagcctggccaatatggtgaatccccgtctctactaaaaatacaaaatttagcaaggcgtggtggcaggcgcctataatctcagctactcaggaggctgaggcaggagaatcacttgaaccctggaggcagcagttgcagtgagccaagatctaagcctgggcaacagagcagaaactccatctcaaaaaaatacaaaataaaatttaaaaataaatttttactacccagccttgggctgggtgtagtggctcacgcctgtaatcccagcacctggggaggccgagatgggtggatgacttgaggtcaggagtttgaggccagcctggccaacatggtgaagccccatctctgctaaaaatacaaaaattagccgggtgcggtgacatgcacctgtcatcccagctgttcaggaggctgaggcaggagaatcacttgaacccagaaggcagaggttgcagtgaaccaatcatgccaccatactccagcttggatgacagagcgagaatctgtctaaaaaaaaaaaaaagcagttactggaaggagttaccttcatcatagatcactattcctatttctcaagtttccaccgactccacctctctcctcaaggccagtcttgggcatgccttgcctttagatggcactttagggcaatctaatgtgcccaacaggagagcctggtttgttaaacgggagagccttatcctgtgaatatcagtgctctatccagaacaggttctctgtggtctcagaggcagtccccagctacctaagaagtttggcaaagcgaatgcacttctcaaggtgccaaagccactcggtggaccccagtcttaggagacaccagacaaggctgtagggacaggtgctggctccgcaatgacacgggttcagttcctaactcggtatttcctgtgtggccttgacgggtctcttaatctcttaaatttcttggtcataaaaaaatcaaaagaaaagtgaaccttgaggccattatgccaggggaaatacgccagtcacaaaaaaagacaaatactgaatgattccacctgtatgaagtatctagaggagccaacttcagagagacagaaagtgccacggtgactgccagggacgaggagaggagggaaatacgaagttgttgttaaatgggtacagagttttggttttgcaagatgaaaacattctggggattcattgcacaaccacgtaaacgtccttgacgctactgaaaagtacgctaatggttaagatggtaaattttatgctttgcgtagtttgccacgatttaaaatatgttaaaaaattttttgaaagaaaggaagggaatttagctaatgcttcctttgcaagattgtttcgaggatttgaggtaaaatgccagagtaaaaagtagatggtggccgggcgcagtggctcacacctataatcccaacacttggggagaccgaggcaggcggatcacttgaggtcaggagtttgagaccagcctgggcaatttaacaagtcccccatctccataaaaaatacaaaagttagctgggcgtggcagtgtgcctgtagtcccagccactcgggaggctgaggcaggaggatcgcttgagtccaggaggtagaggttgcagtgagctatgattgcaccactgcaccccagcctaggtgacagagtgagaccctatctcaaaaaaaataaaagaagtagatgcctaaataaatgttagttccgtagctgctgaagaagctcaggttttgggggaattgtaaagtcctgccttcaggaaagggtggtgaggggtagaggtgagttctcaccaacaactcagccagagtttatagcctgatacggctacattaatagaaatacagtttctagaatgaaggaggtggtgattctgctcattggcagcaaggagtccgtgcctaggaaattccattttttaaatttatttatttttcttctttgaaatggaattttactcttgtcatctaggctggagtgcaatggcacgatctcagctcactgcatcctccacctcatgggttcaggcaattctcctgcctcagcctcccaagtagctgggattataggcgcccaccatgcccagctaatttttatagttttagtagagacggggtttcaccgtgttggccaggctggtctcgaactcctgacctcaggtgatctgcccaccttggcctccctaagtgctggggttacaggcaagagccaccgcgcccagccggaaattccattttagactggaagccacagtataaggaaaacagctccttggagtgcattcagagatgactccatggccaggacagggaggggctctaacataaaaagaactagggggttcggagacgttcctaatcttggggtagcagggaaagacggcagcaccactggacagcaggagcaagaggaataatttcaggaatctgggacgcgaaaagataagggggaagggtcatgggggcatttgtgggttctgtccttgtagttctcaagagccgaccagaaagaaaggccaggggacggagccaggctttttctgagagacccctgtagaccccagccaagcatagaggctggcgagaggaaacttttttgtttttgcttctgagacagtcttgctctgttgcccaggctggagtgcagtggcacaatctcagctcactgcaacctccccgtcctgggttcaagtgattcccctgcctcagcctcccaaatagctgggactatgggcatatggctccccatcctgggttcaagcgattctcctgccacagcctcccgagtagctgggactacgggcatatggctccccatcctgggttcaagcgattctcctgcctcagcctcccgagtagctgggactacaggcatatggcaccacgcatggctaattttcttatttttagtagagataactcctgggctcaagcgatctgcccacctcggcctcccaaagtgctgagattacaggcacatgccaccacacccagctaattattgtgtttttagtagagacggggttttgccatgtttgcccaggctgctcttgaactcctgggctcaaacgatccacccacctctgcctcccaaagttctggggttacaggcatcagccaccatgcccagccaggaagcttattcccagtggtctggctctccagagttgccacgctgaaagatgcttgctctggagagagtgagctccctgtcaccagagctatgcaagcagattcaggccagccctcccagagagcatgagatggggaatcacgcacagagtggaccgaaggagggattgaacaagaaggctcaaagggtcccttttgaccctgaagtctaggatttcgtgaagctacaggtgaacccattggcatgagaagcatccagggaggaaagatgcaagcccttggaatatcgagagaatatttccagcaggaaaagaagtggaaggttaaaggaaagccagagaaggggacgttgccctgggccatcaactaagagaaaagctgcccagagccaggcatggtggcggcggtgcctatagtaccggcagttggagaggccgaggcaggagcatcacttgagcccatgagtttgagaccagcctgggcaacatagtgagacttttttctctacaaaaaagtttaaaaaaaaaaaaatagccaggtgtggtggtgtgcacctgtggtcccagctaacccaggaggctgagatgggaggatctcttgggcccgagagttcaaaaccaacaccagagatgcgggtcagagagtgggctggtaggacgggacctggccaggcctgtgggagggtctgagtatgaaggattcatcctgggagcagtgaagaatcgtaggcgggattgagacatcaggtttgagttctagaaggatctctctggctatacattggagaacagatgggagtggaaagaccagaagccaggagagctgtgggaggctattgtgtaagtatggggagagatggcatgggcctgagctgaggccatccctgcggaggtgagctggaggcgggctgggcaggaagaggagggcgcagacacagtccaacactggtgcaggtggcaggcatctggaccaacacctttcccatcaggaaaccccccaggaggagcaatttactagctcactggcatacaacattcgttttccctgggtgtgtagttagaatgttctacggagacctgaagtgctcgtttattgctcaaccactgtgctcctgttatggagaagtagcagaggggtcggcacctgtcagttatgtccgagcctcattcacacctgtttgttgaacatcagggcactggcataaatactcactgtcccaattggtgacagtaaaggatcagatctcttgagacttcatggtcaataagaagccacagctttacactttgaactgcatgtgaaaccccgtcccgtccgggggctttcagcaattcacagcctttttgtggtgaaaaaaagtggcccgcccaccacccctccggggcctcctttctgagcagtggtgatccgagttgctggtgggtctcaaactcctgggctcaagctatcctctcgccttggcctaccaaagtactgggactacaggcatgagctactgcgcccggctttgaagccagcatttctttactacctacgaggcctgctcagagtccgtgctcaaaaagatgtattgaatgaatatgggctttgacgcacaggctggagcgcagtggcatgttctcctagcccacagtggggctgggagggagtcattgaagtgagctgccctcttcctgttcacctgcctggtgtttatgtcacaagactgccctagtggaggactctccaggttgaggttaggggttggaaaccacagctgaccctcaccacggagagtgggtctccatggaggccttggccactggtgcagcatcagcgtgggacacgtggtggtcagcatttggtctccagctgtggtagctgttcccgacctccttcctgcagagtcagtgacatggagttacctctgggagtcgagatgttcactgtaattgcatgctgcgggtagggcagcagggccttagcccatcatcagctcctgggtctactttgttcctcgggggacttgctcatctctggtgtcctcaagcctgagttttaatggccatgcaagcagagaacaagagacaaaacctggggccaagaagggggtggaagattggatcagagaaaacccccctcccccgccatataaaaccagggacttcaaaggccacactctgaaagtgtaaactggcagggtgggggaaggagtctgcccttaaaggggagacggtgagggttctctcttgttggttccagagggagaagaaaatgagcctcccaagagaattcctaaccacagccacctctccacaggtctggggccatgtcgcacatgagaccccccagccctctccccacaccttcgccccaccaggctgcagctggcccaaggccctgtctttatcctctgcaagcccacccctctctgtgtccttcccatgatgccttaccacgttttatgagtcaaattgttcagactttagaggcctggaagtagctgtctacatcctgtattcacatcccaatcgggcactgcggttaggggaaagcttttttttttttttttttttgagatggagtctcaccctgtgacccaggctggagttcagtggcgtgatcttgactcactgcaccctccccctcccagattcaagcaattctcatgccaattctcatgtctcagtctcccaagtagctgggactacaggtgcacacccccacgcccagctaatttttgtatttttagtagagacaggatttcaccatgttgaccaggctggtctcaaacccctgacctcaagtgatctgcccacctcagcctcccaaagtgctgggattacaggcgtgagccacagcacccagcaaaagcatttacttaccatccttcctggggcctttcagggacccttgagggatgggcaggggttggggggcccgtggaacttcttctaggatgaggtgacctcgtggacccctggttccggctctccttccccaaatcacccagtgaggaatatgacaccagcccagggagcagaaaagcctccttcaccttccccagagaagcgaggctcccctgggtctcacggtggaaaccatctctgtatttgctggcttgactctaacaggaagaattcctgagacacggtgtcgctggctgcttgctacctcccaggtgactgctgaggggaggcagagtttaacctgatgccagctaagagtaatttcccccaaaagggtcttccattttgagatgaggaggatgtgaggtgtgcctggggccacacatgccagggaccttcgtgacaatgtcctggacaccatcgccaggtgatgggcatcggcttgtgtgagccccgtggccaccagtccccttgccgggtggctgttttctgccatcgtggtctgggttaccactgatatgcaagcagtatcctcctcgcccctgtgtttctagcatcaactctgatttctcagcaaatgacagagaatagacaagaaagagcaagaaagatctcccaggacagtgctcaggcttggcgaggggccgttctcatggtggggcagacacaaaagtagaacgagggctcccagtggccctgtctctgcagggacacaggaggagacgggagtccggcggtgaccacagggaagtgatgtctcagggccgccaccgctagatctggggttccagatctagaaacacagctacagctggtttaacaggggtcttcaggaagacgccagagcctcaaaaccagtgtcaccacacgccgacccgggacagggcccccttcttcctgcctcagctgccaatgatgggctacgcttacttctcagctcctgaaatgaatttatcccagctccagatcagtgtctgtttccctgttccttcctttcactgccattaggcctgtttttagtttgaattctcctgtttcgtggatctcaccacacaaaccacctcaacgcttcattttgtgagttttgtattttttttcgacgccctcaggacagaaatcctgaataactatgtgatcagaaagttgcgtgaaagtaacgaaggcaagccacaagtgatagaagtctgacaccgtgaccgccaacagatgggccacagagagactgtccgtgaacttggaaactgattgcaagtgcaaatgctccacagaaattatgcaatcaggccgggcgcggtggctcacacctgtaatcccagcactttgggaggccgaggcaggtggattacttgaggtcaggagttcaagaccagcctggccaacatggtgaaaccctgtctctactaaaaatacaaaaattagctgggcgtgatggcgggcatctgtaatcccagctactcaggaggctgaggtgggagaatcacttcatcctgggaggtggaggttgcagtgagccaaaatcataccgctgcactccagcctgggcaacagggtgagactctgtatcaaaaaaaaaaaaagaaaagaaaagaaaaagaaagaaattatgcaatcagaaattgaaatcatcaacagctagatcccttcttttgtgaaccatcaccctgtgatgagatggtatccgctctgaacggctaaatgcctgcttgagaccatgtaggctcccggggacaccttgtaaccagatgcccgggacttccccagcgctggccgttccagaacacttcagagccagtgttacaagtcagggtggtgaggccacctccttggctgccaccagaacagcttctccactaggctaagaaataggttttctagcccaagagaccaggagaaatatctccaaatacatcttattccaggcagagtcttagatattttctgcccaagagttgaactgaccagcaagggaggcgtaagctcttcagtgatttgacgtgatcatcagaaacacttggcatgacacatctggaaataaactgggaaaaatcttttttgttgaagaggacatttttctgtagtcttaatagttgattaggtcggatgcagtggctcacacctgtaatcccagctctttgggaggccaaggcatggatcacctgaggtcaggagttcaagaccagcctggccagcgtggcaaaaccccgtctctacaaaaaatataaaaatgagtcggttgtggcattgtgtgtctgtaatcctagctactcgggaggctgaggcaggagaatcgcttgaacccgggaggcggaggttgcagttaactgagattgcaccactgcactccagcctgggtgacagaatgagattccatctcaggaaattaaaaaaaaaaaaaaaaccagttgattaattagcatgaaccagaaatcacctctacagtcctggacatacaggtcaccttgccaccttcctgatggctggttctagattcagtgtggacgagagatagtgacagaggtgacctgcttgggcctagacacacccacccaggcaccacatgaattcaactgaatgtaattccaagagctcctggagaggcaaggcaggcggccaccagcaccgccctgggcggacggaactgccattagaaatatcctaaattggctgggcgcggtggctcatgcctgtaatcccagcactttgggaggccgaggcaggcagatcatctgaggtcaggagttcgataccagcctggccaacatgtgaaaccccatctctactcaaaacacaaaaattagccaggcatggtgggcacctgtaattccagctactcaggaggctgaggcaggagaatcgcttgaacccaggaggtggaggctgcagtgagccaagatcatgccactgcactccagcctaggcgacagagcgaggctctgtctcaaaaaaaaaaaaaaaaaaaaaatcctaatttgtctgtatgcagggcaaatagattcaatgctgttgccacagaattgcttaaagctgccaaagccactcctcctagaactagattaatcagccagttccaggacaggccaacttcttgtttgtctttctgagtcctttctcagccattgttagccacacgctgccatgccacaaaataaaacacacgatggagacgctgcttggccaggcttttcttttcttttcttttcttttcttttattttcttttcttttcttttattttctttttttttttgagatgtggttttgctcttgttgcccaggctggagtgcaatggcgtgatctctgctcaccgcaaacctctacctcctgggttcaagcgattcttctgcctcagtctcccgagtagctgggattacaggcatgtgccaccatgcccagctcattttgtgtttttagtagagacgaggtttctccacgttggtcaggctggtctcgaactcctgacctcaggtgatctgcccacttcagtctcccaaagtgctgggattataggcgtgagccaccgtacccagccaattttttgtatttttagtagagatatggtttcaccatgttggccaggctggtctcgaacccctgacctcacatgatccacccgcctcggcttcccaaagtgccaggattacaggtgtgagccaccatgcccagcctttggccaggcttttctgattgaatgtttctagcagtggaatgtaagtctgggaggaagaagcagaactttcacctcagcccacgtgtcccatgtcattcgccaccatctcccacctgtcttagaactgtgcctcagtcctaagtattaagccggcacaaggccattcacaaacgacctctgcctgagttgtgtgtcctgggcacttccgtggctagggaccgtgttcccattttccagacgggtaggcagcagctcagtgagtttgggtaacttgccatggtatgtcttttcccagacaccctgtcgggtggtgggcactggggtgacctgtcctcgtcatccagtgggaaatccccatctgctctctgggggtggttgtttccttgttcaggaattgcaggcaaatgatggaaaagtccactcatttgtcccgcagcccccagcactggtctatgctgtcctgtctacgtcctcggattggcctggttggctgaaaatgccaggatcagcattcaaaacactttgtccagtgaagggttaaatatgttgaaataagcccggcctttacaaaagcagtggcatttacatcctgtacgtttatggaaatccttgctgaagaaaaacaaccacaacattgtttgtgcgtgtttttaggaagagaatggccaaagtgtctttaattcactgtttacccgtgagaattactcccaggagtaatcccgcaataaaatcttcttggtctatgagaatagaaagaaattgaatcaaaagactcgatttccacttgtatttattcagtctgggaaattcagtgggccggagtattagtatcagcaggggattcctttgctcctagcgttaaattactgtcataatcgctcaattatttcttccttgtactgtttaaaataaaaatccatcacattctgtgttttttttcctagcatttattaggttgagtgtttaggaaaatcaattatagtcagtcaggcatgaattgatgaatgttcttgtaataattgtcagttgttaaactgaatgtactttctctttcaccccttttcatttccttcagagggcagaggtggctcagagagaggcggagaccttaagggaacagctctcatcggccaatcactccctccagctggcctcacagatccagaaggcaccagacgtggtgggtagccccggccccgtgggggactgtccccgcctggcctccgcaccttcgagttacagccgcttgctcctttttgttttcagcatctctttttgggaatcacgttttaactagtactgctttctcggtggggtttgctttgaccaattgggggccggagcttgttaaagtcgaaggaagagctttgctaactgtgcgtgggtgggctgaggctagcgtggcatccacccagggccaaggtggaggctacgcaggcacagtcacagacacagtcacgatgccccagccaggcctgggggtgtgatcgctggcatgcgggtgcagacccgaaccaggagcctctccagaatgacacggagaaattgagggtttccgctgtgcctttccaagatgaggaacagttcaggatgagctgggagggtaggggtgggcgggcagagaggtaataaaataacattctgcaccgagtttatagagcaggaagagtgggtatcacaccacttttttgcagcttgctttttctgaaattagcgcaaatggctcttagcccaaacattcccagctcgatcaaggtggctttgaactatgggtttccagactctctttcaatgctgtatagggacaaggaacagcgtaggagctaagaccttgggtgttggagccatagcccccagtgcagaccccagctcagcagtctggtgatggggacaaaggagcttaacgtccctgagtctccgtttccccgcctgtaaactggggggttggtgcgaaagttattatgagcaaataacttagagcaaagctggacatgtaataagactaagtaaaccttagcagtaattctagttgtagttggcaccattatctctgatccctcagttttgggttttttttttttttctttttttttctaagacaaggtctctctctgttgcccaggctggagtgcagtggcgcagtcttggctcactgcagcctccacctcccaggctcaagggatcctcccagctcaacctcccgagtagctgggactgcaggcgcacaccaccacacctggctgattttggtattttttatagggactaggttttgtcgcgttgcccaggctggtctcaaactcctggacttaagtgatcctcctgcctcagcctcccagagtgctgggattacaggcatgagccaccacgcctagcctgatccctcaatttctagcacataatttcatcactagttcacttacaaacctcagttttcccatgtgtaaaataggaattaagtgatcacaaggccgctctatggagccctcatcctaaggttacaatgagtacatatcagttgtaggagtccttttatccaacagtgactccgtcaagcccttgccgtatgctagggcttgtagtggacacccgaagaaccataaggagtaagatgaggctggttgcagagagtacagtctcatcagaagaacttgctcttgtaataaattcaatcattgacaatcattatttccacccaatctgtgaaacagaataccgttatttcttttttttgagagagagtcttcttctgtcgcccaggctggagtgtagtggcgtgatctcagctcactgcaacctccacctccacctcccgggttcaagcaattctcgtgcctcagcctcccaactagctggagctgcaggcgcataccaccatgcccagctaatttttgtattatttgtagagatggggttttgccacattgcccaggctggtcttgaactcctgtcctcaggttatccacctcccaaagtgctggggttacaggcatgagccactgcgggatctcactcggtcacccaggctggaatgcagtggagtgatcatggctcgctgtagccttgacctgggctcaagcgatcctcctgcctcagcctcccaggtcttgaactcctgtcctcaggttatccacctcccaaagtgctgagattacaagcatgagtcatcattcccggccctatttttttatatagatgaagaaacaaaacctccatgaatgtaaacaccttttcccaaagcacagtcaatctaatggctgagctaagacctgaattgggcgttctggcaccccagactgtggcttttaaattattccccaggaatgaatctagatcaaggtattaagactcccttctaagaaaagattttagccttctttttaaaattaacattaattaaaacatttgttgctgggcgcagtggctcacacctgtaatcccagccctttgggaagctgaagcaggaggatcacttgaggccaggagtttgagaccggccagggcaaaatatcgaaaccccatctctacaaaaattttaaaattagctgggcatggtggtatgtgcctgtagtcccagctactcaggaggccgaggcaggagaattgcttgaacccaagaggcagaggctgcagtgagttatgattgtgccactgtgctccaacctgggcaacagagagaaaccctgtctccaaaaaagtaaatatgagactgggtgtggtggcacacacctgtaatcctagcactttggggggccgaggcgggcagatcacctgagatcaggagtttgagaccagcctggccaatatggcgagaacctgtctctactaaaaatagaagaattagctgggtgtgatggtgggcgcctataatcccagctactcaggaggctgaggtaggagaatcgcttgaacctgggagacagaggttgtgcagtgagatcgtgccattgcattccagcctgggcgacagcaagactccatctcaaaacaaaacaaaacaaaaaaagatatgattgaagtgttcctggatgtagagaaaagatttgcattgagcaggccatcacgtccttcatacttcatggactctggaacttaattttaactgaatgtccccttggctctgttacagttccttcctctaagtttagacaaactggatccagcaccatggctagggtgggaggcagccttcaggacagggtcagcggcttcccctggcccctggggtcctgcttcattctgcaaaggaagtcgtccattctgatgtgtctacacggggcccctgagctcagtgttttggttgaaaagaattctggcactatcctggactgcagcaaccaaaacatttcagaaggaaatgaatgtttttgcaggtagagtccgttgtggatcctaggggcgcttaaacacttcatcatcggttaagtgccgtgtttacatggcaccggttcagtctccccagagcagccccgtggggctccccgcgggcgtgtattcccacatagccagtgggttccagctgcagccagttggggagcaaacataggaaactgggccagcggaaaaatggtctgttgggcttggctggcagaatgcagcagagaaacggtggagtctgtagatctagcaaaggccaaaacccatccattgggtatcccagtggaatctccgattctagaaggtgagcggtcactgagtgagctgctggcccaagtttgcagccatgctgggctttgcatagttttgtttgtttgtttgttttttagtgagatgtagccccgctctgtcacccagggtggagtgcagtggcgcaatctgggctcactgcaacctccactcctgggtttaaccaattctcctgtctcagccttctgaatagctgggattacaggtgtgcgccaccatacctggctagtttttgtatttttgctagagatggagtttcaccatgttggtcaggctggtctcaaactcctgacctcaggtgatctgcccacctcagcctcccaaagtgctgggattacaggcgtgagccaccgcacccagcctccctaaagctttgaaggccacctcttcctctctctgatttcctctctagcttttgcccatgtctctcccagccatcaccctatggactgacaggccgctgcttctcatccaggccccctggatcgctccccaagcccctctctgtttctttcttcattctcccttatgtccttgtgacagcacaactgggagtgcccactgtgttgagatggagtgagccacagtttcagataaaggaaggatgggccaggcgcagtggctcacacccataatcccagcactttgggaggccaaggcaggcggatcacaaggtcaggagttcgagaccagcctggccaaaatggcaaaatcctatctctactaaaactataaaaatttgcctttgccaggcatggtggcatgtgcctgtaatcccaactactcaggaggctgagacaggagaatcgcttgaacctgggagggggaggttgcagtgagctgacgtgacaccactgcactccagcctgggtgacagagcaagactccatctcaaaaaacaaaaacaaaaaaaacagatagagggaggatggtcatgtctgtgtcatttccaaggtcttactgctttggggttcattttcacctcatttagttcgtgcgagacagcgatgatttttgctgttttatgaaggaggagtttgtggcttgagttgctgggagttggccagtgtggccgagctcttgtggccatgcccagccgggcgcaggagttgagccctcgaccacccgctgcccggtccccactctgggtccagggacagcactgaaatccacacctttgacctgtgtcactggaagcacctgtcccagatacattcactttgacttgcgccttgtaaaacccacattcccttggctggttttactgacccttttcgtaaaagccctttaatcagtgtctatggccagcacccctcagggtggaagattaagatgaagacgtgatatagcatgattcaacctgtgcccagactgacctccctacatgtcacttctgccatgtcccctccttgctccagagctggcagggactccccagggctgccaccacatgtccaggcgcctctggctacccctggcagctgtcactcctccagccctgccccacactcctgccagcctctgcacctgcctgcatgtcctccgcccttccccggcacccaccctgagatggagccccctttccttccgacaaggtcccgccagccctcccgaggcccacccattcccccctcctgtggctcagccccacgtgccactgtcctggtcctcctaccctggagggctcgtgacgttggccctgcccggcattattcagagcggtgctttccagactccctgtgatggacagttttgttttgttttttaaatttccagtctgtggcagactgatcgttttatataaaagacatttaaaatgtcaccgaaatgccgaatcgctataaaagtttctaaacacttattctcgatttctgtaattgcctcactgtgcaccagcaacagtttgcaaattggcaacgatccctgcagctcacgctgcacagaacgggcctggacagcctgtgcctggtaaataagccgacaggagatgctcgctccagccccccagggccacgcgcacagctgtcagaggtcaggagaaccgaaacacctcttttacaacctcatacaaatcaaagaagcaggaaggagtaccctctttgcacacaaaactttacagacttaaatggtaaaggcctcattttccccgagggagatataaaacattatttccctgagtgaatgcctgcctgtccccaaatttgaaaatccgtggtgagcacacggtgcatgggatggcccagctgtacctgccagctggggccacggtgccaccctttccccacaatacaagcaagatcaggacgtgaaactgagcacttcagaggggggacagcggcaaggacagtggctttctgtgttacagcatgagctgcccccaggattcggctgtcatagacaccatgcagctctgccctctccacccctgtccccgtctgtcatgcccagaattgcatctgccctgcagaaaatatttcagaatctttcaggagccaggattcctttttttttttttttttttttttttttgctttgacacagagtcgctctgtcacccaggctggaggtcagtggtgcaatcatggcccactgcagcctcaacctcctcaagctcaagcaatcctcccgccccagcctcctgagtagctgggactataggcatgcaccacaatgccttgctaatttttgtatttttttgtagagatgggttttcgccatgtggcccaagctggtctcgaactcttgagctcgggtgatccacccacctctgcctcccaaagtgcttggattacaggtgtgagccacagcacctggccccgtgattacttttaaaggttgaaaaaagtactacttgagtcattgagaagtagaattacagatttgactttttcctttttttttttttaataccttagcttttttctattttgcgtattttccacaatgagcatttagtgaggttaaggggtgggtagccaggtttttttcacatcaattatcctaagagttcttcaacaaaggaacaccaaatatacattttccacatcttttaattcttttattaaataaaatactggccgggcacagtggctcatgcctataatcccagcactttgggaggccaaggtgggtggatcacttgaggtcaggagttcgagaccagcctggccaacatagtgaaaccccatctctactaaaaatacaaaaatgagccaagtgtggtggtgcccacctgtaatcccagctacttaggaggctgaggcaggagaattgcttgaacgcaggagacggaggttacagtgagccgagatcgcgccactgcactccagcctgggcgacagaccaaaactctatctcaaaaaaaaaaaaaaaagaaaagaaaaagaaaatgctgatacagagttttcaatttgtcagacaatatctcagcttccgggtaatttaacagtgaatctcaaggaccttgaatcccaccttgtggtggaaaatctcggtggtttgggagcattggagggaggcttcctcctctgagccacccactctgctgttcccctgcctggagcactcttccctcttccccaacgctcagcagcccctccccacctcctcctcctccaggtctctgctcacacatcaccatctcagtgagtcttttcctggccatcttactaaaccccctgcctctcagctctgactctggcctctgttttaagtctcctttgacagtggtcaccccgcacacttttcattactaataagtgtattttctgcatctcactcatcctgccgcatccctgctgggctgtaagccctgggaagacagggacttttctcctgtttttttttgtttttttgagacagagtctcattcctttgcccaggctgaagtgcagtggtacaatctcagctcagcgcaaccttcttctcccgagttcaagtgattctcctcctcagcctcccgagtagctgggattacaggtcaccaccacgtgcctataattagcccagctaatttttgtatttttagtagagacggggtttcaccatgttggccaggctggtcatgacctcctgacctaaggtcatccacccaccttggcctcccaaagtgctgggattacaggcgtgagccattgcacccagcctggactttctttgattcactgctatatggttggtacatggtaggcactcagtacatatttgtccagtgaatgaatcgaggtggcagctaaccacagggggaggaaggttgcataggggaagtgcaagcaagggcaagaagtgacatcctgccatcaccatccacacactgacatctgtgcagcttctgtctcagttgccagcacaggtagcctcgagcacccgcctcaaggccagcgcagttttgtcatctcttttctcctccccaggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaagtaagggggctgcggggcccgggggtggcccgaggaggcagggcggatggctggacacacgcgcacacacacaccctctgcctttctggacttgatagcaagtgtggcaaccttgaacctctgtaaagtagcaccaagcagagtcccggagtccatggcagggagactggatgttaaaccctggcatcagcccttgtgtaaacagcatttccctctttttttttggagtcggagtctcgctctgttgcccaggctagagcacggtggtgcaatctcggctcactgcagcctccgcctcccaggttcaagtgattctcctgcctcagcctcccatgtagctgggatcacaggcgtgcatcaccatgcccggcttatttgtttatttatttattcattcatttatttttgagacagagtttcattcttgtcacacaagctggagtgcaatggcatgatctgggctcacagcaacctccacctcccaggttcaagcgattctcctgcctcagcctcctgagtagctgggactacaggcgcctgccaccacacccagctaatttttgtatttttagtagagatggggtttcgccacattggccaggctggtcttgagctcctgacctcaggtgatctgtccacctcaggttgccaaagtgctgagattacaggtctgagcctctgcacccggctctttaactgagttttgcagggcatcctagctttctgaggatacccctacaggaggagctggtgtactataactccagcacttccggtgcatgagccaaatgaaaccccagaggtccatggaagtcacatctgaccttctaagggacattctcttgtccaagcaccttttccctcagtggcccctgtccaggtgctgcttcagtctaggctccctcccactaggcactcttggcttttccataaatttctatcccagacgcagaacccagagctttttccacatattaaaaagtaatgattatactttaggtatttatgatccgttgaagcaagtgtaatttgaagagggtcctgggacccttgattcacaggcttcagagccaggggagactctcggagttgtctgtcttgacagcgaagaaggcaggaccttcagggcagggcttcagccccaggccaggggttccctgctctgcccgggggctgcccgttcaggcccattccttccccaacccggtacctccatgttgggtgggtgagggaatgagtggctgtaaagtatattcattgtatgaataaagtgggtcagggttcattgtgaacatttaaaggaaaccttttctggtatgaagtagtcctaggatgtacttaggtccattgtgttttgtcgttgttgttgttgttgttgtttttgagacggattttcgcttttgtcgccgagactggaatgcaatggcgcagtcttggctcactgcaacctccgcctcctggattcaagcaattctcctgcctcagcctcctgagtaactgaactacagtcacgcgccaccatgccagactaacttttatatttttagtagaggcggggtttcaccatgttggccagtctagtctcaaactcctgacctcaggtgatcaccagcctcggcctcccaaagtgctgggattacaggcgtgagccactgccttttttttttttttttttttgaaacggagtctcactcactggcccagactggagtgcagtgacaggatcatagttcacggcaacctcgaagtctcgggctcaagcgattctccttgcctcagcctcccaagtaactgggaccctgggaccaaagacatgccccaccacacccagctagttttttaattttttgtggagatgggatttcactgtgttccccaggctggtctgggacgcctgggctcaagcaattctcccacctcggctcccaaaacactttgggattataggcatgagccgctgcacctggcccaatgtctttttttttttttttaattgaaattttctttttgacacatgaccaaatttataccaagactaagtttccagcaatctattgcctatgctgatggctcccacgaccctccctcactcctttcttctgcctctttggggtgaatttcacccattcactgagaactgcccagcgccgggtcccttggaggagacagtcctgccgactttggggaaatggttgaaacctggttctgtctgtcctcagccaggtcgttttttttaaatttttattttattttattttattgtattttattttattttattttattttattttattttatttgagacggaatttcgttctgttgcccaggctagggtgcgatggcgccatctccactcactgcaacctctgcctcccatgttcaagtgattctcctgcctctgcctcctgagtagctgggattacaggcatgagccaccacttccggataattttgtatttttagtagagatgggatttctccgtgttggtcaggctggtctcaaattcccgatctcaggtgatccacccgcctccgcctcccaaatgctggaattgcaggtgtgagccaccgcgaaccaggtcatttattttgtcaccgccgtttcttcctctctcatcagcttacccaatgagtaccaggattcagtttttatttctacatttaatctcattttctcatgttacagccatttctgaccccagcaacggcattatgatgagataatttgcctttctctccattgtcaagttaaagggcgtgactcagatacacaccggctacaagagagcaaagctgtagacctcacattttttattatagagcaatttcttccaaatcagttaaggtttcaatgtttgccttcacaaaaaaatgaaacgcggttttgcaaattaatgttcgttatccgtatcttgggggaattgtttaataccgtgcagttaatgaaacaattcagcgatacttcttccaaaatcattgctaccttatcttcatctaatctaataatcaaaacatatcttctagtaacaagacttctgattttaattatcttaactccttgttgccagattgtcctgatacgaaacccacatgcagaaagcatctgacttcaccaaaccagggtttcctctcgccccaaaggaataaggttaattgaatgagatatgttctgagggctttttgtttttcctaatgtgtataatgtatagcctcaaatataacctaaaggaatacaattattaggaaaatatttttatgaataagacttggcaaattggcaacctgatgcttttgccatggggaaccctgcccccgcagtcttggctactcaaagaactcacctttacttaccacggagctgctttctttctttcttcttcctgtccccttcccctctttcatgtcttacgggggaccctcggacacacgatggggccttgaatcaggttgctgtttgggagaggaggctccaagctcccagctctgggctcagctgtttggagttgcaggtggttttcccatgaacacttggcagcaggtccttgatctttgagacatgtgccagggtgtttggtgacagtcacttggggagagggcatttcccataagcagaaggcttattgggcagaatcttttgtcctgagttcactgagttgtttccacccatactttccaatgatactttctgtagttggatatatcagaggactgactaattggttttctttctctaacccattgaaattctccatctttctgccactgagatttctcctcttccctcaaatttgatttgttatttcacaaggataccagacagctgcacatcttcgagtctgtcctgtccagggctctactttttcaagcaaagctccccataaatgccccgctatccacgtgtgtcatgggacatcgctaacctttaattaggcatggaaacagacgcaaaagtggaagatgtttcctcctgcctaatctgacaagtgcttaagcatagtgccacttgtaaagaagaactgtttttgcaattaatgaaatagcccgaccgccgtgacaaggctgctttttgataactctctattctgtggtcttctgttggaatgctttaatatagaagcagtataattagctagtcaactgcactgtacttgctacagcacagaagataatgctaccaatagcttcgatttaaaatagatatttataagaaaggctaactaaaagaacaccagtctcccagaaggagaaattatatttttctagagatgcgttaaagatcagtgcttcccactgggtggatggtcacatgcgttagaatcacctaggggtcttttccaaactgcttctctttccccactcctgaggttctgatgggtcccatggagacactatgggatgatgctgtgtccctcggggcactgaggtggtataaaagaggtggtataaaaccgtccctctggccttgggtgtctctcttttcatcttgcattctcggagcccaggagttcaagaccagctaattttttgtatttttagtagagacagggtttcaccatgttggccaggctggtcacgagctcctgacctcaggtcatctgcccgcctcagcctcccagagtgctgggattacaggcgtgagccatcgcgcccggccccatctcttaatttttttttttttaatgagccagagtggtggcacatgcccgttgtcccagctacctgggaggctggggagagaggatcattggagcatacacagcacccaccccattgctttggagatttggactcaccgtccagagtccacagtatccttgggctcctccccaactcccagcatcagcagaacctaaatctccatgcctgctgcctctgcctgaggaaccatggagacacatgtccttatctatggagagtccttgtccagtagaagaggaggtgcatgctgcccaggcctggaccccagagatgcagtgtcagctaagggtctgtgcctcagacccctgccctgggccagggggtccccgtgagaccgaagactcccacaccaactctaacctgagccagtcagacagcaccatgtggagcctggccccatttatctgcactgcagatgccactctgcccccacggtcagaattttatggaaaagagatattgtcaccttgaccactggctgtgcaacctggaagacatgacctttccctgggtctctgccttagtcagacctgccagaggcccctttgctgtttttttgagacagggtctcactctgttgcccaggctggagtgcagtggcaccatcatagctcactgtagcctcgacctccctggctcaaggaatcctcccacctcagcctcccaagtagtcgggactacaggcacacgccaccacacccggcgaatttttatatcttttgtagagatggggtcttgctatgttgcccaggctggtgtcgaactcctgggctcaagtgatcctcccacctcagtctcccctagtgctggggttacaggcgtgaaacaccatgccctgcagtagatagacatagtttatagattaaacacctaatttgctaaagccaaaatagttggcattgtaaagtttattatcatttaagtcttagccaggcttttaagagcttcaaatagacaattcttctggcatttcaggacccagctggggagcaccagctaggtttctggagccatgtgggctccgtgtatcttttccatcgtattattacaacaggcgtgtttgattggcacttgatcatcctacatctcaccactgtcctttgaaaacccatattcattctgaatctccccattcttcagatgagaaatgtgaggcccaaacaggctaaggttatccaaggtcacagtcagctagggtaggaccaggttggcagccaggtctctgacacttggccttttcttacctgtctgtgtaaagcccacgtgtgttccttagattcatgcattttattttattttatttttaaagacaggatcttgctcttttgccccaggatggagtacagtggcgtgatcataattcactgcagcctcaacctccagggctcaagtgatcctcccactttagcctcccaagtagctggaactacaggtgtgcaccaccacacccagttaatttttaaatttttgtagagacagggtctctctatgttgcccctgctggtcttgaactcctaggctcaagcaatcctcctgcctcggcctcccaaagtgctgggattcaaggcatgactcactgcacccagccagacaagtgcatttttcaggaagatgaccagttcccagattctctttccacagccttggacatgaagttacccttgacagcgggagccactccagggcacatgtgctctttctctgtggctctgctacagaatagcggggaccctgggaggtgacaggctgagatccgcagaccttcacgaacagagcccctggagaaacagaaccagagactctcttcagatccaatgtagccagattcaaccccacctagcagggatgtagtaattgtagtaacaaggacagtaacagtgctaaccaccatttacagagcactttgccatgtgcccacactgtactaagctctaagtacccaatatttttttaatcctcatcaaagcactgtaacatataaacatgatccccattttatagataaggaaactgaggcttggagaagtcaagtctgggtgggtaggttggttggttggttgattggttgatttatttatgtatttagagacagggtctcactcttttgcctggggtggagtggcaccatcacagctcactggagcctccacctcccagactcaagtgatcctcctgccccagcctcctgagtagctgggactgccggcacatgctaacacacccagctaatgttttggggttttttttttgttttttttttttggtagagacggggtcttgctatgttgtcgtgcttatcttgaactcctatgctcaagcgagctaccacacctgacccaagatgttgagtcttatctaggttcaccctgcaagtacgtggtggagccaggatctgtcggactctggagtccaggtttgcagagagcccccggctcatcctggcctctccggcatctcacttcctccctgcaggcacgtaggaccggcctcagctctgtcaagatctgcactgtaggaccccagagatttttttctttctttgggtagtcagacccatctgcaaaagttttgcaatcatgaaatcagatagcgtatgaaatgctaggaataagcgcaggtctagcataccacgcggccagcggtagcgtgacctgacaggaggagtgcgtcttcagagacattgggaaactggcgtgcctgtcgcccgtcccagggtcagagtcttcgaaaccaggctttctgggaacccaacaaggagtttctgatcgaagaaccgcactgaggacagttagtcttttttccacactgggcattttcagcattggaagtcaatgggagccctgcgtctgcaggttttgagatgtggcactcacagcagggtcactagaatggagacatccatgggaccaggttacaggcgctccggcagttgggagaagcgtcgccaagcagcctcccctaggctccatccagcttgtctgcccaagacagaaaacgtcatagaaggtttacagaagagatcttggggacttcctagttcaactgcccctaggtagatggcagaaccctcaatggaagctgtttagctctcagcaaaactcacggccaactaaaatacagtcgtgtgtcacttaacaatgaggctgtgttctgagaaatgcgtcaataggtgaatgcgttgttgtgcaatcatagtgtgtacttgcacaaacctagatagtatatatatatatatatatttttttttatttatgcctatttttcatacagaaaaccaaatgtcccagcaccattactgagcattagtcatttcccttgcttgatctgcagtgcctttataaagggccgtatgtcaactttctctgtatgttccattagaatcttacgggactcaggccaggcgtggtggcacacgcctataatcccacactttgggaggccgaggcgagtggatcacttagtgttaggagttcgagaccagcctggccaacattgtgaaacttcatctctactaaaaatagaaaaattagccagacattttgcaggcacctgtaatcctagctacttgggaagctgaggcaagagaattgcttgaacctgggaggcagaggttgcagtgagccaagatcgtgccactgcactccagcctgggcaacagagcgagactccatctcaaaaaaaaaagactcttatgggacttaggcagcctttgttgaccaaagcgttatgcggtgcatgattatacatggattccactcctaaaaccttccaattagggccaatcacaggccttcaaagaagacctgcagccgtgcccctagacagaaactgtaatgggacttagcagtgctaagagtcccaatatcaagccaggaacctggaatctcggcactttgagaggccaaagcaggaggatcacttgagcccaggagttcaagaccagcctgggcaacatagtgtgacctcgtcactacaaaataactttaaaaaaaaaaacaaagagtcccactgttgagggcccagagttgccaacatctgaactggttctttgctttgtgcaaacccttgagtaattgctgttattcccattttacagatgagaagtttattaacttgtccataggcacccaggtcagaagtgacagactcgagttccaggctcaggctgtcggccttcttggtctgtgccatgccaggctctgagaccctctgtgtgctcctccctctgtctgccttattcccagccggctcctattctctggatatgaccacgtttatgcacgctaaatttagaccacacctggctaattttttgtattttttttttttttttagtagagacggggtttcaccatgttagccaggatggtctcaatctcctgacctcatgatccacccaccttggcctcccaaagtgctgggattacaggcgtcagccaccgcgcccagccctgaatttttaaaacatcgggcaggttgggatttggatggtgccatctcctccccaaagtctagaatgttctcagttggctttaaactgtggtcttagccatggctagtcaagggcacctacaggcatggtggctcacgcctgtaattccaacactttgggaggctgaagtgggagaatcacttgagctcaggagtttgagaccagcctgggcaacatagcaagaccccctctcttaaaaaataaccgggtgtggtgatgtgcatctgtagttccagctactcaggaggctgaggcaggaggatcacttgagcccaggagttggaggctgtagtgagctatgatcgcaccactgcactccagcctgggtgacagagcaagatcctgtctcttttttaaaaaaaaaaagaagaagaagaacaagaagcataatacctagaaaccctgtagaggggaagttaccggaaatgacaattgttcacctctagcttggaaacatgctgaatggccagaacaccctcccggcaccgcccctccatattcttgttttatgtagagttgcctcatttcctccaaggagctccctttagaaaagatcaaaagcaaactagtccaaaaacaccttcagagaagaaagcaccccctacgaccaccctacagcaatggctcctctcacaagaaagccctgcagagctgtgggcagaaacggccacatcaggctgggtggggtggctcacacctgtaatcccagcactttgggaagctgaggcgagagggtcacctggggtcgggagttcgagaccagcctggccaacatgacaaaaccccgtctctactaaaaacacaaaaaaaagtagccaggagtggtgatgcatgcctgtaatctcagctactggggaggctaaggcaggaaaattgcttgaacttgggaggcggaggttgcagtgagcgaagccaagatcacgctactgcactccagcctaggcaacagagcgagagtctgtctccaccaaaaaaaaaaaaaaaaaaggattaaaaaggaaaaaaaggaaacaggccacatcaatccccagtgagctcacagacctttctggagcccactggagcgtcatcatactttggaaatgtgccatccctcccctaggcccctgagagggagcagcatctcggtcagggccctccccgcaggactcagaccagctggctgtcagggaagccaccaagcactcgactgaacaggtccctgctcctaaaaccccagcatccaggggttcaggagtggaaaggcctttgccctgatgcctatctgatgcctactctcaatacaaaagggctgtgtctctcgttagtagaggtcctcccaaaggtgttgacaaccagctgtatgagtccctcagcctaatatattttgtttaaaaccacacgctgcttttcagacaccaggaaagcctctcctcctgtcctcctgtttgctgtttcatggcacttcctacaaagtacacttttcctcctctgcttttcacctctgcaaagattcttccttcttttttttgggtgcggggggggatgcttttttttttttttttttaaaaaaaaaagaggtagggtctccactcctcactctgtcacccaggctggagtgcagcagcacaatcatagctcactgcaccctccaactcccgggctcaggcagtcctcccacctcagcctcccaaagtgctggaattacaggcgtgagccaccacacccttcattctgcttttgctaagttgtacgttacaaccttacagcatccctacacactttgccgtgcctgggcacgcactcacactgggcaggccaggagcgtgagggacaaaagatggccccagcaccgttgactccattcgcaagggctggcttcccctctcaggcacagctggctgttccgcagtgaatgccgtcggtgaagtccgtcgacctgttgtcaggcatggccactgatcaaattcttctctgttttcagcaactggaagaaaaactcaaaggccaggctgactatgaagaggtgaagaaagagctgaagtaagtacggagagccctgtggcccctcacacgctggggcgcattagggccatctgctaacaatgccaggctggtggcaggaagccttggccccctgccctctggctcagcagatgcccgtaaatgcagccagagttctaccactgcatggtgtcctgggctacccaccactgtgggcgtttgcccttgggcctgtccctgaattctttggacttttgctaaaagctgtgcattgcaggtattccagaatgtatggaatcaggggcatagggcttttacagaaatgatcaaatatgaccttgttttgcaactataaattccccaaacagaaacaaagcacaggagggaaatgttttcgggttgaaggtgggcatatggcctcacgctgccccggcctcctggactcaggaactctgtcttccaaactctattctccatctgtgaggctgtagccgaaagcttatcatcttttcagggctaatgatggcattctcagttctcaagcttcaaagttcctttctcggccagcagcccccacctctgcctcctcaccctgagcctgctttggcactctggagctcccaggtcctggtctttacctgtccccccacatccataatgctccaggctcactgacctcccctgcaagcctggagcctgtggtcagaccctctacgttcatacagctcccctggatcgtcagccattccaagccttcccactggcatgcccgcctcactcctaggttattaagcactgcaaacgaaggttgcctagggcatggtgaccagccccacaggtcccccgtgcttctcgcggctggagctctgctggttcgaggcttcctcaggggttcctccctgcccttgtcactgttaccccaaccactatccacagatgccctagccctctgctagggacagactcccgcctctggtcttgggtgccacctcccatctctgcaggctgccccctctgcctagaccttgagtcccttccttcctgcccctcctgctgtcccatcagcccctttctctcttgctgctattttccatttctccttttaagatgagcctacacccactcaccacgttttctttgtgttgttaattccattctgctaagaaaagctcctcgggcatcctcttgaaccatctcacttccatgaccagctgccttctctcgcctgggacccccagcctccctggcgtctgctggccctggtagtccctgtccccaccatgctctccccctgagcggtctcatcccctctccagctgcaaagcctctgccggcacctcctcggacagacccctacatccctctaacagttccagcctctgtaacttacttacttgcttgcttacttatttatttatttgacagagtttagctcttgttgcccaggctggagtgcaatggtgctatctcggctcaccgcaacctccgcctcccgagttcaagcgattctcctgcctcagcctcacaagtagctgggattacgggcatgagccaccaccccgggctaattttgtatttttggtagagatggggtttctccatgttggtcaggctggtctcaatctcccgacctcaggtgatccacccacctcagcctcccaaagtgccgggattacatgtaacttattattaaacattacctggttaaccttctctacctgcctctcctatcccattctttccttcctttccctcttcttccctcttccaaaaagaaaaagaaattgggccttttaattttgagccagagaaactgctgcgaaggcctttgcccagcctcaccctgggagttagtcgtcgtcttcattgtcgtcttcgttgtcttcttctttcttcctctcttcttctttcttcctcctcctcttcttctttcttcctcttcctcttcttcttcctcttgctcctcctcctcctcctcttctcccccaacccccacgttcacttcatcccctgggagctgaggcttccaggctccagcctgcaacacataccgttctactccctctcatccacagcctgccggaccacaggctgcccctacccccactgaagggctgccacaccagccccgcttgtcactgcatttctgctaactctttctgttgcgtccgcacatgacaggccccaccaccatgtgcacatctggaagccccactcaggtggcttctttgcccaaatgcgctcctagttttccacttcctggtgaaccagctgtgctcttgagctcttgcccgcgtccccttctcagcatcgtcccatttccacttcctcacccccacgcaacaggggatgctgacctcagatcctcatgcactgcagcacaagacaccctgtcccttcagggcccttctccaatgcttgttcatcatgacactgagacgtggtctccaatccatcaagatccctcctgctggggtcctcacaagttctgtcttaatggaccacttggagtcttgcctattacctgtaatggcctgtaaatttcctggagtacggaccaggagtggttctgattccccacggcaacaagcggatagcaggctgctggtaaagatctgtagaatagataaagagccacgtggtcttttattacataatcctaaagaaaataggaaacgaaggacaggattccatcttaagaaacccctttcagctgggcgcagtggctcacatctgtaatcccagcactttgggaggccgacagatcacctgaggtcaggaaaccagcttggccaaaaccgtctctactaaaaataaattatccaggtgtggtggctcacactagggggacagaggccgaaattgtggctgcaggaacatggcgaaggtccggttgactctgcacctgcgagtcgtaaatctcacggtccagccagcctgctctgggtctctctcttccatccttggtatttcaaagaaacacttgcagctccttcaaagccacatagcctcacttcccctcttctccctggtaaactcagcaaaaaagggacatccacagcaaaaggaactcaagaaacagtaataatcctggggacctggactcactgagacagcccagagaccgtagtgatcagggtgcggcccttttcagtgccattgagaacaagggagggagaagtcaccttctcttgccacatctttgtcattgcactccttccccaacctggggctgcagagaaggtctgcccacctggcttctgagtcatccaagtctaggaggttgctctttgcctatgtcccctggtccccaggtaggtgccagttaggagtgaggtgtgggcagtggccgccctggtgggttcccctctctctggcttctccttacaactttttccttccctttaagctttacaaatacattccacttgcaacaatgttatgtctgtattaaactttaaaattatactctgaacagacctggtgtgattccatatggaatgatttacatgctaggcaagaaacttttgccagccaactgctagttgaatagttattctagagacattatcagattctattactgccagggaagttgttaaagttgacagttcttcggttcctggagagcaggaaattgtaatgttaatgcttattaatgtggctgttgtcaaaggtataagtagaaaataatcactctggtggctcatgcctgtaataccaacactttgggaggctgaggcgggtggatcacttgaggtcaggagttcgagactagcctggccaacgtggtgaaaccccgtctctactagaaatacaaaaattagctgggcatgatggcacatgcctgtaatcccagctactcgggaggctgaggtaggagaatcgcttgaacctgggcagaggttgcagtgagccaatatcgcgccactgcactctagcctgggtgacagaacgagactctgtctcaaaaaataaataaaataacccctctgttgtgctcttgcagcattctgaagtccatggagtttgcaccgtccgagggcgctgggacacaggtacgtgtctcacctcaatggtcagcactagcatcagccccgctgctggttaccactggtccctccggcatatcccatgatccactgtttctacgagacctctcacttacagccgatgagtcatacttcaagaacatttaaccaagttgaagcaaattatctttttttttttgtctcctttttttccatgtgtccaaggcatgaaccaggcatagatcaaaagccaagctggggatgaacaagggattgcttcatccctgactgataggagatgggcactaccaaaaagcaaattatctttaacaaaaagaggcaaaaagagaaaagctagtgttttccaaactggtaactgaagtgaaattgtgatttcacttcagcaggtactaagaacataaataaaaaacaatttcagattgtgtttaagaaggccaggctcagtagctcatgcctgtaatcccagcactttgggaggccaagacaggaggatcgctttgaggccaggaatttgagaccagcctgggcaatatagcaagaccatgttgctattaaaaaaaaaaaaaatagccaagtactgtgacatatacccgtggtcccagctacttgggaggctgaggcaggaagatcgcttgagcccagtagttcaaggctatagtgagctatgatcgcaccactgcactccagcctggacaacagattgagactgactattttttttttaattgcattaaagagcagccaaaaatggattggtttaggaactttagttacatgctgcctcagtagagaaggtacaagggaaggatgactgtggcccagggtcatctggtggccaattaaaattgacatcccagaccaagcatggtggctcactcctgtaatcccagcactttgggaggctgaggtaggtggatcacttgaggtcaggcatttgagaccagcctggccaatatggtgaaaccctatctctgccaaaaatataaaaaattagctgagcgtggtggcgcacgtctgtaatcccagctacttgggaggctgaggaaggagaatcacttgaacccaggagccagagggtacagtgagccaagatcatgccactgcactccagcctgggcgacagagtgagactccatctcaaaaaattaaaaaatcaaatcaaataaaattgacatcctaagtggaatctgactcctgatgcccagaagacagccaacatctttgtggctggcaaaaaaaaaaaaaaaagaaaagttccctttacagtaacgttcggacagacgtttgtggcttggcagccagtcttatggccaaatgaggcacgggctcaggtcgcttgagtttgagaacagatgagagaataattaatttttttaggagctgtggaagtctaagaaggaaaatgacttcaactagaatccattctttctaaagggaacttgttttccacgtgtgttaaacgacttggggggaaatcagctgtccgcagcccacttcctaatcagatcgagagctgggtgggaacgcggacagatggagggaggcagggctccaggcctggtggccccgggagcgggtgagtggccggccccgcagtgagacccccgctctgccccttctaggatgcggccaagcccctggaggtgctgttgctggagaagaaccgctcgctgcagtccgagaacgccgcgctgcgcatctccaacagcgacctgagcggtaggttggccgggcttcgcgcgtgtgcggtggttggttcgcttccaggggtcggtcgaggacgaggaaggtgaatcgtgagtctggacagatgcatggccagagaagcgccggttgacgagaacctttgactaacgcgtgttgggtgccctcctcctcaccgctcctcccttcccttccccgccctgcttaaagctggatgtcgagacgggccagccgcacaggctctgcggaggtcagttaggggcagtgcggctggaatccccgggagggacagctcggaggacgtcggcctttctgatctgtgtctggttgtgctgcacagaggccaggggcagtgtgaacccagcctcgctctggtggtgttttcagggacagccccgggcctgccgggtccagtagaggtttttcttccttggtcaggtttcccctggggacgcgtcccccatccttagcctttcttggctcatcccccaaatggtggcgtcacttgactgtgcttctggtttgggcagctggtaaaacgcgtacaggtgtctcgggctctaatggtattgcattctcaaaacgggcgcgcgcctccacatcgagggggctcggtacggtgcatcgcctcagagcaagaggtgcgagcgaatccattggtcctaaaatgtcagtgtttgctgctcctccggccggggccagcgggcccagtaagaggcccgcgacccgtcaactcttccctgtgtgtgtcaccagctccttgtcacgctaggagtttgagtctatgtcaaggggactctccaggctgcaacgtacaagaaaggcgcaaacatgaatgcatgttgcttgttttgggaagcctcgtttggctgacttacaaatttaatcggaaaacaaaccaacccacctcattggcccttgtaaaaaaaacctgcacttttttttgttttcccttttgcgggggcaaacttttgcattttggtcttggtttttttttccccctttggaatcccccataatgcattctgtttgcccttccttgtagggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagaggtgagagactggcgttgggtggcgccagcgtgcgagcccgtcacagagttgcacatgtgtgtgtgcatgcgtgcgtgtgtctgtgtgcgtgatgaaacatttgtgcatcacatcaggtaaagttctctttgcttctgccacgtccagagctcaagggtggcccggcatgagttaaggctgttagatttgggagatctggcctttgaaacgcactcagcactccatacttaggaaaccctatagtatttcaatactagagatcgtatcagagggaattgcattacatgatgtatagcgtctccgtatgcttagtggccgcgggtccaattggccttgggtgctggtctcacttttgggaggagcccttaagtcccctccagccccatagcagcaacgttgactgggctcgatcctcatgcaaagctggttctgtagggagaacacatcacagatgacacctcccctcttcccaccccgcagaagagggcgtgtcccatggccaccttccctacattgttcacggtccattagtgatttgtttagcattatgagtaaaacaggcctggcttgagtaaaatacacaaaagttttatttaagcaccctttctaccccaccctccgtaaaaagataaaatgtcagtcacattcataatttcaaaaaatcccagccgggcacagtagctcacgcctataattccagcagtttgggaggctgaggtggatggatcgcttgagtccaggagttcaagaccagcctgggcaacatatattttgtaatcttttgatctacaaaaaaatcaaaaggttagctgggcgtggtggcgtgtacctgtggtcccagctacttgagaggctaaggcaggaggatggcttgagcccaggaggtggaggctgcagtgagccatgattgagccactgcactccagtctgggcaacagagtgagaacctgcctcaaataaaaaaacaaaaaagaaagttccttttctgtttaagaccaggggatcaatgtgccacatcaacagagctattgagaggtcatttcatcagacatgtttgaaacaccctgaaatttagactcaaacagagcagggagatgttttgaacagcatcaatttgcaccaagaaaatgcagtgttttatgaggatgttaaccgaaattgaatgtctttggatgattaatgcgagctttgttctgggggctggcgggtgatcctccttcaaggcagtcctccctcccatggacctccctggcctcaatgccgtaggtcgctacttagatttcccccatctccttttgcagcagagccacggcctctgcgggccggtcagccagggaagggcctctcagaagattctagaaactcccgagttgcacaggcagccctgagccctttctttagtgacaggcggctcagatttcatgtcacacagcccatatcgtcaacaccaccattcccctgattgttttgttcttaccacacttgtttttcaacagagaatccaggccagagcctgaacagactatttcaggaagtaccgaaacgaagaaatgggtctgaaggtatgttgcaggcaggcgttttctttgcagtcagtcacctagggaagcagcatgtccttagctgtgtatttgggttaaaactgtgcagtgtgattctggcctggaacctgatggaaaaacagctagtaagtataaaacaaggcacgggttcaagcacacccagccccttcctcccgagctgcctgccctctcccaagcacaggcgggggtgagaagaggcattgctaagctaagccccccgagtctgaatcccagcccacttcagatcctaattacccggtcccccgtttttctcagacgcagttgaaaaaataacagcggttgctctgagaaaagtcaggtgacccgtcaaattaaatactgctgcttcctcgtatttttaactcggaaacacactcaaggtcctatggaacggacgcatcccacatcgtcccggtggcatacttgtttttaaatggtggtatacttgttttgaatgcagtggttcctatttaggaaggtagtaagaaattaaactatccgggtggcttcccgaaagagctggggccagcccctgggccatagtagcctcatttcgtcggcacgtgtgcctgcacaaaacatcaccatgtggccgaaagaatccatcctccccacttaggaatttctgcaggctcctttcctcgtatgtaaattttaaaaagatattatgtgataataggtgcaaacaattttttaagttaagcctttcttcaccctgtgcctctgaatgattgatagacaatcagcctcaaaccctctgccctccttttccgtttatcctgtgtgggaccccagcatccaataaacatctaaccccgaggagagtcagtcccaagccacagcagttgcttctaagtgactcatgagaaacattgccttttaatcactcgccttttatatatatggattaaatgatcggttctcccgggtactaacccacgggtggtgtccggctttggcagagtaacattgaccgtaaggtcaaatgagcaggaaatccctcctgcccggtgtcgctgtgaagttgcactcacagcaaacacaggccactgggaggccacatctgcctccttgtgtcaccagcccccacccggggctatatatcagaatgacgtcttcgcgcagcgctgatttttgtccggggtttgggtttgatgtcattggcgcaacttctccccacaggtaacatcaccacccggatccgagcctcggagactggctctgatgaagccatcaagtccatcctagagcaagccaagagggagctccaagtgcagaaaactggtacagcttccatttcttcatccactgtcttcaaacttaattaagagaattgtcatgagtgctctggtcagcagtaattaactattttttttttaaacaataatgaatgcctgttctcaagcatttaggcacgtagagagaagcaggtctgtgtgatctgtatttgcctaatagttacctttttttttgagatgcagtctctctctgttgcctgtgctggagtgcagtggcacgatctcagctcactgcaacctctgcctcccgggtttaagcgattctcctgcctcagtctcccgagtagctgggactatagacatgtgccaccatgcccatgatatttgtgtttttagtagagacggggttttaccatgtcggccaggctggtctcgaactcctgacctccagtgatcctcccacctcggcctcccacggtgctgggattacaggtgtgagccaccgcgcctggcccctagttgtaattattcacagaaattacgctccttaactttgacagaaccacttgcatttcagaatatagcacaggaaaatgaataccaagtataaaaattatcagaggtcaggcgcggtggctcacacctgcaatcctggcattttgggaagctgatgggggaggatgacttgagttcaggagtttaagaccagcctatgcaacacagtgagagaccttgtctcttaaaacactagccaggcatggtggcatgcacctgtggtcccagctacttgggaggctgagctgggaggattgcttgagccagggaggtggagggtgggtacagtgagccgtgatcgtgccactgcgctccagcctggacaacagcgagatcctgtcgctaaaaaaaaaaaaaaaaaaaaaaaaaaaaattctcggggaaaggagccccaggagggcaggtcggggagcactttcactgacaccccctttattaccctctacatctgtgtgtataccaaaggccaccaggtcatcaagctgtagtgtcaggccctggtccttggttgagacaagatgcctgaatgtttcactgacaggggccatgctggggaaatacacagtgtggttctcccaaataacccacactttgcagtaggtcaagttaggatgagaagcatgtccccagctgaagggggccgccctgccacactctcacccctgtttctccatgcagcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtaagggatctgctctgggggctttggttctcccatctcttctccttgctgaggaccaagtatctatcccgcagcctgtgaccctcacccatttcaattcacccaagagcagagcgtaaggcatcctctgctcccagacttccaaggtgcggctggtgaacattgcagccccgatcccatttgccgagccccgactgcagccaggttctaggctcagcctttcacctgcatgctgccctttcgacccctcacttggcgctgggaagtggatggtaaaatccccaattgacagggaaggacaccaaggcttggggacgttaactacttgccccaagctgaccggcagccgagtccacatccagcttttgctgccaaggggagctgagaggcacccctgcaggcttccttggccaaaaaaaatcccatctgatcacacagagggaccaccagtacgcagagagccaaaagggacttactagaaaaagctgcagagagcattattgttcctttctgtgtaactcttggatattgttcagtcagagaggtcaagcaacctgcccggggacacacagcttggggatggcccaagcagggtggcccgtgtttccctatcatccttccctggctcaggaaagtgtaatcgtgcatggacgagcttctaggcctttctgttcttggcactttcctggtcactgagattcaggagaatgagggttaaccgtgcctgccaaatctaaaataaacatcatgtcctagtatcattttatttatttattttttgagatggcgtctcactctgtcgcccatgctagagtgcagtgacgctatctcggctcactgcaacctctgcctcctgggttcaagcgattctcctgcttcagcctcctgagtagctgggattacgagtgcccaccaccacacccagctaatttttctatttttagtcgagtcagggtttcaccatgttggccaggctggtctcctgacctcaagtgatctgcctgccttggcctcccaaccccctaccattttagattaaataacggagtgctgaatagaaggagaagcacccctctcccctaaaaggcaccttcctgagggagcacgtggctggatcagcaggggacaaatcccaccccctcccctgccaagccagggtccctgcatggcgccgtccccgcactccccaccccgccttccactcagtgtttgccgtatgctgtgctgtgaatcccggtggtgtccgatggcgaactttgccctgattttgcaaaaggtgaaggggggcgactagaaatgaggatgagtatttcaagtcccttgagatttctagttcagtgttgtaaaaataccatttgagaacattgaaatagacattcgtgctcatgccttaaatttagcagagacttaataacattgaacttgtttggcccgtgagtgcagttttattctggaacttgagaacttttcaaaagagtgatcggatgcagcccctaaatatcccagggcggcatctgtgtcctgtggggggtgtttgtgcctatacatatgtatggccatatgggagcgtcagaaaactcgggtgtgtacacgcaactcggcaatcatctgcggcggaatgtcactcccaggccggctccccaggtcccaccagctcacctctgggcccccacctttgatcaggatgtggtcagaacaagcagacctttctaaatgctggcctggctcagcgtttgcagaggacaccagcttcgccagtcccaccggcacccactgccccacctctggagggatcttgtccctggaaccttagcctttcccggtgccaccaagtgaagagcaaggtgcttgtacacacctcctccgcggggtgtcagggtgacagccctgccatcttggcaggatcaagaccctgggatgagaccctcttccctccctgggagctgagagctgtggctgtaaccatggctcacccgaaagtccccctgtgccggggtctcagccaccgttgatctttaaatgcatattccctgcccacaagctgtcaccgccaccaggccgtggttctgtgctcagaagtcagccctagacgcgccctctgcgtggtgggtgtgcattgcagcagcatctgtggtgtcatgctaatagccaggcactgatggcctgtgtgttcggtgccactccaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccaggtaatgggggtcctgccacaggagaggggctgcccccccatagcaaggacctggtcacagcagccccacctgggctatgcagagagggaggagggaactccgccccaggaggtggccaaccacactccccaccgtgggctggtgctgggggacagaaccgtccccttcctccacaacctgttgccgtgggactgacttcagtgtttaggagagatcatgcctgtctaattttataagcagcagaaaatgagttaccaatttaaaaaatgctgtttatacataaatacaggtaaaagtcaagtagctgaatcagggagtcaggaaagaaagtcagccaaaggtacaaaagtggaagatgtcacaggcgaaacctttcacctgctcccggcccgggggcctggccttgcaacagcagcgcctccccggcccgtgggtccccatgcccgcccctccccaggaggaatgggaagcctccccgggccttgccacattcagttaggaagctttaagccctgggccgcgttccttcctttaattataacctttttctactttagtcctccactccgtgacatcgctccaggacccgctgcagcagggctgtgtgagctcaggtaagcagccagtttctgttgcttttgcatgaaatgtctcactgccttttctgttgtcccgtgctgtggtctgtcccggcgagactccgagggaccgcacattctggatttggggagctgaaatatggcatcctatctgcaaacggggtccctctctgtgtcagtttctaatggagagcgagctgacagtgcatggagggactctgccaagatttgcacgcccactgtcatcctttgtcggcccagagccttgtgttcagggctggggtctaagtcggagacagattccccactcagggggcttaccgtctgataggaagggataaagcacgggcacacgtccctctcctggtggggtcatgtcgggggacttcttatctaaccggaagacatccaggcagcctctgagcaagaaaatggggagctttgagcttgagcagtgggaaaggtagggtagcagaaaggaaatggccaggaagcccctgaagacagctcaggtgtgaacgaatggagagctggggactgagatctgagcctgggagcaggtggtggcggagagtggtggctgcaggctgagaaactcgggctccttcctgtctgcatttcacagcctcgaggtctccaaccacacttgttctctttgccacatggtgcctggacacagcccaccgaggctgacccatggccacggctcccaggctctcgtctgcgcccccccgcctcccttctcgtgcgccaatcccacacttggagctgagcttttcacagccagcttttaggaacagccagcactgtgagctggtcctctttttccctttctgtatttttctaaacatgttgattcgtctccatatcccattgattcattgaaaacacaaacaaagctaacaggagcacgaagcccgccagcttgccgcaagctccacgagggggaacatgtgtagcacggggaacagctgtgtggcagtggctgctgcttctacaagagaccaaaccctcatacagatgcagccggggcacctcggtggcatccaagtccccagttgagagttctgcgtgttttccgtgttctgatttgactctgaccaacgtgggggtcgagaggctgcatctcacccgcgccgtgggtcttcttggctggacatctaggtggagcgggtgcccattggaagaagggatcactcattctggcttggccaatttaattagaaagtaccaagaactaatccagcactggctcgagttcagaatacttcaggggaaataatggacatagctgtttgtgctggagttttacggacgtctgcttggaaagttagccttgaccccctgctctaacgggaagttggccttcttgaaactcacgagagtatttgattccattgaggcaggactgaacttggcagaaagtgactaatgtattctagatcaaaaccccttgttagaccaggtgcggtggctcacgcctgtaatcccaacactttgggaggccgaggtgggtgcatcacctgaggtcaggagtttaagaccagcctggccaacgtggtgaaaccccgtctctactaaagatacaaaaaaattagctgagtgtggtggtaggagcctgtaatcccagctagtcaggaggctgaggcaggagaattgcttgaacccaggaggcggaggttgcagtgagctgagatcgtaccactgcactctagcctgggcaacagagcgagactccatctcaaaaacaaaaaaaaccctcgtcctacataaaacaggaagtctcccctggtgccaggcctgctaatgatcgatgccagaagcaacttctatgtgacggaacaaatccttgaagaatgacgttttactttgtattgtaacggatcatcgccactgtgctggaacgtttgtacaacagtcacatttcaaacctaggaaaaacacactaggctcctaagaggaatgtaaatgatatttgtaaaatatcaattgactttatagaataaagttagttaagactcctgggcaatctcgcagattggaagcaggagagagaaaaaggcgatgagcccctggatgaaacggaacagagtgtagaagttgccagtggtttttgtgaagaggcagcagatgggtgtgtctcccccacccgccttccatgtcattccagcaagaggggaggttgagcacaaatcacttacccaaaatcttgaagtcataggaaagccaccagcagaagcaaaaatcgtggtgactagggagaaaaatggaaaaagatttcttatttgcaggaaaaaatatttttttttttttgagacagagtctcgctgtgtcacccaggctggagtgcagtggcacaatctcagctcactgtaacctccacccccccaggttcaagtgattctcctgcctcagcctcctgagtagctgggaatacaggtacccatcaccacgcccggctaatttttgtagtttcggtagtgacagagtttcaacatgttggccaggccggtctcgaactcctgatctcaggtgatccccccaccttggcctcccaaagtgctgggattacaggtgtgagccactgcacctggccaggaaaattttaaaaaattgtatagcataatgatggccaagtgaaaatatttctctggaccaggaagactaggagggctttgccagaaagaaaagagattatcatatggttttcctcgtctgaatctttactatcagaggttacttttcaagggagtttcacacagaggctcacatctgtaatccaagcactttgggaagccaaggcagacagatcacctgaacttaggagttcgagaccagcctgggcaacatggtgaaaccccatctctacaaaaaatgcaaaaattagccaggtgtgatggcatgcacctgtagttccagctacttgggggactgaggcgggaggattgcttgagcccaggaggtcgaggctgcagtaagccaagatcacgccactgcactccaagctgggtgacagacggagaccctgtctcaaaaaaaaacaaaagagaaaagaaaaaaagctatgttcacagtatatggagtgtgtgtgtgtgtgtgtgtctgtgtgatggagtctcactctgtcgcctaggctggagtgcagtggcacaatctcagctcactgcaacctccgcctcctgggttcaggcgattctcctgcctcagcctcccaagtagctgaaactacaggcatgcgccagcacacccagctagttgtatttttagtagagacggggtttcgccctgttggccaggttggtcttgaactcccaacctcaggtgatccacccgccttagcttcctaaagtgctgggattataggcatgagccaccgtgccccacctagtatatggaatttaatttagaaaaatagagttgctaacagtggtttttagtaaatccttgggattagtgacatgagagactagaatcttccttgactgtgtctctgtggaagcttccagcagtgctgcccctgaagcaggagagcgagcctctgtcctaagattgctacaggattccgattccctgttcttcccatggctaccccagaatcctttcaagaggcccccagacccagaagatgctccctccattgcttgcctcaagtagctcgccgtggtagaaccaatgtctgcagaaaggtcattgcaagcccggcttggcttcttcctgaatgtcagtgagaaatgctcagtgcttgagattctgggcctcgaagatggactggcggttggttttccttcccaggtaggcagggactttggacaacttgctcagccagccacagccctgcagtaagggaatcgggcttacagcggagtccgtgggggcggatggctctgtgctctgtgctcggttaccatggtgatcaggtgccctgcgctagagtggcctcgcccatctgaacagcaagctgctggcccaggagtctattttcttttcctcactgagagctcccgtcagccttttcctgccgggctctgttgccttgtctgtccttccgttttccttaatgacttagacgccaatttgccaaaaaggagagagaaactgacatttcattcacatcatcactttttcctcttggtggatacaactggttctgaatgttcctctaagaatccgagcatgggggtgacgggcttgggcattaaggaaatttgatgccatttttaagcagcagcgtcactagtgacccaccactttttcttagacactgttgaggccttgaaaaggcgtaaggtgagcggtaggttccatgccagtcatgagtaactttttttttaagaaaaaggatttttaagagacaaatcttcagatcagttacctgttcatagatttcctggtacgtcttaactttctacaaatatttttttttgtttgcttcttgcaaaatgcccagcaccttgggatataaaggggggtgtagttataaccagggtcatctttgatctcatttggaaaacttcatttcaagatggagttgcaggtggtccttggggactgattctgcaagccccttttgtctgtcagtcattccaggcttcatccctcatttctggacctcacactacttaaccataccaaatgttcatagaggagaaggtagaggctcattaaggcttgtttgctcagagtgtggccttcttatcatttagcaatttattgtatcttattctatttattttatttattttttatagacagacggggactcactctgttgcccaggctggagtgcagtgacacaatcacagctcaatacagcctcaatctctcaggctcaaacaatcctctctcctcagcctcctgagtagctgggacttatagacactttccaccacactcagctaatttttttattttttgtagaagtgggtctctcttttttattcgtttttgtttttgttttttgagatggagtctcgttctgtcacctgggctggagtgcagtggcgcgatctcgactcactgcaacctacacctccggggttcaagtaattctccttcctcagcctcccaagtagctgggattacaggtgcctgccaccacacccaggtaatttttgtatttttaatagagatggggtttcaccatgttggccaggctagtctccaactcctgacctcgggtgatcctcccaccttggcctcccaaagtgctaggattacaggtgtaagtcaccacacccggccttttttattctttatttccaaatacccaagtaacctggtctctgttgccagggctggtctcaaactcctggcctcccaaagtgctgggattaccgatgtgagccaccatacccggccactttgtaactttttaatgtgggagcgtttcattgctgtggctaacaagctgttacgtctgcattcacactggcttcaggtgtattatggctatccaggtggaaggatggtcccctgcccttggctgaatcgtgaaatacccagctctttcctggcgtgttaggaatgatgggttccaagccttctctgctgcctgttgctgttcccagtcagccaacagagtatcagttgcctctttgagaagacagctgctatggtctgtctctaatgtgggtggtccaatgtgtgcccctctttgacgtgaagcccacggggccgtgggctgtccatgaccttgtacaaccaggagattccccttggctgcagcccctatcgcggacaggtccacgttccttttgaatgtgcatgcgtatcatggtcatggctcttagctggttcccaccagacagccaggaacacgtgtccagggctcgtgagctttgaactctgcagtaagattctaaagcagtgtccttgataagcagtcagtcggctctcccacattcatggctaacagtcagtgtcgggggcatgtggatagcatgttcatagggacaggagaggctgattgcacccctgggcattccacagcactgtctaaagcaggcaggggccaggcgcggtggctcacacctgtaatcccagccctttgggaggccgaggtgggtggatcacttgaggtcagaagtttgagaccagcctggccaacatggtgaaactcggtctctactaaaaatataaaaataagtcaggcatggtggcttgcacctgtgatccctgctactcaggaggctgaggcaagagtatcacttgaacccaggaggtggaggctgcagtgagcaatgatagcatcactgcactgcagcctgggtgacaaagcgagaccctctccgcccgcaaaaaaagaatacctcttcaattggagacattaaagaatcagcttttcggctgggcgcagtggctcacacctgtaatcccagcactttgagaggccgaggcaggtgcatcacctgacgtcaggagttcgagaccagcctggccaacatggggaaaccccgtctctagtaaaaatacaaaaattagccaggcgtggtggtgcacacctgtaatccagctccttgggaggctgaggcaggagaattgcttgaacccgagagacccaggttgcagtgggccgagattgcactattgcactccagcagggtgacaagagtgaaactccatctaaaaaaaaaaaaaaaaaaaaaaaaactcaacctgatctcggctgagctaagatgcaaagggactggctgtgccactgtgaacccttccagaggcaggtgaggcaggccgcgcgggagcagcacgggaagtcccggctgatgagatgaggctggggggccgccccaagagccacaggaggaagggcacatgcgcttctcaaaagttccttgatgtgtgatgtatagggatcactcagggaccttgccggaaagcccctttgtcactgtgcgtgacctgcttgttcagttccccaagcgcctccagatgcttgtgggattcaagatgggggctggccacatgttgctggaaccagcaccctgtgacatttatgcaggagaacatgggtatttgaagggtcttttgttcctaggacagccctgcctgggggaccctgcacacacagatcctgcacagatgtcaggggcagccagtgctgagtaccacagcccactttaggttttgtttcaaagcaacaaacgtcgctgtcatcaagtgagcaaggcagcctacgcaggctgccagcaccgccccagcaccctgcagtcccaccttccagcaccactcgtcacacacccttggggaaggctgctttgccagaactcggccccccaaagtctctgttcctagagcagaatttgtccctgtgcctcacccaaagagagggaagtcatagcccagagtcaccgatttatttgacttttttgtttttattatgatttgcaggattttttccaagaagtaaaatgcaccatagttacaaaatgcaagcattcaaacttacagtctttttaagaaatcggtcaccatccctccctcatcttcctgtcacacaccacccccacccccacaccccaccccaccaccatccccagtttgtcatgtgtccttcaggacagtcatgcacctaaatatttattccacgcagatggggggcgtgcaggcctcaaaaaggccgtgtgccttgcttttctcacttagtaacacaccgtggagaccttcctccatcagcacatggagaattttccctttttgtgtgtacatgtgtgagagggagtctcgctctgtcacccaggctggagtgcagtggcacaatctcggctcactgcagcctccgccttccgagttcaagcagttctcctgcctcagcctccaagtagctgggatcacaggtgtgcaccaccacacctgactaattttttgtatttagtagagacggggtttcaccatgttgctcaggctggcctcgaactcctgacctctggtgatccacccatcttggcctcccaaagtgctggggttacaggtgtgcaccaccacacccagccagatgtctgcttttaaaacagaatctagtcgcatcttcccacctcctttggtggagattgtcccttgcagatggtgcagggtactcctggtgccgcagtcctgtgagaggtgatctatatgtgcctttccaaagtctcgacttctacaaaatgctattccatccttggaagttgcctgttcattgaccaattccttaaagtggacacaaaaccttgagcttccagagtaagactatagggcctaggtcattgcttaggccatttggggccaagctagtatggaaccaggccaactaggctagacacagccggcgaggctgagggctcacataactctcgttcttcccgtcgctttccctggaccctccatcctggtgctccctggtttccccttctgaaaaggcccgacaggcccagtccagcttgtagacacatcccgttctctccccttcaggctttccatagaaaacagaatttacagcacattgggcattcagtacaagaggcaaaagtaggtcataggagcaaatgaggacttcagttttcagtggttgaattctagggaaggaatgaagaagcttaaatgcctagaaaccctcaggtgattgcagaaaggggggtgggaataaaacaagggagtccacatgctggtgtggtctctgtgccactcacagagctgatgtccgtaatccttaatcagtaagtgaggccgggctcagtggctcacacctgtaatcccagcactttgggaggccaaggcgggtggatcacctgaggtcaggagttcaagaccggcctggccaacatggcaaaaccctgtttctactaaaaatacaaaaaaattagctgggtgtggtggcggatgcctgtattcccagctactcgggaggctgaggcaggagaattaactcgaacccagaggtggttgcactgaggcgagatcacgccactgcactccagcctgggcaacaagagcaaaacttcatctcaaaaataataataataataataagtggaaatggttcccttctcttacggatggagtaaaccaaggctcagagataaaaggtgatttgccccaatcaagaagaaggtggtggccaggcgtggtggctgacgcctgtaatcccaacactttgggaggctaagactcaaggatcgcttgagtccaggaatttgagaccagcctgagcaacatagcaagaccccatctctacagaaaatttaaaatttagccgagcatggtggtgtgcgcctgtagtcccagctactcaggaggctgaggcaggaggattgcctgagcccaggagttgaatcagcaaatcagtgacagcatggaagccacatttactaggtttggctgttggaaaatgtgtaatccacctggcctaggctgcatggagtgtccatgctcctttgaaacctcttctggtctaaattcagtgaacgtatacacactggcttgaggtcctctgcctgctacagggcagccctgcctttcagctgtcacggccccccggagccatgccgacacccaggccccagccccatgcggactggcccgagggacctgccccgctcccggtgaggataaggaggggagtttcttaatggcattgccctggatagattgggagccaggcaggaggcttccatcggggcctcctctagattttgcgtttacttcttccctttggaaccggattcctaaatatagcccgagtctgaattggcagatgttgggtctgtcctttccttgacggccaaaattagtctgtcatttggcacctaaataaagcagccaaactacctttataccagctttgcaattaggcggtagttggaacattctatttgataaggaaacttttatggatgccttagcagcacctctgaacccaggaggctgaggagagaggacacccgggccccagagggacactccttcctcgccatcaggccttctcattccagagttaaggtcaattttgttccatgtggcttaaaaacacctcgtgaatgtggaaaagacagtcaatgctccccagaaatagcattctaagagcatggcaatggttactccaactttttttttttttttttttttttttttttgcaagcaaagaaaaatctgtccagagtgcctggagctgggttagtgcagggactccccaggggcagcagaaagatgttataatcaattatcacatcataacactgatgtatgataattactgagtgtttctcctgagatagtgcagcatttggctgggatgccgctctttcacggtccactgcctgattaatatgcaaataataggctgattgcatgatgaatgcagaaatgagttcgctgataacgtgagcaccgaagcgggaagatgataaattacttttactgactgtcctacattaagtaccctttctcaacaatttcatcacaaattaagtaaagcagtatggagagattaggaggacgtgtaaaataatgtaccttaatggtttttctaataccatcgtggaagacgaaaatctcaacttggttctgcccgggtctttgtagggccaagtgagttcactcacctgggcattgagtggaagacaggaggcaccccaccacaccggcgtgttccacgggccatgatcagccatggattctctgaggaatatcccattgcagcccagacattacccgcacactgggccaacaggcagcatcatggagggaggaggacaggctgctctcggggcagacgcagcatcctccacacagatgggcacccccaagcctgctgtccaccatgtgcctgcaggaaaggagcatttctgggctgcaggcctggaagactcggaaagaaaacaacatttaagacctcctgcctgggcacagtggctcacgcctataatcccagcactttgggaggccgcagcgggaggatcacttgaggccgggagtttgagaccagcctggacaacatggggaaaccccatctctacaaaaaatacaaaaattagccaggcgtagtggtgtgcatctataatctatagtctatagtcccagctactttggaggctgaggcggaaggatcattggaccctaggaggtggaggttgcagtgagctgagatcacgccactgcactccagcctgggcagcagagcaacaccccatctcaaaatttaacaaacaaaaaaagacctccttgacctctttttagctcttccaagtctcagaaatctggaaaaattaatttcactattagaatggcagtgggcacaccggccagagagcatgacttggtaagggatgggtaggtttgtccaaagccagaattgaacccttgagaaaaagagggcgtgcgtgtgtgcgcgcacacacacactctcccccccacacacacacacccacacacgcacacacactcccacacacacactctcccacacacacactcccacacacacacacacactccccacacacacacccccacacacgcacacacacacactctcccacacacactcacacacacacactcccccacacacactcccacacgcactctccacacacacatgcacacagagtcccacacacacttctgcacacacacactcttccacacacactctcccacacacacactctcccacacacacccccacacacactctcccaccacacacacacacacattctctctccctcacacacacattctctcacacacacattatctcacacacacacacacacacacatttgcagtgattaatctttgattacagcaaagcaatttaactagaggctttgttttttcccgtcttagtaatatatatttagactgtttgtatgacatacattttgtcttaatgcacagggacgcattgataagtgttcgtacacacagctggcttggtaataaggttattgaaggtaatttgaaagcatcatttctaaatcagtatggatctgcagaaaagccggaacaaggcgagcctgtgcccctgaagcagggccatctgtgtcacccagtgtcccttcagcaatctggccagactgagttcactaccaaaatcgaattgtaatttaagcagggtttttaatttttaatatcttcaagctctgcttttgatatgcttatttccttaagagcttataaaagatacacaagccaactgagcccagagggaaagtgactttccactccgaatccccggcaggtcccctccccgcccgcgggtgagctctggttctgcgcaggttcccgccaaccacagggcctcatcacctctgcagcttcctcctcgtgcatttcaggccaacacagaatttctaagatcatttctccccaccgtaccttcccatgtcggggagatgaaagaggagagtcgaaaaccatccccagagggagggaggctccagatggatgccatggtgtctagagggagggaggctctggatggatgcgatggtgtctagagggagggaggctctggatggaagcaatggtgtctagagggagggaggctctggatggacacgatggtgtctagagggagggaggatctggatggacgtgatggtgtctagagggagggaggctctggatggatgtgatggtgtctagagggagggaggctctggatggacacgatggtgtctagagggagggaggatctggatggacgtgatggtgtctagagggagggaggctctggatggatgcgatggtgtctagagggagggaggatctggatggacacgatggtgtctagagagagggaggctccggatggatgcgatggtgtctagagggagaaaggctctggatggacacgatggtgtctcctctagttagaggagctcatggttgacttctcagagcaacttctcactcgcttggcagcagggacctgtcacacccctgtgctgtggccaggaccatgttgcctgcactgctgcacctccagaccctgccctgacactgctctccccagaaacaccctcgtcccagactctttgtttgagtgacctgcttagtgacttcggcctcccgctttggttacaagatgtgggggcgcagggtctgccttgctcacggctgtacccccacacctggcacatggagggtttccccattgtggaaagctcaggtcccatcttcaagtaacttagaagtcaggtttggggaggtaaaatacaaatcacacaagttaaacaaccttgctctaattgaaacaggttttctttggggccagatatggtggctcatgcctgtaatcccagcactttgggaggccgaggcaggagaatcacttgagcccaggagttcaagaccagcctgggcaacatagtgagaccctatctcgacaaataataattatagtaaattagctggaatggtggtatgtgcttgtagtcccagctgctcaggaggctggggcagagggattgcttgagcccaggaggtcgatgctgcagtgagccgtgattacgccactgcactccagcctgggcaacagggtgagaccatgtctcaagaaaaaaatcaagagagaaagaattttggctcccatgtcattataagagtttctcgggcaaacctaaaaacatatattgttggccaggcacggtggctcaggcccataattctagcactttgggagtctgaggcgggaagatcactagagtccaggagttcaagaccagcttgggcaacatagtgaggccccccatctccacaaaaaattaaaaataaccaggcatggtggtgcacgcctgtcgttccagctactcaggaggcaggggtgggaagatcacttgagcccaggaggcagaggctgcagtgagccaagattgcaccattacactccaacctggacaacagatcaagaccctgcctcaaaacacacacacacacacacacacacacacacacacacacactatggctatatagttgtcacacagacacaccccagcacctactaggtaccagagactttgagttcatcttatcctattctttctttagtccctgcagagggtgtgtgtgtgtgtgagagagagagagaaagaaaatcattgctgttccattttatagaagaaactggcacccattggtgggggtgggggggacattgatctttcctggagtggggcagagctaccacccatcccctctagttcctctgaggcatcttccctcccactccaacccttctccacctcctcccccacaccccctacagaatctttctcaggttctttctgctgttgaaaaacagtgatttgataggtttggggctggcaagggatgtgcccaaagcttgatgctgccacttgtaagggcacagaccttcccagggggcagaaggccaacccaggaccctcgggaattggaccttcgcgtcggccccccgctggcgtcaggcatagctgctcaccttcttggaaagaaagccattttgtagtttggccacgctgggtacgtctctgatattccttaggatgttgttgggctacttttgtttctttcatggtaaggaaacgtccagtggcccaggaaggaggtgcagaaagctcatgagtgtctctgtgacatctgctaaagtcgctgcatattttgtttcaagctcttgctaatcagtcaagatgccagtcttactcaaaagaagaatactgtaggtttttatatgggcgatgtctaatggagatggaggactgttccgatggagattcagcagggctgtgagcttctgctgctggattcagaagcaaggcttgggaactgaggagcccagcgtcgctgccatggttgaggaaagccttggtgttcagaaatttcggagctggtcatgcaagggtgtctcatgtttgtgatatgagcctgtatgaccaaaatacaggaggccagggccgggcacagggccgggcacagtgggatcacacctgtaatcccagcactttgggaggctgaggcaggcagatcacttgaggtcaggagttcgagaccagcctggccaacatggcgaaatcccatctctactaaaaatacaaaaattagctgggcctggtggcacacacctgtaatcccagctactcaggaggctgaggcaggagaactgcttgaaaccgggaggcggaggttgcagttagccgagattgcaccactacactccagcctgggcagcagagtgagactccatctgaaaacaaaaaacaaacaggaggccaaatgagcattgctgttcccctttgatgctgagaaactcactccaggcgtaaaccaccagggggtgtggtctgtttagagcacagggtcagttccggagcaggtctggtgcccacatcacgatctgtccctctaaacctagctaggaagtatccaggctggtggccaccctgttgtgtcttctgaagctgtcagcaccggtcgctggaaaggcccgcaggctgggaagagtctttctgagcctctagggctcctgccagccccggcatgcccacaccgggcacctcagagcctgccgtgcatccttgtatcttgcaccagtccccgccacctccaggcccatccctccctcgggctctcctttcctctcctccagggctcccttgatgttttttatttgtgtttttttattttgtattttattttatttacttatttatttttttgagatggagtagctgggactacagacatatgccaccacacctggctaatttttgtatttttagtagagacagggttttgccgtgttagcagggctggcctcaaactcctgacctcaagcgatctgcccacctcggcctcccaaatgttgggattacaggcgtgagccaccgtgcccggctcccctgctcattcacacttaatgtgccaggccacgaccacctcccctctcccctctcccctaacctcctccctccttccacccgcccttccatacgtgtctgtctgtatagtcattggaatttcctggcttggcatgggctcaaagccgaaaccatggacagaatgaaaagtggcgcatcagaccagccgccagttaaataatgtttgggttcttgtcagaatgtcacggagtaccctgtcattttgtttcagcaacttgtccttctgaatgcacagttcgccttatggcatgccagcagtaaaaatgtcacttacaataattactttttggtgaaaatgcttgctgacttcccaccttcaagctgttttttacacagtggggagataataagaaacgactttatcctgactgctcaaatgaacactaaatggaatttgggttcttattactgcagatagagggccgggtatggaaatttcaacagtagatcggaagaactgcagagagatgtatctccgagaattacggcgggtgcgggttttcaattggctcccattgaaaacttaaggcagctgttgtttgcctgctgtttttggaatataatatttttcataatccttttatagttcgtgaatgccttgtgtatctcagagggccttgagtcactatctctgctttctgtagcttgctcaccaagctcctcttatgccagattcagtgccttgtaaaaaaaaaaaaaaaaaaaaaaaattaattcacatagatgactttttaaatgtaacaccttactattgctgtcaaaactggatggatggtactgtgcagtggggcttttaaaatatgcaaattacccattttcaattgtcctggtcctgcaggctgcagggtccttggaagcgaggtttttgtctgatttctcccttatccccaagacacagagtaggtgctttaaaaatatgtgagtaggctggatgcggtgactcatgcctgtaatcccagcactttgggaggcagaggtgggtggttcgctggagcccaggagttcgagaccagtctgggcaacatagcaagaccccatctctctacaaaatatacaaaaattagccaggcgtggtggcacacacctgtggtcccagctactttgggtcatacattggcaaggaggctaaagtgggagggtctctgaagcccaggaggtcgagactgcagtgaaccatgatcacaccactgcattccagctggagcaacagagcaagacctcgtctcaaaaaaaattaaaatgagagtgaaatgacgcaggaatgacggtaggctgcaattcagaatcacgtggtgttggcagatagcaggatgggtaggaaggtcgaggttttcccctcctgatccttgcaccatctgtgtgactttaaccaagtcacgttgcctgtctgagcctctgttttctcacctgggatgtagggtgtaaatttccaccccagggaccattgggagaattgaatgaagccacatgcagacgccctcagctcgctgctccattcacgcctggtatgaaatgtgttttggttcccttccacaatcctatgagtggatcagctttttgtgactcatcgttaagtcttcgagattcacgcatgtcgatatgtgggttgtagaaaaactgtgcctgggaaggcaggcacagtcactctgtcactaacgcacacttgggcgcagggtgcaggcgccaccagctgtacaggggctgtttagaatatggcccatccacctagctcctggctgtgtgtctcggggcaccgtatcttttttttttttttttttttttttttgagacagagtctcactctgttgcccaggctggaatgcaatgacacgatgtcagctcactgcaaccgccacctcccaggttcaagcaattcccctgtctcagcttcccgagtagctgggcacgcgcctggctaatttttgtatttttagtagagatggggtttcaccatgttggccaggctggtctcgaactcctgacttaaggtgatctgcccacctcagcctcccaaagtgctgggattacaggcatgagccactgcgcctggccagggcaccatattttacctgtgtaaaatgtgggaagtggccgggcacagtggctcacacctgtaattcagcacttttggaggccagggtgagaagatcactcgaggccaagagtttaaggaccaacctgggtaacatagcaaaaccctgtctctattttttaaagtttaaaaaaagtttaatgttttaaaaaagataaatgcatcatacaggatgtggccttttgagtctgtcgccagcgtccctgtcatgtgtcaggcattgtgggagaaatagcactcagtcataagatttatgttgactgtaggtctttatagaaacaaatacatttgaccaggtgcagtggctcaccctgtcagggtggcgagggtgaggggaccctctgtgcagcggggagagttggcttcctgtaggattcactgtctgtcctaacagaacaaaaatatggtcaatagaaaagaaacattacttctcctttcaaacattagcagatggagccctgtgattaaaacgatactttctgaaacaacaaggctttgctctgttccatgcaattaaaaataataataaaaaaagaaaaaaagggtcaggcgcggtggctcacacctgtaatcccagcactttgggaggccaaggtgggcgggtcatctaaggtcaggagttggagaccagcctggccaacattgtgaaaccccatctctactaaaaatacaaaaattacctgggcttggtggcacgaacctgtaatcccagctactcgggaggcagaggcaggagaatcgtttgaacccgggaggcggaagttgcagtgagatcgtgccactgcactccagcctgggcaacagagggagactctgtctcaaaaaagagaaaaagaaaagaatgactttctccccaacatgatgttctgagctcgtggattcacggtgtctccaacgcgtctgtttgctgtggcatctctccatgcctgtgcaaaaaacatgtactcaatcctgtttctttgacctgagaccatagccacaactgtgcatgcagatgtctgttggcgagtaaactatctcccaggaagagcatgcagcttccagctgtcttctacattttatttatttatttatttatttagagacagagtctcactctgtccccaaggctggagtgccatggcacgatctcagctcactgcaacctccgcctcccccattcaagccattctcctgcctctgcctccccagtagctgggattacaggcacccgccaccatgcctggctggtttttgtatttttagtagggagggggtttcaccacgttggccaggctggtctcaaactcctgtcttccaagtgatctgcccgcctcagcctcccaaaggtcttctgcattttagactcagattgagagtggagagacagatacaagccacctccagcaaccagccgccacatgtcactttcacatgcctggacctctcagggctcggacagggctttgatctcagggggcctgcctttgtctgtagtcacagcctggagcacagagggacacctgtaacagtagtgagcgcccctgtttagttctcctgggggttcatgatggcacaaatccacgccactggcttgcaaggcgcactggaagaaagaactgtacagcctctgagtttcgtggtggctctgcctccgccagcacccagaacaaaacagggagatgccacagcagccggcaccacactcggtttattagccagacagccatgatgttgaccttgctgtgggttaaaggacacaaaacctgaagagaaatctgtttatcatttgggaaattcatgccatccttgacagtatctggtgagcaagatggatgatctgccaggccggcccctcgcatgggtgaatcacgccatccttacggtacggttcctctgccggcttcagacacaaaaataacatttgtggggttttatatccagttctctggtgacccggggggtgagcagagagaagaaatctgatttgtaagattcacattgccctaaagatttatacggaccatttctgcctcttacgcttgtctcttctacatctttcaaaaaccggtttggcatgtgtttttctctttgtaacctgatttcccaggtcaaggacacagccttatgcgatggcggaagtttgtgccggttcaggacgataaacgggttgatcgcttaagttgcaaatgttttatttgaggttttgctctttctaggtatgaatacaaaatattccttgtagttggaatgtatttatggcaggttagtgtatcctggatacagtatgtccagaaaaggactcttaagataaatggtaaattgaagttaagttgctgctctatgctacattttcttttcagccaggtaacaagtattttgggctatctactatggtgctgatgttgactgagtgacctgctagggcccaagggagaagcagcaagagtaagacccttggccaggcacagtggctcctgcctgtaaacccagcactttgggaggccaagaagggaggatcacttgaggccaggagttcagcctaggcaacatagcaagacctcatctctacaaaataaaaaattagacaggtgtagtggtgcaagtctgcagtcccagctacttgcaaggctgaggtgggaggattgcttgagcacaggattttgaatcagccagggcaacctagcaagaccccatctccacaaaaaaaaattttacaagaccctgggagcagagagcatggcctgggccctcttacctggcactgtggggtcttactctgtgtcaccctcagtgggcatcaggggagagattgtgccaagacactgagctgggccaggggcagattctgccttgcaggcaggacctcagcccgaagccacatcttcctccaggacagtttctatctgcagaaattaggaaatggtctaagtctttatcccagacatcccagaactggaatccagcctcttttatcaggttttatgggctgttatcagaggccagagggatcactcaccaacagagcccagctggcatttcccactgggcacccacggcgaccccaacaaggcagaggagagtgtagactctggcttgtccacaccagcccagtcacttctgctgttggttacagcatggcttataccagcaaagagctcggttttcagaagcaggcagaaccagcaagtcccaaggttggaggtagaactctaaaatggaagagctggggaaacagggtgctcctcctctccttgcctctctccatcttcccctagagttgggtgctgtggagttctctgctcttcacaacaaaaaaacagctgggcatggtggtgtgcacctgtggtccaggaggagccgtgattgcaccactgcactccagcctgggccaccgagcaagaccccatctctaaaaacataaaagtaaaaataaaccaacctaggtcctgagacccagtgctggaggaccagaagctatagccttatgtttccgcagttgttgttttttttcttttttgagatggagtctcactctcactctgtcacccaggctggagtgcagtggcacaatcttggctcactgcaacctccacctcctgggtgcaagtgattctcctgcctcagcctcctgagtagctgggattacaggcgtgagccaccatgcctggctgatttttgtatttttagtagagatggagtttcaccacgttggccaggctggtctcgaactcctgaccttagatgatccactcgcccagccacatttcctcctaagggtcttcctaactgtggtgactacgtattgtgggcagccctcatttaaaacaatctgtctatgctttttgttctggaaaatatggacaacataactacacaagttatgatctagccaaagtgcttctgaattaccaaattatggggtttcattagaagaaatgacagcgataacatgattaataggagtttttttagcagaatgccctcatgttaagccttccgaagcctttcttttaaacccctagtttttctcgcaatgatgttatttttgttttttaatatggaagactagaggttactctcagtcaaaaaaatatgaaacagttcactaagacccacagaaaaccctaccgtctgcttctcctacagagcgtttaattagtatttcctagataaggaacgtagatggtcgtggtaaaagacagctattttcaggcacggtttctcgtgtgctttaattacagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggtaggttctcctctcggctgctgagtcaggaggtggcagggagtttgcaggaggagcaggtgaagggcgggccctaggccaagccaaccacagagtctcaacttgtgtaggcaccctttgagaacatgaaacatcctatagttgtgaacagtaaggagcgtgccgtctgcaggtcagtccccacctcctccccaccctgcacccccacggggaccagttagaagatgagcatggagtcagagtggactcgggaggatccacacagactgtctcttttttttctttttttttttttttttttgagacagtcttgctctgtcacccaggctggagtgcagtggcacaatctcagctcactgcaacctctgcctccccggttcaagtgactgtcgtgccccagcctcctgagtagctgggattacaggtacctgccaccactcctggctaatttttgtattttcagtagaggtggggtttcaccatgttggccaggctggtctcgaactcttggcctcaagcaatctgcccacctcagcctccaaaattcttgggatcacaggatcccaagccaggcatgagccatcgtgcctggcttagatgtatctcaatagagacagtctgagtaagtccagatttcttgaggccacagtctgagaccagcctgggccacatagcaagaccccatctctacaaagaattttaaaattagctggacatgttgatgtgcacctgtagtcccagctactcaggagcctaaggtgggaggatcacttgagcccaagagttcgagaccagcctaggcaacatagcaagaccccttctctataacagatttaaaaattaggccgggcatagtggctcatgcctgtaatcccagcacattgggaggccacagcaggaggatcgcttgagtccagccaggagttcgagaccaacctgggcagcatggcaaaaccctatctctacaaaaaatgtaaaaattagccgggtatggtggtgcacgcctgtagttcagctactcgggaggctgaagcaggagaatcgtttgaaccctgtagttttaggctgcagtgagctatgaccatgccactgtacttcagcctggacaacacagtgagattctgtctcaaaaaaagaaagaggtagacacccattagagcctggcatcctcggggctccagagctgggcagcgtccacccggcagtgccaggatggcttagtggaaggtctaacggaccccggttctcactctgctcactgagtccgtgatgctggccaggctgcctgcattctcagatccccctccacgaaactggagtaaccacgcctgcctgggagcagtgagtagcagcattttctagcaccaggcccgactggtaataatagtcattgttattttatcattgctgttcccgctgccttgcgaagccatctccatttcacagcccacagctggggcgggcagcccctggggaactcactccgtcaccctggcatcccaccgtgcctcagacctggcctcggcctggcacatgctctagccccctgggtgctcggcctgggttggttgtctgtgctctgtgtcactggtcatcagctgctgtggctgtaagaatgttacggtgtttcatcttttttttttttttttttgagatggagcctcactctgtcgcccaggctggagtgcagtggcgcaacctcagcttactacagcctctcggctcactgaatgccgggttcacgcgattctcctgcctcagtctcccgagtagctgggattacaggcatccgccaccgtgcccagctaatttttgtatttttagtagagacagggtttcaccacgttggccaggatggtctcgaactcctgacctcaagtgatccacccacctcggcctcccaaaacacagggattacaggcatgagccaccgtgtctggccttttttttttttttttttttttttgagacagagtctcaccgtctcactcaggctggagtgcagtggcacaatcgcggctcactataatcactgcctcctgggttcaggcgattctcctgcctcagcctcccaagtagctgggattacaggtgcccaccaccacgcctggctaatttttgtattttcagtagagacagagtttcaccatgctgccaaggctggtctcgaattggcctctggcctcaggtgatccacccaccttggcctccaaaaatgctgggattacaggcatgagccaccacaccagccaagcctattttgtcattttaaaccaccgtgctcctccagtgtggtgttaaccaggcagggttccctggtttaggcacgcggagattggaaacccaccctttctatctttatttcccaagggtgaaagtcagttaaaggggcagtgttctctgcagagcatgtaagcacaaccctaccgagtggttgcagtttgtctgctgctcatggaaaggccttgtgtgtcttttctttctcccatgggatgagaagagaagggaggccgagcatggtggctcacttgagaatgacaggtggcctgtaaccctagcactttgggaggctgaggcaggtggatcacctgaggccaggagttcgagaccagcctgggcaacacagtgagaccccgtctctacaaaaaaaaaattttttaaaaattattatccaggcatggtggcacccgctgtaatccctgctgcttgggaggctgaggtgggaggatcacttgagtccaggaggttgaggcagcagtgagccacggtggcatcactgcactccagcctgggcaacagagcaagacactatctcaaaaaaaaaaaattaaaaaaaaaaaaaagaacagagtagctgagttccactaaagtttgctcagtgatctaacagcctggaggttaggccagcttgtccagtggaagcctcccatccccatgtctgtatgcaacagacaaaacagaatgagagaaaaagtcatatcaatgagaccttatataattaagtcaattcataaaaataaaaatgtagctgttgatttgaaaaaatggctaattcccatatgttcatcagttattgaatcatgcagggattcctagacttgagtcatctcccacttcatagctcgtcacacatccaaggaagcagaccagttgcatcactcctgcccacctccttataggaagtggcatttcgtgtaaatgttgaaaatcagatagggtctagctctgttgcccaggccggagtgcagtggcacgatcatagcttactgcagccttgaactcctgggctcaagcaatcctcccacctcagcctactgagtagctgggactacaggcacacaccccaagcccggctattttttttttttttttttttttgagatggagtctcgctctgttgcccagggtggagtgcagtggcgcgatctcggcttactgcaatctccgcctcccaggttcacgccattctcctgcctcagcctcccaagtagctgggactacaggcgcccaccaccatgcccggctaatttttttgtatttttagtagagacggggtttcactgtgttagccaggatggtctcaatctcctgacctcgtgatctgcccgcctcaacctcccaaagtgctgggattacaggcgtgagccactgcgcccagcctttttttttttttaaatagagatggggtttcaccatattgcccaggctggtctcaaaactcctaggctgaagttatcatccatgccaccatcattgctggagttttccttgatgttggttttactgggtgaaggtttgtagctttcttcaggctctcaaatgggtctgtagccccaaaacaattaaaagtcatggctaggaaacatctaggagtcatacagataattttccaggaataatcatctgatttttttttccccattcagctgggaggcctaagcaaagagcaactagctattcatatatattgctttcccgaacatagcaagctccttgaaatgaaaatagattcttttaccatgttagcattaagtaaaattttctctttttttttttttttttgagatggagtctcgctctgtcacccaggctggagtgcagtggcacgatctcggctcactgcaagctccgcctcccgggttcacgccattctcctgcctcagcctcctgagtagctgggactacaggggcccaccaccacgcccagctaattttttgtatttttagtagagacggggttttactgtgtgagccaggatggtctcgatctcctgacctcatgatctgcccaccttggccttgcaaagtgctgggattacaggcgtgagccaccgcacctggccaaaattttcttataacaactaaaaaaaaaaaaatcataaggacttgggacatttataggctaaagagtttgaaaagcagagaaacacaggtttacaaaatcagtaaatttatctttaagttttttgttttgttttgttttgttttttctttttctttttctttttatcttaagtttaaaatgactaagccaggcgtggtggtgcacacctgtaatcccagctactcgggatgctgaggtagaacaattgcttgagcccaggagctcgagtccagcctgggcaatatagcgagaccctgtttctttagggaaaaaaattaaaaagactgataagaaattaatgtctcagcttcagtgctttctaggcagtaaacttttacttggaggcccccttcttagaagccagtgtgtggtgtttctatttcacatagaggatgtaagccacagagagaacaagccagccctctgtcgtctccctgccccggatggggagaggtgccttctgttctgtacactttatggggtcaaacgctggcccctctgatcccagtctccacttccacctaataagtcctgttcattcaagtactcccgtcaggccttccaggttatcactgatcctaatttgtatctttacaagcggtggccctctaaaccagcagcggaatggccctcagagaagtgagcctttctttctaagctcctgacaagcattgccaactcaatgcggctgtgctctccatagcgaaatgccctctgatcagcctgtgaagcgggctgcctgcccctgcctgggagaagaaaaggtatcaggaaaggggttttgatccacttccagttactttatttagcaaaggcagcctagactgcaaaagcagactttggaattggaatcggccggcctctcagaaaagcagagctgggcagctccctctcctctgtcctgctgtgattgtgggttgcctgccccgttttctcagcgagacctgataaccttgctaattgtggaaggagacgcaggttgccctctgatttgaggttgtacaagagaggtctcctgtttgctgtttggcctcctgagctctggcttagagatttcactgcctctgagaaacaccacaggtgttagcgtgacctcagcacatacaaagcctgaaggcttttttttttcctttttttttttttttttgagacaacggtctctctctctgttgcccaggctggagtgcagtggtgcaatcatagctcactgcagtctcaacctcctgggctcaggcaatcctcccatctcagcctcctaagtagctggaactataggtacatgccaccacgcctagctaattttttgtgtgtgtatttttgtagagactgagtctcactgtgttgcccaggctggtctcaaacccctgggctcaaatgatcttcccgcttcagcctcccaaagggcccttccggccaccgcaccaggctgaaggcttaagagaaacgtcactggccagatgcggtgactcatgcctataatcccagcactttgggaggctgatgggggtggatcacctgaggtcaggagttcaagaccagcctggccaacatggcgaaaacccgtctctactaaaaatacaaaaattagccaggcgtggtggcgagcacctgtagtcccaggtactctggaggctgagacaggagaattgcttgaacctgggaggcggaggttgcagtgagccaagattacactactgcgctccagcctgggtgacagagcaagactccatctcaaaaaaataataataataaagagaaatgtcattggttgtgtgtacggagaatgcaagagcaatgccaactccctggccaatggagagtattataagtctggttgaagatatatttctaccacatgtttgctgtaagctaggatgtcaccagcccaaccctgagcctttaaactcctgtgtctgattttaaccttgacacgtacttgtcccttcagatccctggctctcggtgacaatacctgtcttgcttctgttttctctctaggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaaggtaagtctccctgccccgcccgggccggctgcgtccgcattcatagacaggctgtttctttcaaatctttcacacacagctgatgagggacattgacccatgaccaagggaccagaggacagggcaaaaatatttttggatggtcatcagctaatgagtacctaagagggctggaaagttgtgtaactttttctctccagcagcctgaatctaaagatttttttagcactgggagcacttttaaccaaggagagcgaaacagctctgggggcgctgcatttggtttttgtgttgtgtgggtggctgatcgggctatcacagcatttactgagcatgtaccaggtggctagaggccttcctttgttatcagagagagaaataagaaatgcattttgtaggcagggcacggcggctcacgcctgtaatctcagcactttgggaggctgaggcaggcggatcacttgaggtcaggagttcaagaccagcctggccaacatggcaaaaccccctcactactaaaaaaaaaaaaaaaaaaaaaatatagccaagcttggtggcgtgcgcctctataatcccaactacttgggaggctgaggcacaagaatcgcttgaaccctgcaggcggtgaacagagattgagccaccgcactccagcctgggtgacagaccatgaccctatctcaaaaaaaaaaaatgcattttgtagatcaggaaacagaggttcagagaggttcggtgcctccaccaaggtcacccggcctggaaagtgacaaagcaaactcctgccacaacagatctctctcttgctgttatttcccagcctctggggatttggcctccctagaggaataaccccacgtgcacccacatgtcatctcgaatgtggattcatgttcttcttgcagcctgtaggctacagcataggaaaaatgcctaaagccaggtgtgctgtgcctcttggtttgcagtttctaagcgctggtcctcgccagtgagtccgcccctcgagcaccctcagtcctcaggtcacctatggtgctgggagctcactgggcggctgaactgcatcccttaggggcagagactgggaaccagctgctgccggtctgaccgtaagaagcggcagcctccctgatcagctaacgcagaggaccttaactaagagtgggcatcccaggggccgggcacagtggctcatgtctgtaatcccagcactttgggagtccgaggcaggtggatcacttgaggttcagagttcaagaccagcctcagcaacatagtgaaaccccatctctactgaaaaatacaaaaatcagccaggcatggtggcgcacgcccgtaatcccagctacttgggaggctgaggcaggagaatcgcttgaacctgggaggaggaggttgcagtgagcagagatgacaccactgcactccagcctgggcggcacagcgagaccccatctcaaaaaaaaaaaaaaaaagaatgggcatcccaggcccttgagtggctctgccccagcccaccccacccccgtccccgccacacacacacacacacacacgcgcacacaacatctgagccaggggtgggtatggaacccaggcctgtcagttcttaattcacccagaaattccagccaagcatcgccgttctcacccaacccgggaaaggactgctgaaggagagagagtgtctggtgcctcctccaggaaccctatgggggttcctttataataatagaggcttctattttctgagaactgccctgtttgccaggcactgcgctaagactgctgttcatccacacgactctgcttagatgtccttatccaggaaatacgaacctcggtgcttcatgcagcctagcagatttcaatagctcctatcagtagggaacgggaattcatactcagggctgtcagatttcaaagcagatgctcttaaatatacatccgctgcctctgtgctgcgagctgcccccctgggatgacccaggggcactgctgctgcccactgatgacctgcccaggtggtggcctctgccccattcagggcccctctagcgagctctggcctgcccttgggcctgtagtctaagggtctgaggtaggccatgcctcttgggcagccccaggcagcgctgtaagctgcagaggcctggtgccacattgcccccctaaaagttttcaacttatttttcgttttgttttttgttttttgttttttaaagtctcgctatattgcccaggctgatcttgaactcctggcctcaagcagtcctcccatctcggcctcccaaagcgctgggattacaggcatgagccactgcgcccggccttttcaatgtcttattatgggaaatctccaacataaacaaaagtagagaaaatgctgtcatgaacccaatagatctgtgcagagtttcccgtgatcccctcacccgagcagcgtgaagcttcctgcactagccaggaggcagccctcagcccttaggagggaggaggccctgacaacccaactccctgctgtgtttctcaccctggggcccttaggaaaggaccttagtccccgcaaatacatctccagggcttcccaggcctcccatctttccctcggcacaggctcggggcgccctcttgtgttacaaatgaattactgtttctgcggggcccagacctttccaaaggtgccctagtatccaaagccgctgtggtccgatggccttctcttcactcctgggggtgccggccacaaaggctgctccctagagaggccttctccagccccctgccagcccctggtcagtcgtctgtcccctaggagggaactggagggagtccccacggttggacaatccaactcctttctctggatccagcagctttgactccgctgtttgggttttctatggggaagatttaccttctcaattgcttctgagttctcatgacaaaatggcaagttaattaaggaaatcccttgcctaagctgtttattttatttttttagagacagggtctctgttgcccaggctggagggcagtgatgcaatcatagctcactgctgcagcctcggtgttctgggctcaagtgatcctcccgtcccagctactcgggtgcacgcagcctcggtgttctgggctcaagtgatcctcccatcccagctacccgagtagctgggactacaggtgcacgccaccacactggctaatttttaaattttttttgagacagggtctctctatgttctccaggctggtctcaaactcctaggctcgagcaatcctcccatctcagcttcccaaagtgcagagattataggcgagagccaccacgcccggcgatgtccttcaggattcagtttaaacatcatctcttctaggcaacttccccttctgcctccccaggtgtagggaccagccccacagggtctgtgggtctctccccgtgtgtggagacgagagagtatagaaataaagacacaagacaaagagataaaaggcagctgggcccggggaaccactaccaccaagttgtggagactggtagtggccccaaatgccaggctgcactgatatttattggatacaagacaaaggggcaggataaggagagtgaaccatctccaatcataggtaaggccacgtgggtcacatgtccactggacagggggcccttccctgcctggcagccgaggcagagagagagaggagacaaagagagaaacaacctacaccattattagagacttttagtactttcactaatttgctactgctatctagaaggcagagccaggtgtacaggatggaacatgaaggcagactaggagcgtgaccactgaagcacagcatcacagggagatggttaggcctccagataactgcgggcaagcctgacaatgtcaggccctccacaagaggtggaggagcagagtcttctctaaactcccccggggaaagggatactccctttcccgggatactccctttcccggtctgctaagtagcctgtgtttttccttgacactgaggctaccgctagaccacggtccgcctggcaacgggcgtcttcccagacgctggcgttacctctagaccaaggagtcctctggtggccctgtctgggcataacagaaggctcgcactcttgtcttctggtcactcctcactgtgtcccctcatctcctatctctgtatggcctggtttttcctaggttatggttatagagcaaggattattataatattggaataaagagtaattgctacaaactaatgattaatgatattcatatataatcatatctaagatctatatctggtgtaactattcttgttttatattttattatactagaacagcttgtgtcctcggtctcttgcctcggtacctgggtggcttgccgcccacacccaggcctggccgaggaactcttctcagtatccccatggtctcttgcacttacttacccccaccccacttttcactctgctgggaacatctctctggatacttctctgcctcccctactaaactgttaagttgtgcagggacaggtgaggacctgacattccgtcagagcaggtccttggtgagcatgtgctggtaacagaatggctctcatcttagcgttgtttcttttgttttgttttgttttgttttgtttgagacggaatcttgctctgttactcaggctggagtgcagtggcaccatctcatctcactgcaacctccacctcccaggttcatgcaattctgcctcagcctccctagtagctgggattacaggtgcgtaccaccacgcccagctgatttttgtacttttagtagagacggggtttcaccatattggccaggctggtcttgaactcctgacatcaagtgatctgcctgcctcggcctcccaaagtgcttggattacaggcatgagccaccatgcccagcctcatcttagtgttttgagatgctctatgcaaagtcctgcaagccggcactgtgccgtcccgctagcgggactggggatttgggctgctgtcccagctgggcctgaccttagtctgccatctcttcctccgcagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtacgacggctggctcacagggagcgccggtcggcccaggggaaggggctgatctgtccggaggccgccatggcgcacaggggtgaggctggggccggaggtggggcgctgggagctcggtgattggtccgttccttggtcccttagggttttttttttcttttcttttcttttcttttgagatggagtttcaatcttgttgcccaggctagagtgcattggcgcaatctcggctcactgcaacctccgcctcctgggtttaagcagttctcctgcgtcagcctcccaagtagctgggattacaggcatgcaccaccaagcccggctaatttttgtatttttagtagagacggggtttcactatgttggtcaggcttgtctcaaacatcctgacctcaggtgatctgcccacctcggccccgcaaagtgctgggattacaggcgtgagccaccacgcctggcagttccttaggtgttattggaggttttaactgcagagatgtaaggccacgtcccttcccgtcactgtcacatagttagaaacaggtggtatctgccatgacccagaaagaaaatcacctctcgattacatcatttaataagggagagtgtaggcattcatggttcaaaaggagtgaaacttttgtggtttagtttatatatatctatatttatagttatattcatatttatttatttttagagacaagggcttgctctgtcacccaggctaaagtgcagtggtgcaatcatagcttactgcaggctggaactcctgggctcaggcagtcctcccacctcagcctcctgagtagctaggatgccaatgcaccaccatgcctgctgattttttatagagacaggggtctcgctctgttgcccaagctggtctcaaactcctggcctcaagcagtcctaccacctcaacctcccaaagccttgtgattatagacatgagccaccacacctggcctgaacttttatttcttagtgattttgcagtgctttctcggggtcttctgccatgttatcttccaaattagtttgattagttctgtaattaaataaatgaagtcatttaagacctttgcatttgggaaagttcatgagttaatgaagacagattgagcatcttctagatctcagattctgagctaagtatttcaccgagttatatcacttaatcctcacagctcacaaatgtatatgagataccttattcttgtcattccttttttgttgttgttgttgtttgagacggagccttgctctgtcgcccaggttggagtgcagtggcacgatctcggctcactgcagcctccttctcccaggttcaagcgactctcctgcctcagcctcctgagtggctgagactacaggtgtgcaccaccacgcctggctaatttttgtatttttagtagagacgggtttcatcatattggccaggctggtctcgaactcctgacctcaagtgatccgcctgcctcggcctcccaaagtgctgggattacaggcatgagccaccgcacccagccagttctcttcattctacagatgaaaaatatagaactcagaggggctaaggaggtcaggccccagtgctgtcttggtagaacaaagtgcactgggatgaagtgtttggagtagatggaggaaacccactgaaggatcctgagttgctgatcatagctataaccatactctctgctgctagaaaccaagaattccagggccctgatggagatccctaagctagtgccttgccattgaccatctcaggtgctgcttcccattgtccctagggcacgataacattggggtaggtgctcctggttcaaccaaggtcaccctacgtaggtctagccgatggcagtggggccctcccagctgtgcacatgacacagtcatgggcagcacaaagtcacagtcaggctggaggggaagttgtgtctctcaccgggccctccctcccccataaggtccactggagttcctaaaggggcccagtaaaccacccaggctctgaacaaattgggaaactaaaatattaggtcagagtccaaatcacacctttattgcccatagaggcaaagtcacaagatgctgctcattgtgagaactgagcgcacctgctacgtggaccctagactcaggcaaacttccccacaatggcagccctggccccgcacaggcctccccgtgttccagctacctcccgcaaggacaaaatccaggattagccaggcgtggtaacacgcacctacagccccagctactcaggaggctgaggtgggaggatcacttgaggccagaaggcggaggttgcagtgagccgagatcacaccactgcactccagtctgggtgatagagccagaccctgtctcaaaaaaagaaagtccaggagctgcacagccagtttcttcattccaaatttagcaatcagatcaaaacagaggcagagggaggccagcagttagaacagtggaggtccctctacttggaaggaaacttcaacagtaatgaagcagaatgaaggaaatgaacggaaacgtggacaggggtttcctgaagcttctctttgccaggtgccatgctatcccatttccactttctttctttcttttttttttttttttttttttctgagacagagccttgctctgtcacccaggctggagtacagcagcacgatctcggctcactgcaacctctgcctcctaggttcaagcttctcctgcctcagcctcctgagtagctgaaattataggcacccaccaccatgcccggctaattttttgtatttctagtagagactgggtttcaccatgttggccagactggtctcaaactcttgacctcaagtgatccacccacctcggcctcccaaagttctgggattacaggcgtgagccaccacgcctagatgccatctctactttctagccacagagatgcgtgcactttgaagtctcctgcaattcacatccattttagggcatgtgtgataacgctttctataatatagacacatgcaaagccctaggttaccatctgggcatagatgctaccaattatacaaaacagttccaaaagtatgttccctggccctgctggagccacgtttgtttcccaagtcccccaacaggcctcagctgcatggcagtcactgccccctggccagggtacacaccctcgggtttctcagtttgctgcttgtcttgctggtcttctgacagtcatacccgtcacactgtagtctgcggtcattgtggggatgcctcttttgtgcattttagcactagcaaattcagtggtacacctgtggcaaagatagagaaggggagagaagaagaataccagtaggacctcaaaacttagtaagtaaaatttagtaatcacaggtctgggctgggtgtggtagcttatgcccgtaatcctagcactttgggaggccaaggcgggtggatcacttgaggccaggagttcgagaccagcctggccaacatgatgaaaccccgtctctactaaaaatacaaaaattagccaggtgtggtggggtgcgcctgtaatcccagctgctcaggaggctgaggcaagagaatcgcctgaacctgtgaggtggaggttgcagtgagccatgatcataccactgcactccagtctgggtgacacagcgagactctgtctcaaaaaaataaatgaatcccaggtctgaatccagagtagacactcaacaaatgcttcctttcaaaaataactccacaacaaagcaggctgggctgagtcaaatatgggatccaagagatgagtttgagctgcagagatctggaaaaatatcatggaagaggtatgaaatgagcaggctcttgaaaggaggattggagtagagaagaattttataagcaacgaaacaggtggaaggagaaacgaggggccgagcacagtggctcatgcctggaactccaccacattgggaggctgaagcaggaggatggtttgaggccaggagtttgagaccagcctcagtgagaccctgtctctacagaaaataataataataataataataataataataataataataataataaaataaatgaaggagaagtgagcattcaaaattagcatgaagtcgcttgtctaagatcacccagcaggggcgggcttggtggttcacgcctataatcccagcactttggaaggccaaggcgggcagatcatctgaggtcaggagttcgagaccagcctggccaacatggtgaaaccctgcctctactaaaaatacaaaattagcccggtgtggtggcacatgcctgtaatcccagctactctagaggctgaggcaggagaatctcttgaactccggaggcggaggttgcagtgagccgagatcacgccattgcactccagcctgggcaacagagcaaaactccgtctcaaaaaaataaaaataaaaataaaaaaagaccactcacccagcaggccaagggcagagggcagagcagagatgcagactgagtttcttctccaacactttggttctttcactaaatgctttgtacagaccaacctgccgttatacccgacagagcttcccgacactggatgtgttaaatccctaaccaagaacgtagttttttacgttcttttctcaggggttaaacaggaaaagtagattttcttttctcctgtcccactggaaccctcagggagtaacacttggtgtcaatttttgccccctcaaaaaaaaaaccgagctttatttcctcttatcctttcactttaagggaattagaaatatctctggctaaaggcaattaaaaatatctcaggctgggccgggcacggcctgtaatcccagcatttggggaggccaaggtgggaggattgcttgagcccaggagtttgagaccagactgggcaacatagtgagaccacgtctacaaaaaatagaaaaacaggcgggcgtggtggtgcatgcctgtgatcccagctactcaggaggctgaggtgggagaatcacttgaggaggttgaggctgcagtgagctgtgatcatgccattgcactccagcctggggaacagagcaagaccctgtcccccagcaaaaaaaaacatatctcaggctgaccatttacccaggattgatgacgagattgccagaacaacatgccacaggacactgctctcccctggaaaaacaggtccacccagttaggaactcagattctgaaccctcgcagccacggcattctgcgagccttgtgtgacttccctaaaaaccacaactgctcctggaagctcatctttctaggccagaagacagtattccttagaaatatggagacaaatctaggctaaaaaggatgatgtctcacatctgtggagcacaaagcatgtgccaggcactgagccaaaaaggtttttgtttgtttgtttgttttctgattttggttttggttttggttttttgagaaagggtctcgctctgtcgccgaggctggagtgcagtggcaaaatctcagctcaccgcagccttgaactcccaggctcagccaatccttccatctgagcctcaggagtagctggggcttcaggtgcatgccaccacacctggctaattttttgtatttttctgtagagatggggttttgctattttgcccaggctggtctctaactcctgagctcaagtgatctcccacccaggcctcccaaagccctgggattataggcatgagtccctgcacccggcctgagcagacagttttatagatatatcatcttattagtccctccatcagcacccaagtgcagtgctgctggccccattttacaggcaaagtctgcacacaggggccaagctcatgagcatggaaacacaagccccatgcctaacggtgtccgctccccaccccagccttagggcttatcacagcacacaaacagcggctggatagggggaagggtgacccctttttgaatggctactttgggtcctacatcatacatttaataccttatttaatcttaataacttctctgcaaggaagataccattctccacatttttcagacaagaaataagaaaactgaagttgtagccaggcgtggtggctcacccctgtaatcccagcactttgggaggccaaggcaggtggatcacctgaggtcaggagttcaagaccagcctggccaacatggtgaaaccccgtctctattaaaatacaaaaaattagccagttgtcgtggcacgtacctgtagtcccagctatttgggaggctgaggcaggagaatcatttgaacccaagaggcagaggttgcagtgagctgagatcgcaccactgcactccagcctgggcgtcagagtgagactcccttctcaaaaaaaaaaaaaaatgaaaaatgaaattttcttatttctcacagaatgctatggctatgaggttaaataacttctccaagttgcacagctagtaagcaccttagccagatatccaacccaagtgtgcctgcttccaaaaagcctgtactctggttttgggtcgggctgggaccaaaccttcactacccatatagcctcccgcctccccaaccagaataggtggggtggagagtttcaccccaactagcagtctcactgccaaggaacttgaaagccatagcgcccaggaacctgttcacagaagccaccatttcctgggctcccaaggtagccccagggaagggggaaagacttacacaccttggaacttctggggggcttctcagaacctttcctttctgaaccagagctcacaaatctttcaggacaaggttcagagctcactgcacgcaggaatcaaataactccatagcagattcacaaccccctgcaccccaccagagttcaataccctgggctaagctacagtaggatcttccccaggggagtccccacagtcagcacaggacccggcgcagagtaggagcccagaaaacctttgttttttttttcccttgagacaggatcttgctctgtcgcccaggctggagtgcagtggcagtcttggctcactgtaacctccacctcccaggttcaagagattctcctgcctcagcctcctgagttgctgggattacaggtacctgccaccacgcctggctaatttttgtatttttagtagagacaaggttccaccatgttggccgggctggtctcgaacgccgggcctcaagccatctgcccgcctcagcctcccaaagtgctgggattgcaggcgtgagctaccatgcccagcctcagaaagccttattggccgggcttggtggcttatacctgtagtatcaacactttgggaggccaaggcagcagaatcacttcagcccaggaggtcaagtttgcagtaaactatgatcttgcccctgcactccagcctaagcaacatcatgagatcctgtctctacaatattttaaaaatttaggcatggtggtatacacctgtggtcctagctactcaggaggctgaggcaggaggatcacctgagcctgggaggtggaggttgcagggagctatgatcacaccactgcatttcagcctgagtgacagagcaagacactgcctctaagtaaaataaggaaaggaaaaaaaaaaaaagaaagaaaaaatacagaatttggtggaattccaccctaccctggaccacaagcccccaacctgaccttctgtggctcagagattaaaattgtcactttggccactatccaataattggtcctctctcctgaagtcctgatggatgcagcggttatcaggcagtttcactgatgaactcacccagccttcgttactgcacaccaggcgccagtgcaaggcctgggtgtacaaagaataaataggaccttgcctttctcagtctagttggagcgggatgggatgggatggaggaaacgtgtcactcgataagaaccctggccagaagtggtggctcatgcctgtaatcccagcacttggggaggcccaggcaggaagattgcttgagcccaggagctcaagactagcctgggcaacatggcaagactccatctctttaaaaaatttaaaaattagcaagcatagtgacacagttgtggtcctagctactcaggaggctcagatgggaggatcactcaagcccagtagttggaggctgcagtgagctgtgatggcaccactgcactccagtctgggtgacagaacaaggccttgtttccaaaaggtttttgaaaaataaaataagtggccggacgcagtggctcacacctgtaatcccagcacttttggaggccaaggcagatagctcatgtgaggtccggagtttgagaccagcctggccaacatggtgaaaccccatctcttctaaaaatgcaaaaattagctggatgtggtagtgggtgactgtaatcccaggtactctggaggctgaggcaggagaatcgcttgaacccaggaggcagaggttgcagtctgcggagattgagccactgcactccacctgggcagcaacagggaaattctgtctcaaaaaataaaaattaaaataagtgcccgcggcaatttgttgcagtggagaataggggagtggtgtcccagccctgggatggctcctggccaggcccggaggggtgggtggtgactctggagaggggctgccccgtggcccgagggtcgctggaggggcacggaggggcctccaggctggacggagcaggagccccagagagaggggtctggctggggtagcaccagaggccctttccccagcagcacccccctcacgtccccgccgcttgttgtcttgtaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggccgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcctgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatggtgcattcattatttcttaagtttaattaatattacttttttttttatttggggggtgggagggagttataattttaaaggtatgctctggctgttccacctccgtgtgcttgttaattaacttgtaggactttgactgtaagatgtgaaaccacgtttcttgcatgatgttttagagattatttcatttacagtcttttaacctgcagctgcagcacttagttcacgttttcacaaatttcaagagtcactacactaaagacaatgccttttcatgaataagaagttttcagaaggctctagggggctgggaggcaggctgttcgtttgtcttttgttgggggtatcatttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcatgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacaaaagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaagccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttgcaaggcccgcatgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaagaatgtgtgggttgtttttatttaaagtgctctggcctgaggacgagcagcaaacactgtcattcgaggtccaaagggcacctcaagaatcgccgttcccgaggtcgtcccctttgcacctgtccgcaggtcctcgggcgtgtggcttccgggcacacagaaaaccgtgtggttctaggatacatggggatctcgggcactgctctgtcaatctgcatctggttcacaggaagggcttcgccagggcctgcgttcctacttgctgttgtcaccagcactgtttgcctacccttgaaccaagcccttaccctccctggcgtccgcttccttttctgtaaaatggagacaccatctcctgtcatataggcttgctgtggggaaccaggaatggtggccagtgctggtgcggcactgggctggtggtggcagccccaatcgatggcacttgggcgaccaggactacggccagtctcctctgccgtgtggcctgcagctggtcagtggcgtggcctcagccttctgtgtgggggtctcactgtgcccctgactcctgatgtaacagaaagacaagtgaaaggcaccagttaatgcttgcgagtgggacagtggcttgcgggtctctggaatgacggggctactgagaagagtctctttccagatggcgctcgggctggaggtggggggagagctctgcagaggtggctgttaggcttctccgcgcagttgtgactcagaggctgttgctcgtcttgggttggaaaagagctgtctgccaggccgacgtgtgtctggtggaagtgggggatgacttggtcgcatattaatttggagatttcagattgtgaaatgtccacatgtgatacagaatcgtaagcccctctcccaattcaactggattcaatcctccctccagtgggagaacccagagtatgggatggagacaccccccagtgccaggtgccctcggcagccccgtgtctgatgcagtcacttagggccgggggtgtctctagagttgcccaaaatgctggtcccctcagataggagaggcctgcataaaaccctaagagctggcccagcgcagtggctcacgcctgtaatcccagcactttgggaggccgaggccggtggatcacttgaggtcaggagttcaagaccagcctggccaacatggtgaaaccccgtctctactaaaaatacaaaaattaaccaggcatggtggcgggtgcctgtaatcccagctacttgggaggctgaggcaggagaattgcttgaacctgggaggcagaggttacggtgagccgagattgtgccactgcactccggcctgggcgatagagcgaaactcagtctcaataaaacaaacaaacaaaaaaataaccctaagaactctgccagtttggtatttgacagactgaagtctaacgtggttaatttttctgtttgctagtttaggtatgcccctatgtatttcatgatctgctaactaaattaaaataagaaatgttaaaaaaaaaaaaaaaagaaagaaaagagaaaggaaggaaggaaaggaaggaagaaagaacagttgggcacagtggctcattcctgtaactcctataggcccagcactttgggaggaggtcaaggcaggaggatggcttgagcccaggagtttgagaccagcctgggcaacatagtgagaccccatctctacaaaaaataaaaaattagttgggcatggtggcatgtgcctgtagtcctagctactctggaggctgaggtgggaggatcacttctgcccaggagttcaacgctgcagtgagctatgatggcaccactgcactccagcctgggcaacacagcaagaccctaaatcttggggggaaaaaaaaaaaaaggaacacttagctcaaagtctttttcctcagaaagttgagacaggatctcagtctgtcaccacctcctcctcccaggcttaagcaaccctcccatctcagcctcccaagtagctgggaccacaggtgtgcaccaccacgcctggctaattttttgcagagaaggggtttcaccatgttgcccaggctggtctcgaactcctgagctcagaagatccacccacctggttctcccaaagtgctgggattacaggcgtgagccaccgcgcccggccccttatttgttatttgtttcgtttcgttttgtttttaagatggagtctggctctgtcacccaggctggagtgcaatggtacaatctcggctcgctgcaacctccaccgcctgggttcaggcgattctcctgcctccgcctcccaagtagctgggattataggtgcccgccaccacacctggctttttttttttttttttttttttttgtatttttagtagagatggggtttcaccatgttggccaggctgatctcgaactcctgacttcaagtgatctgcctgcctcagcctcccaaagtgctgggattacaggcgtgagccaccatacccagccgcgttccttatttgatgctctgaagaaacacaattgcaggtagacagggtggcgcgacgtgatgatgagatatattagagcacttgaattgtctgcaatggtcctgtgtgcttctgttacaaagcccctctgagtggctgcctgggggcatgctgctcctctccacggtcttaacatgccagctttgggggcacacagcttgctggtgtctacttcagctcatcactgattcctgtgaggtggcagaggcctgggcctgcatgtacggacccaaccagggaactgggagggctccacagagctaccgtgatgttgcccaggctcccggccagtgggccgttgcttagcaaccgactcatgcagtgtggagtgaccggcctccacagacaggggagacacagcctgggcccagccttaggcaggcattgctgaagttcctgtcttttccaagaagttcagactcttagaataccaacaggaagggccctggtcgagcatggtgggtcacgcctataatcccagcactttgggaggctgaggtggacagatcacctgaggtcaggagtttgagaccagcctggccaacatgatgaaaccccatctctactaaaaatacaaaaattagccaggcatgatggcacatgtctgtaatcccagctactcaggaggctgaggcaggagaatcacttgaacccaggaggcggaggttgcagtgagccaagattgcgccactgcactccagcctgggcaacagagtgagactctggctcaaaaaaataaaaaataaataataccaatacgaagagcccttttttttttttaagcagaatcaagtatggataagtaatagcagagcttcccatttggggcagtggtgtggcctccagggagcgggatttgaggacaaccctcccattgttcagggaggcgtcagtgtctctgtggtcaggagacactggctgtatcaggatcccagcagcgtctcttagtggctgatgaccgtgagcaagtcttaagtcgatgctcaggaaatctttgaaagaataaatgagtttaacttcctagtgcttctgtttctgtctctgtaaaggggatataaaaagccaaactcggtcgggcacgatggctcacacctgtaatcccaaggctttgggaagccaaggcaggaggatcacttgaggccgggagttcaagacccaccctgggacacatagcaagaccccatctctacgaaaatgtttaaaattcgccggatgtgctggcacatgcctgtagtcccagctacttgggaggctgaaggatcgcttcagcccaggagctcaaggctgcagtgagctataattgcaccactgcactccggcctgggtgacagagtgagaccctgtctccagttgaaaaaataagaggtaggtggctcatgcctgtaatcccagcactttgggagccgaggcgggtggatcacgagttcaagagattgagaccatcctggctaacatggtgaaaccctgtctctactaaaaagacaaaaaaattagccaggcgtggtggcaggcacctgtagccactcaggaggctgaggcaggagaatcgcttgaacccaggaggcagaggttgtagtgagccgtgatacctccactgcactccagcctgggcgacaaagcaagactccatcatggatggatggatggatggatggatggatggataactcacagggttactgagaggacccagtgagaagacctggaaaccactcacccagcacccagtggcagggcagagcctggaaggatccaagtgaggcctatgcagttactggcagtggaagcagcagaggactggctggccctgccagggtcttgctgcccgtggccaggccccatctcctggggtctttagtctcctctaacacacatggcctctgggtttggctgtgatggggtgggactgagccgtggtagatgcttacatcagacggattgcaaagagggccagctgtgccccagcctgggagaccctgcagctgtgggaatcccggtgcaactttccaactgaggaaacagatgcttgccgcggggtagtatccactcgcccgtgagctaatacataccgaaggctgaccgtgggccgctgccttacacgctggggttattacagggcaaaccaggagctcaccttcttgtgggagggacagacagtagacgtaataaataagtgaatgagatagttgcttcgaaggtgatcaatgttataaggaggatgggaagagcaagtgaaaagggttaaactttttttttttttttttttggagatgaagtcttactctgttgctcaggctggagtgcagtggcgtgatctcggctcactgcaacctccacctcccaggttcaggcgattctcctgcctcagcctcccaagtagctgggattacaggtgcatgccaccacgtccagctaatttttgtatttttagtagagacaggggtttcaccacattggccaggctggtctcaaactgctgatctcaagtgatccacccgccttggcatcccaaagtactgggattacaggtacgagccaccacacctagcctttttttttttttttttttgagatggagtctcactgttgcccaggctagagtgcagtgacacaatttcagctcactgcaacctcctcctcccaggttcaagcagttctcctgcctcagcctcccaagtagctgggactacaggtgcacactgccatgcccagctaatttttgttatttttagtagagacaggagtttcatcatgttgtccattctggtctcgaactcctgacctcaggtgatctgcccgcttcagcctcccatagtgctgggattacagatgtgagccactgcgcccagccgaaaggggttaaagttttaaatcgggtggtcagggtaggcctccctaagaagttcacttctctgtttaatttattatctttttctctttttttttgagacagggtctcactctgtcacccaggctggagtgcagtggtgcgatctcagctcactgcaacctccacctccggggttcaagcgattctcctgccccagccttccgagtagctggaattacaggcgtgcatcaccatgcccggctaatttttgtatttttagtagagacggggttcaccatattggccgggctggtctcgaactcctggcctcaagcgatctgcctgcctcggcctcccaaagtgctgggattacaggcatgagccactattcccagacagaagttaacttctttttttttttttttttttgagacggagtcttgctctgtcacccaggctagagtgcagtggcgtgatgtcagctcactgcaacctccgcctcccaggttcaagtgattctcctgcctcagcctcccaagtagctgggattacaggcgcccaccaccgcgcccggctaatttttgtatttttagtagagacggggtttcaccgtcttggccaggctggtctcgaactcctgacctcaggtgatccacccgcctcggcctcccaaagtgctgggattacaggcatgagccatcgcgcccagcccagaagttaacttctaaacagtactggcagagctgagggaacgagccctgcagatgtgagaaggaaggacgttctaggcagtgagaactgccagttcaaaggtctcgtggtgcaaatgtctctggaaaccagcatggccgcagcaccgtgaccaggaggaagagtgggaggcgatgaggtcagagagaccaaggagaggcggagcatgggggccttgtcggctattgctgaggctttgttttttactctgagtcaactgggaggcattggacggtttgaacagagggtcctggctctggtggggaaacaggaagtaggattcattggtaggagtgagtaaggaggggtcagcacaggggaagccctcagaagctcacccaggaggccacaactggggctgcgtttaacccccacagccatgccagatgagctgcttctcagccaccacgtgggatcgatttcttccacattgaacttggtcaaggcccgctgctttgtgctgtggatcttctggcagccagggaacttagacttggccctgcatatggcctcaatcacaccctcatggttctgctcttagtacggatagacacaatgacctggccaacataaaccctggctgtcacaccctggggctttccaagggcaccccgaatacttgcctggtgcctagaccacagacagcacgaggtcagagacacaaatgtccagtggaaagaattgtctccaacgttccttagggcaacccatgtaagaaacagactgtgtggccgggggtggtggctcacgcctataatcccagcactttgggaggccaaggtgggtggatcacctgaggtcaggagttcaagaccagcctggccaacatgaagaaaccctgtctctactaaaaatacaaaaattagccgggcatggtagcgggcgcctgtaatcccagctacttgggaggctgaggcaggagaattgcttgaaccccggaggcagaggttgcagtgagccgagattacaccactatactccagcctgggcaacaagagcaaaaatctgtctcaaaaaaaaaaaaagagaaagaaagaaacagactgtgtactttactgaggaggctgctgtttgcaaccactgcaccctacaaggtcactattttttttaagagacagggtctcactctgttgcccaggctagacggcagtggcataatcatcgctcactgcagccttgacctcctgggctcaagcaatcctcctgcctcagcctcccaagtagcagggacaggcgtgcaccaccacacacggctaatattttaattttttgtagcgacagtctggctatgttgcccaggctggtctcaaactcctggactcaagcaatcttcctgcctcagcctcccaaagtcctgggattacaggcatgagacagttgcacccgaccaactttttaaaaggctctctctggctgctgcttggtgcccagatcataggttgcagagggaggccaatgaggaggctgatgccatcatcacaatgagaggtggtcatgactcggactaggtggcagcagtggtaaaaagagactggattctggagatattttgaaagtagagccaaaaatgagacttaaggcaggggcagtggctcacgcctgtaatcccagcactttgggaggccgaggtgggtgggtcacttcaagccaggagtttaagaccagcctgaccaacatggtgaaaccctgtctctactaaaaatacaaaaattagccaggcgtggtggttcatgcttgtagtcccagctgctcgggaggctgaggcaggagaatctcttgaacccaagaggtggaggttgcagtgagttgagatcatgccactgcactctagcctgggtgacagagtgagactccgtttcaaaaaaaaaaaaaaaaagagagagagagagacttaagacagattcagcatcaggagtgatggagaggagtgaggctacctcccggggtttggtctgagccaccgaagggtcgcagagagctgggtcaggccgggaagggggtctctgcctatccctgcagatgtcacctcccgaggctggactacaggggtccacacttgggcttggggagtacagacttggggaggaagggatcaggctgaaattcagacctgtgaaggttgaaatgccagtagaagatcaagtagaagataaatccaaggagaggcgtggactggagtcccacactggggaggcatcggcttgtcaatggcatcccgcatggccagagcggatgagggggcagagtgaggcatctgcggatggtccctgtgcagcagcggcaagaagcttagcagggagggcaaggaccagtcaaggaaacagggcagagcagccagccggggaaggaggcccaggagggtcggtgacctggaaactagctgctaacacagcagctcagatgagagccgaaaaacaaggacgtggcaatgtgcggaggtcattagggaccttggcaaggacagtcagcgtgaggggtggcagagtctgatgggaagggcttgaggaattggaggagcggaattagacgcttgagaagagacagcttcttcaaggagttttgccagagtggggtcaagggaaggggcgtgtgtgcatgtgtacatgcctgctaggagaacatgcttgcatgcatgtagaaggcaagagccggtgctgcaggagagggtggcattgctggagaccccattgcataggggtgggggccagcacctgcaggcatggggagccggctgggggggctcagtggtcacctgaggctacctgcaggatctacaggtgcagaggcagggaggggtggatgaggcagcagcttggccccctcagtgtcctcctagcagagataccatgtgcaccgagcgtctccaccattcctacctggcctgcaagtgatttaataagacaggggcagccgggcatgtggctcatgcctgtaatcccagcactttgggaggctgaggtgggtggatcacctcaggtcaggagttcgagaccagcctggccaacgtgacgaaactctgtctccactaaaaatacaaaaattagccaggcatggtggtgcatgcctgtaatcccagctgcttgagaggctgaggcaggagaatcacttgaacctgggagagagaggttgcagagagccgagatcataccattgcactctagcctgggtgacgagtgaaactccgtctcaaaagaaataaaaaataaaaagacaggggcccctcgcgccttcaggaaaaccgtaggtacaacaccgctggcctcgctatgataagtctctgcatttaatccttctgcagtcagaaatcatgcctagactttttttgggcgtggtgcagagagggacagggtcttgctctgtcacccagcctggagtgcagtggtgcaatcgtagctctctgcagcctggaactcctggactcaagcgatcctcccgccttagcctcctgagtagctgggaccacaggtgcacaccaccatgcccggctaagttttgtatttttctgtagagatgacgttttgccatgttgcccgtgctggtctcaaacacctgagctccagcgatgctaccacctctgcctcccaaagtgctgtattccagccgtgagccactgcaccgggccctcctgaagtcttgaccttaaagatgctttgattccctcctcccctctgtgaggtgccccctctaggatgtctttgtgggttctcccagaggatgaggtcccagtctttcctgaggggaaggggaccgtcttgggcccttgcaccacagactccttttctgagcccctttccctgtcttatgctcacttatccacccgtcgcctgtcatccctctctcccctaaacaaaatctgtccctctctcctgggtttctgggttgcagatggtccattccacacactctatgcttctcaagatcccctctcgggcacacgttactgctcttccaccagttctgcccatcgggctgtgccttgcagccctgcatgcccccaccacctcgacgacaacaccttcgcctcgctcagcctctctgtagcttctgaccccctgaccctccatattcattgaccctcctgcctcatcttggtgccttcacatgcatcctcctgctgtctcccctgcctcctgctgcctcttctcagggtctttgcgggaccccctttgtggatcaccccctgaagctctggccacctcacagcagcactgtctcaggacctgtccaccacccctgattttctgtattagctgttcttgcattgctatagagaaatacctgaggctgtgtaatttatcaagaaaaggggtttctttggctcatggttctgcaggctgtaccagaagcgtggcgctggtgtcggtttggcttctggggaggcgttggaggctttactcatggtggaaggcgaagtgggagcaggtgtgagacatggcgaggccaggaggaagagagagagaatgggggtgggggaggtgccacgctccttaaacaaccagatccctatctcagagacagcaccgcgccacaagggacccgccctgtcccccaaacacctcccaccaggccccacttccaacactggggattaattacttttttttttttttgagacagggtcttactctgtcacccaagcaagagtgcagtggtgtgatcacagctcactgcaacctctgcctcctgggctcaggtgatcctcccatctcagcctccctagtagctgggactacagctacaccaccacacccagctaattttttgtgtgggtttttttgtttgtttgtttgtttgtttgtttgtttgtgtagagacagggtttttccatgttacccaggctggtctcgaattcctgggctccagtgatcctccctcctcagcctcccaaagtgctggaattataggcaagagccactgcacctggcttgattacatttcaacatgagatgtggacagggatgaatatccaaactatataattccacccctgccccctcacgcaaatctcatgtccttctcacattgcaaaatacaatcatgcctttccaacagtaccccaaagtctttttttttttagatggagtttcactcttgttgcccaggctggagtacaatggtgccatctcagctcactgtaacctccgcctcccaggttcaagccattctcctgcctcagcctcccaaatagctgggattacaggcgtccgccaccatgcccggctaattttttttttttttttttttgtatttttagtagagacgagttttcgccatgttggccaggctggtctcaaactcctgacctcaggtgatctgcccgcctcggcctctcaaagtgctgggattacaggcgtgagccaccacgcccacccccacagtcttaactcattacagcattttggtcacaaccatcgaacaagtctctaagaagttccaaactttccctcatcttactgtcttcttccatgccccccaaacgcttccaagctctgaccgttggggccctagatctcctcaaccagcatatccagcctcaggtccacaggtccaaaccccaccacacacatgcccttagctgttcacaagcaccttcgtgcttaccagaaccgagccagccagctgcccaccccttcccccacagggggccaggcccgggcctccccacctgggttctgtacagcgatggggtccacagctctctctccagctccttctgtgtcctcgccccagagccctgtactccagaggttgaagaacttgccgaagatcgtgaaattcataaaaggcagggccagaatgcaagcccggttctggacttgacatcaagtggccaccagagatgtcaccccagcttccccacctgcgtgttccagcctccagcagagaaggcagggtgaggcagccggtgggggataggggaccctcccgtggccggtgaggccctgtccttctctaagtacatctaactgaggcccctctctggtggaagcccgcacagccagtctcctggccttcgcttcctcccagcgtggagtgacagtttcaaagcacagctctggttgctgctgggatccagctgggctctgggacagtgtccagatcctgtcccctgcagcctccagttctctgtccacccccctctacccacagccttccctccagtctcaccgtctgccagcctctgctgccctgtcttacccagcctgttctctctgcctcaccagcagccatcccccaattctgctgcccgtgcaactggcctgtgctcctatcaccccaagccacctcttcagggatggcctcccccaaccactcagccctgcaccctcagatcccctcaggagctaacccagtgcccagagcatctgcagcagcgccaatggccaggcctccaggccagcttaacacatgggccttttccaggatagcgggccaccagcttggaactggggcagcctaggatagagggtttgcagccaggatgctcacacctgcacagaatgtcacctacatacacggcaggactgtgtgcccacccctgcagtagcagacacaggaacaagtgcacggggaccaggcccacgcaccccatcatctccctggtgcccacggatggtgctgggagctgcaagttgctgccaccccagggacctgaccaagaccacactggggtggtcacagactgggggcagataaaacaggcagtgcaaggaatcatctcagcagctttttatccacccctcttgccaggcgcacacctccagggaaaagggctcactctggccaggcaaaagtcacctctgcaaaggttctccatctcagccctgtctctctgtcccccaggccctcatccctgaggtggaatgtggcttccctgagccttgttggagcttaacgccctctttttatcccaggagtctgtccccatggtcccagcacggttcttggatgtgctcctgtttgtggccaaactgaagcatcccctcccttggtccaggaccttcacctctattaatgtgacccaaggccccattagctttctggtggtttcctctccctacatctcacaaccgctgtccacctcccatcctaagcatgagtggccggctctgccatcccatcccacaggccaggacccaaggactctgtactcaggccaggagggcatggtatttatcgtctctctggacctctcccctttggggtctccttaaagtccctgcaggtggcccagggccagccccaaccctgcccccgacagtcctccctccaaggccgggtcctgccttcaggtcctgcctcttccctcatcccctcctcacttccgcagataccaccttcctgccagggacccaggggctcagtgaatgtctgaaggaagaaatccatttaggggcccagtgcggtggctcacgcctgtaatcccagcacattgggaggttgaggcggacagatcacttgaggttgagaccaacctggacaacattgctaaaccccgtctctactaaaaatacaaaaattaactgggcacggtggcaggcgcctgtaatcccagctactcaggaggttgaggcaggaaaattgcttgaaccttggaggcggaggttgcagtgagccgagatggagccactgcactccagcctgggtgactgagtgagactctgtctcaataaaataaaataaaataaatccattcggggcctgaacgaggcgagactctggtgtgagcaagggcttagacagagctgggggtggatgccttgggtttggtcccaggtcgggaagcctccgttctttgactgtaaaatgtgaatcgtcttttctgactcatctataaggacttggtgtgcagtgggaacccaggagcatgtggaggtgaggctgggctgccccatcctggcccaggacactgagcccagccagggcaggtatgacagccggtcagcaggccgcgcagtcagggatgagtccacggaggaggccgcacataccatttccctggcactgcccacagcctgcagcctttgtgcatttctgaggccacagtgccccctggcggctgtgcagcctaccccaaaggacagcgtcctgggtctcaggcctcagtctccctctctgcggccccaacagctcaccctaaacaaggtttattgttaccatgttacatgtcaccatttgggaccagaaagggggatccagtggccctgagccgcacagtcaaccagaaacagggccaaacctcaccctcagggctgcctggctcctgggtcactgaagtcctgcctggcaatgcgtgcttgggtctgggtcccttccccgacatctctcaccctcctgcagggcaggaaagtcacagtttggatgctttgttataaagatgaccctggcacctggaggagggagagacagacagggctgtgggtcgggggactccttggggaccacgccaccccaaccactgcagctggagcctctgttgggggcgggaccaagcacctctgttgtcagcccagaggtggcacccctacgcgctccactgcacccccgcggctttctctgcctctcctacccccaggcttcccactggacattatcccagaacatcagctaggaagcaacctgagcctccttgcccctgcctgacaagcaaagtgaggcccagagagggaaaggggctggccagggccccccaaacagccgtgggcagagccacgttgcaccggtttctcctaatccctgacctgagctccttctcctacccaggggatttcatcaatccagagagtgcttggggccaggagtgcctctgacagtcagggagggcttcctggaggaggccctaggtctaatggggtcttctaggcagtggtgagttgggagggaatagccagcactctcacagcatccaggcagccctgcttccagaccgtgggttggagaggcagaaccaggggagggcaccaagggtcccaccaggctccctctgacggccatgtcttcctttggccacaggacgctgtgcagagctgcaagtccgtatcactgaggctgtggccacagccactgagcagagagagctgatcgcccgcctggagcaggacctgagcatcattcagtccatccagcggcccgatgccgaggtgagcccacccccctgccccatgcccatctcgctacctgcccaactgacttagcctctgcaaacactgacttcccagattagcctgtgtatcaggcagctggtgacaacccagaagggctgtcacctaaaaccattgggttctccctgcttactccatgaataccaccctgcctccgatttggggtgacaggccatggggcagaggccacagggcttcctagcggtagcacagaggcccgtctttccaggcactgccctgagagcagaggcagaggcaaggccaggaccatgcacccatctcccagctaaaggacctggagcccagagatcacagcaggctgggacataaacagcccagggagagcatctcctcgcccacctcccattctgtagagtccacagtgggactccgggagagaagtctgggctgtcccaggtcacgtggcaggctggttgcagggccagggaggcccaggtgtctgatgcatgtcaaagctgagtggctgcgaggagagctgcactgctgctgaactctggcctcaggagtgacttagggcccagccatctcttctttggtagctcatgtcacgtgtccaggtccgggccctcctgcagccagcctgcaccccggatggccccacccactccttgccacacccaccctgccatttgccttggccatgctgaaagggaatattccgtgcccattgtgcggaggcacctcctcatcgcttcctgtcacctgcagggtgccgctgagcaccgcctggagaagatcccagagcccatcaaagaggccactgccctattctacggtaaggagaggcctgacccatgggaggagggaggaggagggaagaggagacaggtgataccgcctaagaacacagatccccaaagagtagtcccttcctctaagaaggtcaggcccccacgcctgcaatgcagcagcaaccttcaaagggtcgggtaaggctaggtgtggtggcgcacacctatagtcccagctactttggaggccgaggtgggaggatcgcctgagcccaggaattggaggctgcagtgagctatgatggtgccactgcactccagcctgggcgacagaccgagaccctgtctctaaaaaacaaaaaggtgaatgagccctcaacctgcctttctggatcttagactgacaccccccaccttggggccctgacccttcagccctgccggtggcctgtgaaaggctggtgagtggtggtcagccaggcctcactgccaaagtgcagccggaggtccgtgcagtgaggggaaggcagcctccttgggtattgaggacagaaactgaggctgctggactgggatactgggggtgtgcccatgcctccccagttcccctcctgcccctttgcttccccaggggatataggcctagtctgacagctgcaagggtctcagattcaaggacagagtgactgggaggggagttctgggcctggccctctgacagcgcagacgggggtgctgggcccttccccagcgtgcgtattgtcaggtcagcccctgccatccattctcacgctccccggttcccctggctgtcccctccccttccccgacctgcccagcaccagggagtcagacaccatgtggcttctaccccatggcatttggcagaaatcccccagggctgggggacccaccccaaagggccgcctgctgggttccacctcctgccaccccccaagccaccctcctctacctgctaggacctgcagcaccagccagcggtgccctcccagagggccaggtggattcactgctttccatcatctccagccagagggagcgcttccgtgcccggaaccaggagcttgaggccgtgagtcacatccttctctccctgatgctccttgggcccaaggacacagttggggaacacacaggctttcaggagagagatgtggcacagaccgtaaacctcagggggaagagatttgttctgtgcagtcagggagggcttcctggaggaggtcatgccacactgggctttgaaagaagactcagatgctcacagtagaggagacacgggggccagtgagccagaagggagcatagatcattccaggtgaaacaagtcgccaggcaagtgccctcttgccaggctgggaggcatggccttcaatctgcagggaggggcaccaaggaaggatttaagccaggcagtggcactgcaagaatgcagggtgagccaggtgcggtggctcacacctgtaatcccaacactttgggaggctgaggcaagtggatcacttgaggttgggagtttgagaccagcctggccaacatggtgaaaccccgtctctactaaaaatacaaaaattagccgggcatggtggcgggcacctgtagtcccagctacttgggaggctgaggcaggaggatcgcttgaacctgggaggtagaggttgcagtgagctgatgagatcgtgccactgcactccagcctgtgtgacagagcaagactccatctcaaaaaaaaaaaaaaatccttcctttttaaggctgtataatattttattgtgcatatagaccacattttgtttatccattcacctattcatttacattgcctccaccttttggctgtggcgaataattctgctgtgaacatgggtgtataaatatctctccaagtctctgccttcaattcttttgggtatctacccagaagtggaattactagatcctatggtaattctatgtttaacgtttttagaggaagcgtcatactgccatatacttttttgtactgctcaagttttggttgtgtttgttttttgagacggagtcccgctctcttgcccaggctggagtgcagtggcacaatcctggctcactgcaacctccacctcctgggttcaagcgattcttctgcctcagcctcccggatagctgagattacaggcgtctgccatcacacccagctaatttttgtatttttagtagagacaggatttctccatattggccaggctggtctcgaactcctgacctcaggtgatctgcccacctcagcctcctaaagtgctgggattacaggcgtgagccaccgcgctggccactgcttgaattttgaatagtgtgaaagaaacacttattcaagcatttgaataaattgaaaactgagattccatttcacgttgcctttagattggcaaatattaaaaccacagcgtgtgattccatgaatacgaacattcggtataggcaaatccatagagacaaaaaagagactgccggttaccaggcagtaggggaggagggaatggggagtgactgctggcaggtttggggtttcttattggggtgattttaaatgttctggaattaggtagtggggatggttgcataacattgtgaatacaaatgaccgaactgtacactttgaaatgctgatgtttatgttatgggtattatatctcaataatagtttttaaaaggctaataccaatgacaaaaaaaagtatgaagaaatctgaccaggcatcgtggctcatgcctgtaatcccagcacattgggaggccgaagtgggaagattgcttgagcccaggagtttgagaccagcctgggcaacgcagtgagaccccgactctgcaaaaataaaaaagtagctgggcatggtggtgtgagcctatagtcccagctacctgggaggcagagatgggaggatcgcttgagtcgggaggctgaggctgcagtgagctctggtcatgccactttattctagcctgggtgatagagcaagaccctgtctctaaaatatatagacaggggccaggcgcagcagctcacgcctataatcccaacactttgggaggcagagatgggtggatcacctgagatcaggagttcgagaccagcctgaacaaaatggtaaaaccctgtctttactaaatacaaaaaaactagccaggcatggtggcacatgcctgtaatcccagctacttgggaggctgaggcaggagaatcgcttgaacccgggaggcagaggttgcagtgagccgagattgattgcgtcgttgcactccagcctgggcaacaagagcgaaactccatatcaaaaaaataataaaaataaaaataaaaaataaaataaaatatatagacagggtcttgctctgtcatatattaaggttgatgcaaatgtaatcatggtgtttgccattacttttaagggcaaaaaccacgattacatttgcaccaacgtgatacatatgaagaaacctgacccaagatccctgacttctgcctgtggtggggccacagtgggggaaggggcagctttacagagtcaggcaggtcaaggagaaggctgtgggcacagaaggggctccaggtagacggagcagcacctgtgccagcacggaggcctctcccccacccctttccttgcccctccccccccaggagaaccgcctggcccagcacaccctccaggccctgcagagtgagctggacagcctgcgcgccgacaacatcaagctctttgagaagatcaagttcctgcagagctaccctggccgggtgagggccctcccctggcctcagctccaggtggaccaggcagggagagaggccgatcagggctctggagatgggagggtcggggaccaagacctgctgggcagcactgggccccagagacccctgaggccttccgacatctccccacccacccacctgcctgctagctgccctccctaagccggcagaagctcacagagtggagcccctgtccagattcattcataaaaactggccagaaggaccaggcacggtggctcatgcctgtcatcccaccactgtgggaggccgaggcaggagaattgcctgagctcagaagttcgagaccagcctggccaatatggtgaaaccccgtctctactaaaaatacaaaaaaagtatccgggcatggtggtgcacacctgtagtcccagctactcaggaggctgaggcaggagaatcgctggaacccaggaggcggaggtttcagtgagccaagatcacaccactgcactccagcctgggcaacaagagcgaaactccgtctcaaaaataaaataaaataaaaataaataaaataaaattaaaataaaataaaataaaataaaataaaataaaataaaaaaataaaatataaaataaaataaaatataaaataaaataaataaaataaaataataaaatagtaaagtaaaataaaataataataaataaaataaaataaaatagaaaagaaaatactagccagaagggccaggcacagtggctcatgcctgtaatcccagcaccgtgagaggccgaggcgggtggagtttgagaccagcctggccgacatagtgaaaccctatctctactgaaaatacaaaaattagccaggcatcgtggcacgtgcctgtagtcccagctactcaggaggctgaggtgggaggatcacttgagcccaggaggtacaggctgcagtgagctgagatccagccactacactccagcccaggtgacagagcaagaccctgcctccaaaaaataaaaataaataggctgggcatggtggctcaggcctgtaatcccagcggtttgggaggctgaggcgggcggatcatttgaggtcaggagttccagaccagcctggccaacatagtgaaaccccgtctctactaaaaatataaaaattggctgggcgtggtatcatgcacctgtaatcccagctactcaggcggctaaggcaggagaatcgcttgaacctgagaggtggaggttgcagtgagccgaggtcacaccattgcgctccagcctgggcgacagagcgaaactctgtctcaaataaataaataagcaataataaaaaatgtaaacagaatttggtccacactccaaaaagcaaccaagagagtggatcagaaactcacttgccgagtttttctgggctagggaggcctgtgcgtggcttctctcagcccccaggcctcccaggggccaccccgtgccaggaaaccctttctatgagtgagagaagagcgtggggcatagtggggcagggattcacctctccctcttcctttggggcccagcagcccccagccctgtccccacccatcagagccgctccttggccaccagagggcactcagactctgcaaaccagcctggctctgggtggccagctggggggcgtctcctctcccagctgcctgcctgctcgcatgaccaccccacactcccagcaaacccaccttcctgcagctgcgcccggccctgcctgggcctcagttccccatctgtgcccggaggcactgtggccctgaccccatgggtaactccatgcccctgtggcaggaggcaccagccacattcacattgtcaccccagcaccctctcctcccgcctctgagatctagggctccctcccccacttcccttttttgcagatgaggaaactgaggctcccctgggctcctgcccttcccgctgggccccaaggcactgactggttctcttcccctcctgtctgtgcagggcagcggcagtgatgacacggagctgcggtactcgtcccagtacgaggagcgcctggaccccttctcctccttcagcaagcgggttcgtgagcccagcctgggcaggggaggggaggggcatcagcccagggaagcccaggggtccccccatcacttggcccccatccctgagcactcggccttccctggctcccctccacctgccctcgtctgggtgctctcggccagccttgccacgccagccctgcacaccctggcccctcaggccaggagcccccccaagacagcctccccaccgcttcagtgcaatgtaggcccagggcccattcaggaacacctgccgaggactacccgagggtgtgtggcagtgaccgggttaacctggagtgcatttgcgggacaggcagacaaggaaaaaccagttacagctcccagaatcgggcgatccattgtggggaccccaccccacaactcccctcccccacccagactgcagaagttctgcccgtggagtactttcccatgggcagaatggacggctgcagaggcggggaggggctctcacagatgtcaggggagtccagaatgtcacactgagtagactgtgcacccagggaagcccctggcagcaccctggcagccccctgggggtctgcaagaacagcgggcagggtgtcctgtggctggccaggccctgctctctgccacaagccagggcctgtgaggtcctttggggtcctttcctgactgtccctccctgtgcaggagcggcagaggaagtacctgagcttgagtccctgggacaaggccaccctcagcatggtgagtccctgcccctacccaccccctccctggacaggcctgagcctctgtctccaggcacctcttcacctgccctgcagcccaggctggaggagccgccagccctgccaagagtggctgtgtgatctgggacagggtctctccccttcccgggcagatcctctgagagcatggttcacagcatggttctgaactgggctgtagagggggcattcctcagaattcctgcagcctagagtcagacatggtggctcacacctgtcatcccagcactttgggaggtgggaggattgcttgagcccaggagttcgagaccagcctgggcaacacagtaagatcctgtctctacaaaaaataaaattagccaggcgcagtggtgtgcacctgtagtcccagctactcaggaggctgacggaggaggatcacttgagcctaggaagtcaatgctacagtgagctgtgaccactacattccagcctgggcaaccttgtctaaaaaaacgtttttaaagaattccggtggccgggcacagcagctcacgcctgtaatctcagcactttgggaggccaagttgggcggatcacctgaggtctggagttcgagaccagcctggccaacatagtgaaaccctatctctagtaaaaatacaaaaattagctgggcgtggtgacgcacacctgtaatcccagctactcaggaggctgaggcaggagaatcacttgaacccaggaggtggaggttgcagtgagccaagatcacaccactgcactccagcctgggcgacagagggagactctgtctcaaaaaaaaaagaattccagcagcccatgtccctggcccataatgatggaataggggccccagcttcctgtcccttccctccccttgccaccctagggccctttctgtgaagcccaggcagccctgcaggggtgggtgaggccggccccatccccactcaccccctccttgctcccaggggcgtctggttctctccaacaagatggcgcgcaccatcggcttcttctacacactgttcctgcactgcctggtcttcctggtgagtgtgcacacgggcgggccagaggcacattcaccatccccagccctgacctccagggcagcaggggcctgttacggtggcctggcccctgggcctaccccaagctgcatctctagcttgcgaccatgcctctccccttcgagagccttggcccaccccagggacgagaaggacccaccccattgggacctctggccagggcaccagccgggccgctccgtgaaagaggcctggctgatcacatctgggactggtcctggacgggcttcataggaagaagggatggagtgggaagggagcaggtctaatgaactccaccaagggacagtcacgaagactgcacagagaaggggcgtcttgaactaacctccccagctgtggaggtggcgttctagttagcggataagggcctccatgtctgccaagttgggggagaagaggggtggaaggctgtgtctctggaaggatccagccttggggtctcctgtccccagcacagtcaagatggcccctacagagctaacctgggctcaagttctgaccccagggtccagcggctcctggcccttccaagggttggcccacagtattagaggaggtgcctccgtgtctgggcccatctgatcatctgcagaagcagtgggtgcaggaacatgtctaagacccacccgccccggagtctggggctcgagaacctttatgttccaggccaggcccaggggccatgggtgggctgcaggggtggccttgaggcgaacgggcagctcaccgtgtctccacctggccaggtgctctacaagctggcatggagcgagagcatggagagggactgtgccaccttctgcgccaagaagtgaggacccccacttgggccccccctcagccccacagcgagctcccagcacccccgcaacacccccgagttcctgcctcatgtcccccactccttagccctccatcacagccccccattctggccctccccctacccctactcccggtatccactacctcctagccccaccccatcacatggtacacaccccccttccccaacacacacactcggcctcagcaaagcttcccgtgtcccccaggttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggttgcagcca

SEQ ID NO: 773 - DNA, 468068 bp, Homo sapiens; identical to SEQ ID NO: 772

SEQ ID NO: 774 - DNA, 468068 bp, Homo sapiens; identical to SEQ ID NO: 772

SEQ ID NO: 775 - DNA, 467964 bp, Homo sapiens
cactccgtctcaatatgtctcaagatggcggccaatgtgggatcgatgtttcaatattggaagcgctttgatttacagcagctgcaggtcaggctcctccgcgctcggcctcgcgcccgggggtgggggctgcgggcggtcgcggcctccgccgggggccccgggctggcccagccgccggggggcccgcggcggcggggaggaggggggtgccgggcaccgcggggccgagtcggggccgagtccctcccgctccccggcccccattgatcactcgcttgatcggaaattgatcctctttgttcaattcatcgatcagcccaagatggcgccgggagccgccgccgccaccactgcccccggtgtctgcccccaccccgggcgcccccccgggccccgcgccgccgccgccgccagcgccgccgccgccgttgccgccgcgggaccggggagggggcggccccggcggcccgcggggtgcgcgcgcgagcggggagcggggagcgggcggcggggggcgggcggcggcgggcgccgggagggggccgcggcccggcggtggcgcccgcccgcccgctcgccccgcgcccccggcccgccgtattcccggggaaagtttgtggggagttgctgcggggggtgaagcgcctgcctctccaggaggagccgccgccactgccgccggcgcggcggagctggggctggtggcgctgtggtgccgccggctcgggggagggtcagagcggccaccggcggcggcggcggcggcgcggcccggctccggccaggcgggcgggtggccgggcaggcgcccgcgctcgctacccccggccggccccggccgccgcccccggctgtcaccggcccgggccgcgccgccgctccggcaccccgcgtgtggctcccggcgcggacccccgggtttgtttacgtcccggggagcgccccggggccacccgcgcacctcgcggccgccgcgctcttttgtgtgcctgtgtcggtgacgcggacctgttcctccgtggcggacccccgcgggggctctttggggaaacttggcgaggggcggcgggggtgccccgcgcgcagtgtcgctgggtcccggtgtcccggaccgccgggtgcgggcgcgggaggaggaggctgcaactttcccctaggcaggccccaagctgttcccccgggtgcccgggcagtgtacgctgcctccccgccgccggtccgagccgcgatcgccgcgcgcctgggggctccggcggcccccggtgacctgcggcgccgggtcccttccttgcgtcccctcggggcttctgccctctctgcagggcccgccatggagcgcgcggcgggtgcgctcggagatgccttctcgggccgggttctcgaaagcagagccccgggggcccgttgggaccgtggcatgccgggcggtggtccgcgcgcggagtccccggcgccgcggggggaccgtgccggggctccccggcccgcgcccgagtcgccgccgtgcccaaggggcgagtgcctgcctgccaccccccgcccggaggagcggcgcacccttagggtccgccccgcacgtgccagctcggcgcccgcggcgccgggacagccccgggactctgccaggtggatgttgtgcgtagccggagccaggttgaaggtgagcggcgtgtgggccagaagtcccgaggttgcaggcgcggagggaaccggggatgtcggggggtgcccgggtcccgcggcttagaatgctctagggcggcctggtgctctgggaggggataggagggttcctcagggcccctggggaactgcagctactcccaactgctaaggtgtgcgtgaagataaacttggctgaactttcctaacctggaggactggtgacagtgacctaccgcaatacctttgggagcaaagctcgagatgcaggcttgtatcaaacgaagcgggttggattaaaacatatttaaatggaatctgacaactttaattgtatatgcttgttttctgctcttgcctactaagaacgataaagccgagtcatagtcgttatgaaatttcctgaaatttctcgcttaactaggaagaagactatgcgaaatatgtatttccgataagattaaaacttaaaggagtttaagtatttattgactaaaatagattactccaaagtgtctattgtgtaaattagattcctggatgtaatgaacacagccgaatggcatttttgataaattggtctaccctgttttagtaaaaatagctcccttttaccataatttaattcctgtgcttactgtaaaacccgttgtggagttttaaggacaaacattattattatttttctctcttgtcttcctaaatgtgacatcctagcttaatatcaatgaagtgtcttttttaaagcatcctggcaaaattgcctggaaaatggatttggtttctagagttactagattttaagaactctaaaccttcctgtcccccatattagctacttcttcaggggatcagggctccagggttccatcgaaagtttccatgtcagtttacttgcactttatgtggatattaagaagaaatcaaaaccaaaccccaaaacaaagtcccttatttgaacttcattcctctttactcctttgcttttggtggttgctaacgatttggccttagatgatttcctatgggtttgcaaactttagtcgaatacggaatgtcaaagttcaagtctcaggccaatctggttctttctctgggcggtgaggaggcctttggagttggtgtctggttaattcccaccgatagtcagtgagtcaatagaacgagtttgggagagaattcattagttccagatttttctcatttttccagacctctttatactgagattgggttgccacctgggggtaaagaggctgatcggtctttgcagagagaaatccaggttggagacgtcagcgggtccaggtgaggttgggccgttccgcagttctgcaaccctggctcactgggttcttgtccctcggcttcctgggtcttgaagctgctgccttggcacaggagtgtgtgctcaggaagagaatttctgaagattgtgttttattccgtttcctttttagtcccaaaggcttgtggtatggaagtttcagtgctttggtattgctaagactagttggacaagttttttatcctatctcagacttgtaaaaaccaggttttcttttctttttaaataagaaaagcactgttgtataaatttgtcttttaaatacatatttgaaaggaggacactttctaagacaaagctcatggcactctgtatgttagtggagctttgaactctttgggacggggcccgccaatgactgccttccctttgggacattattcccacatggtgaccagccttcccctttaagcagcttctgcaaaagtaaacttgaaaagttgccttctttttcagaatcaaaaaacaatttcagttttgctgaaagtccattttctgatggctttttttccccctgttgtggaagtgtgtatgttactggctgtccagtactgtttgccataataagtatattattttaattaaaatgtcccatctagtaccctttataaaagagcagttcaagaaattacaccactgctgctcctgcttttgttttcttggttcttttaatatgggtgtctttgaggttggatgtgggaaggggtcattggcagttgatttaagttttttcctatgtgaaactctttttttccttaaaggtgcaagtggtgagttaatgcaacaactcctggtacagttgagtccacagagagccctttgactacatcctcggcttcgtgtatcttctgtcggtagttagccaacctaagaaagctgaaagggccaaatagtccaataccttcaggaatgattctctcctaaatccactgagctaaccttaaaaatgcagtctggtgaactgtgctgagcctgaaacctttaatggctatttaaaaagtctcctgtttttgtacaattaagacaaacccatcagggtttatatgggagctgtgaaggaacagtagtttgtgctctctgattcccttctgggtctacctgtagcagtaaacaatcaaaaccactcctgaggctgtactcactttctgtgtcttaggagagaacacaagactagaagtagaaaatccacatttgtttcagctcctctgtaatgccccaggaacgtctgtttttagtgaaatgaaggaaggacacgtttgttaggggaaaactcatacatttcgtaagcagagaaattcatcatatgaagaatcctacagaggtaggttaaattcctacccgtgcttccatttcaaatagtttacacatttgtcacatgtaaatttcacagacaggtatatctgacgaattgtaacacaaatggtatgtaaaaggcaactctaaccattattcaaatatacaggatccaggatcgtgagttattgtagaaattacttaagacctatttaaaattattgaatacataactttaaaaaatgtaattgctctatgaaaagtgacttttattataattgtcaaagacagaaatttgtctgtcttgtccttttgttttgtctgaagccccgcgttatcgctgcagagagagagttttggtttccaccgaaatttccctgcctccgattgtttaaaccagacccttaatcttattttaacatatttaaaatgttcacaaaacccggaagaattgttttgtgtaagtagcaagcgagtgtagcttaaacactcaagcaattctggtatctaattggaaacaggtggaattcttggaatcccatgtttgagtctttttatagcaaagcccagggacacttttcacttatagccattcgttttgtcgaagctatttgaagaggggccccacagcctctccttatgtcccactgttgcttacctggacaaagcagtcgtgctgggcgctttaggaactggatacctgtgaatgcctggatgccgagagaagtgtgtgtgtgtgccgataatggagtgaaaaaggaatctaatggtatagttagacaagcaatttaatatctgcattgttatatgactttagagcaaagaatttgtgaattcatttgtgatttctgacttgatgaaccttgactgaccagagcatgtaggtacattttattataccccaataatgatatagaattcagagagaagatactcccccccgcccccaaaaaaattctacatttagagaatataagctccaccagcaaccataaaagtattaacttggtgagggggatattttctttctttttttttttttttgagacagagtctcgctctttcgcccaggccggagtgcagaggcactatctcagctcactgcaaactccgcctcccgggttcacaccattctcctgcctcagcctcccgagtagctgggactacaggcgctggccaccaggcctggctaattttttgtatttttagtagagacggggtttcaccgtgttagcccggatggtctcgatctcctcacttagtgatccgcccgccttggcctcccgaagtgctgggattacaggcgtgagccaccgtgcccggcccctattttcttttcttttctttttttcttttttcttttttttttttttttttttttttttgagacgtggttctgtcgcccaggctggagtgcagtggtgcgatctcggctcactgcaagctccgcctccagggttcaggccattctccttccttagtctcccgagtagctgggacgataggcgcccgccaccatgcctggctagtttttttgtttttttgtttttttttttttttgagatgtagtctggttctgtggcccaggctggagtgcagtggcgcgatctcggctcactgcaagctgagcctcccgggttcacgccattctcctgcctcagcctccggagtagctgggactacaggcgcccgccaccacgcccggctaattttttctatttttagttgagacgaggtttcactgtgttagccaggatggtctcgatctcctgacctcgtgatctgcccgcctcggcctcccaaagtgctgggattacaggcgtgagccaccgtgcccggccgatgttttcttaaatattaatggcagggccctctggattgactgtgttatttgacccattccagttttcaaggcgtggtcttgaaaagctgtcgatcaccctggttttgggatgtgtttcagaaccaagtttcgatggtgtgtcagtgttggattttcctgctgaggacagctaaggtttggtatggagcagttttggatttgctgagctgtaatcagtccagcttctctgctgtcttctgagaaggttgatggaggagagtggtctttggcggggatggaggtttccctgcaggaaatgaaccaggactgaggggaacctgtgccgttcccctcatttgtcctgcgcctgaaacagctttgaagcacctggcttgtgacttaaaagatttttaaaaagcatttgtgctgccctattcgggtattacacagtgagggtgaaccattcttttcgaaagacgtctaaggccgggcacggtggctcatgcctgtaatcccagcactttgggaggccaaggcaggcagatcacttgaggtcagaagttcgagaccagcctggccaacatggcaaaacctcatctctactaaaaatacaaaaattagcctggcgtggtggcgcatatccataatcccagatactcggcaggctgaggcatgagaattgcttgagcccaggaggtggaggttgcagtgagctgagatcgtgtgactgctctgcatgcagcctgggtgacagagcgagactctgtctcagaaaaaaaaaaaaaaaagacatctaatttgttgtaaaacctgtcaagaaccttccctttaaaaagctaatgcctctctaataaaaataattttaattttgttgtaattaaattcagagaggatgatgttagtgcacaaaataaagattgtcaatttctttattttaatccaacggcatttcctaactgcaggaggcccaggaccgttggcagaaattttgtgttgattagagcctcgggccatgggaagtgcaggtactgtggccacaaagttcgtcgcccaatccctggctgaccccacaagcaggactggtacagatcccaccctcaggggtcttcctacacagagaaacataatcacacaggtgactggaacggagccaaggatggtggtgttcctcctagggatttactaacactgccagcaactcaagaactagccagccgggagtttcctagtaagtgaaactgacttggttctgcttcctttcatgaaaacctttgtgaaaatgagcccaataaggggtccgaacctttataaagcacacgaccccccagagtggaccgggccctggccgactccatcagccgaagcttgagatcttggatggtctggatggtcttgaccgtgtgtgattgatgcagttaacaaagcaggaaattaacagagcttactctgagacaccagggaagtggcttgttctttcttggggttactttgagtggatgctggcacactgcttgttttcttatagatacctttctattgggctgtgtttattcaataaggaaatgcagttaacatttttttaacaagtaaaccatgggttatgaggtgttccgagtttggttaagggaaaaacaaattgacaaattagctctttcttaagtgagtattgcgaaacagtgagaaatagaatgcctgtcgtaccgtcattaaaaatttatctgggtgttgacagctttttgttaaatgtaagacattcagatcctgtccacccagcatatgaaaaaaccaaaccaaaccaaaccgaaaaacaaaatgcaacacaaaagcttctttccatttccccccaaaagcaagacaatttttcttaaactggggctttctccctaatgaattgccatgattttgttttctctaacatagtttaatatctttaagacagaacgaatatcaactctttttattttattttttgagacggagtctcactctgtcgcccagcctggagtgcagtggcacaaactccgctcaccgcaacctccacctcccaggttcaagtgattctcgtgcctcagcccccccgagtagctgtgattacaggtgtgcaccaccacgcccagctaatttttgtgtttttagtagagacagggtttcaccatgttggccaggctggtttcaaactcctgacctcaagcaatccacccccttcggcctcccaaagtggtgggattacaggtgtgagccgccgtgcctggcctccactctttttagacacctttgttgagttgttgttttgggcctgtaagtttctctggcttattaccactttcccctcctgtttctagggaagaaatgattatttagataaaaaataatttgataaaaggtagcagatgataccaaaggtaaatctttgtcttgaagagcctgaagctgtgagcattggtaaagccgtgggctgcagtgagggaagggccggcttggagccgccctcagcctagcctccgggtgttacctggagcccttgctgtcaggacggcctgtcacttctcgcccttctcctgccctgccaagcctgtcccttcctgtgttgtgacaacttttttttttaaacaagtatttctacagctccattattttgagattcttggaagaaagatactatgtaaatgaaaattaaaaataaaattctcgctggagggaatcgtatacatgtaacgtttttgatgaggtttggaaaagactttcgttctccctctggaactgggaacattctgtggctcccgtcaccatttctgtgtcactctgaaaggtgtggcagataatggtgaaacatattattttctgtttttcaccaagtagttgacccagaacttgaacccatgcagtcctgggtccagtgaattatttctgctgcatacagttctgctgtgtcctcgccgagagcgtagtcagcaaccgcccggagaataccaacctttcaaaagaaaaagggctggagtccccaacatacagagattacagctaaaattacgaccagagctgttaatcaaatcccatcttcccttcctattcacacagtagagatgttataagtcatacaggtttgagacagaaaattgagagcagaggagcatgtgtttaaaccagcatagaaacattcatttaccagaattgctttatttcagccgtatctcaactcgttgcttacacagtaacgcatgctgtctcgtcactcagccaagtgggagacaagttcaggtttctgctccatgggatccaggagcctgcagtcaccgatgagcctggaggaccacaaggtggccagggcccttggagagctgtgctgcggaatcgtaaagctaccatccggagctggccgtcccagagggaaggcttggtcatctcttcccctccacctggtcctcagccctggtcccgcagtttgtcatcccgcagtttgtcagcatcgatgtgggactgggagaggaaggatattgccagttatggttgaatgtcattgtcaggggagtaagaagtagtttgtgattgttttacgtggctctgtgttggtatataattatgctgtcatcttaaaacgccctgataccttaatgaaatctgtgtgtgtgtgtgtgtgtgtgtgtgtgtgtgtgtgtgtgtgtgtgcgcgcgcgcgcgcagttagtcttcggggctgcttattgtgtgtgagagccaagtctttctaacacacgagctgagtgcgtcgtcttttacttgtttcaaaactgcccattcgaaacaggtcgcaatccattataaatgcagctgccagattaatcttcccgaaccattgatttcatcatgccattcctctccttaaacatccatggtggcccacttaggcacagagtggagaccacatttcttagggtagcagacagagttcctgatagtcctttctgccccacctaaaccttttccatcccagctagaatgactccagaatcttgcttatttgggggagctccctcctcctccctctgtacatctgagcttcaagcctacttcagaatttttttgtttttttttgtttttgattttttgaggcagggtcttgctctgttgccggctggagtgcagtggtgagatcatagttcactgaagccttgacctcccgggctcaagcaatccttccacctcagcctcccgggtagctgggactataggcatgcaccaccacgcctggctgatttttccatttttttttttagagacagggttttgccctgttccccaggctggtcttgagctcctgggctccagtaatcctccctccttggtctcctaaagtactgggattatagaggtgaaccactgcgcccggccttcaagcctatttcatgcattcctttttcttttgcccctgtgtgcccggcagtagtgatggagacttaaaatagcagtggcttcccgcctagagggcggacaggactggcaggacgaggctgggatggatggagcagtgtgtctgagcctctgggaaggctgcaggaagggcttggaaggcgggtcggggagtgggcagggggcgcccactgagttctgtgtgcttggggaggtgtgggagacagggctttccagcagaacagtcgtggggtggccggggatctctagggctcccctctgagcttgggttccctccctctgccctgattatcccttgggtacccaccacaccatcgccacacaggcccccactctctgccttgtgtgtccgatttaggactcattcagctggttaagaatgcaaaattaattcttttttttaatatagtgaaagcaggtagattatattaaaatggctgtgttttgaaagctactgataggtacacctatggaatagatgtttctttttcagtcccattaattatctttctgtgcaaagtaacataagtgttactttttcagtcccattaattatctttctttgcaaagtaacataagtgttggttaaaatacagttgacccttgaacaacatggggattaggggctgatcccttctgctgttccccctaccccacctgcacagtcaaaaatccacgtataactttttttctcccctcccctccttctcttctcttctcttctcttctcttctcttctcttctcttctcttcttttcttttcttttcctttcccttccttttcagacggggtctcattctgtcacccaggttagagtgcagtgacataatcatagctgactgcagcctggacatccggggctcaagcagtcctcccacatcagcctcccagtagctggaactacagacactcaccagcatgcctggctaatttttaatttttttctttttttagagacagggtcttgctttgttgcccaggctggtcttgagctcctgggttcaagtaatcttcctgtcccagcctcctaaagagctgagattataggcatgagccaccaggcccacataaaacttttcattccccaaaaacttaattactaatagcctaccgctgatgggaagccttaccgataacataaacagttgcttaacatgtattttgtatgttaatatgtgtgatatactgtattcttagaatgaagtaagctaaagaaaatgttattaagaaagttgtaaggaagagagaatatatttactaatcagaatatagaatggatcatcataaaggtcctcattctctttgccttcatgttgaggagtctgaggaggaagaggaggcgttggtcttgttgtttcaaggtggtggagatggaagggctggagcaggtggagggggagtcgggagaagcaggcccaattggtataacttgttttttttttttttttttttgagatgggagttttaccctgtcacccaggctggagtgcggtggcggatctcgactcactgcaaccttcgcctcccaggttcaagtgattctcctgcctcagcctcctgagtagctgggactacaggcacccactactacacccagctaatttttatagtagagatgggtttcaccgtgttggccaggttggtctcagaattcctgacctcagatgatctgtccgcttcggcctcccaaagtgctgggatgacgggtgggagccaccatacccagccccactcaatgtcacttttattatggaaaaaaaaaaatctgcgtgtaagtggccccacacagttcaaacctgtgttgttcaagagtcagctatatgtataattgtacctgtggcacatagaacacaaaaagatccacatttttaaaaacagcattgggcagaacaattttttgacagaggtctgtttgactctgctgacagcctgagtgggaggaaacttccccatatgaacgaacggggaaagtgcatgttgtagttctcaaaacccaaaaaaatctaagagaaacccagcagcaagaaacacagaggtttgggtgtcagcatcggaggaatgtctcacgtctgccttgtcccccagaccccgtccctgtgtctgggcaaaggcacgccccgctccaggtcggccccatttcagagcagtggccctcataggctttgtgcctcttcatttagtctaagaaactacctaggatatttttgtagaggtgacatcactgtctggctgcagaagcatttgcttggatttggggaagtgagggctgggagaggagggcttagagaggcaggatgcccaggcccattgcgggtggctgatggggggtgggcttagcatctgcagggacagggtggagggagaggagccaccccaggcagggggaaggggtgtgccccctttgggatatggaggttttggggggctggtgggagggaattccaggggtcgagcccctggggaaaaggaggctttaaggtcagtggaaaagtgggtgccaaagtctggaagatgagttgaaacctggagtttgaagcccggggaggattttgttggagtgttggctggtgctggagagttttgcatcacttggggtggggtggggtgaagaattaacttgaactggcacagcacccctttgtcttgactttccctgttctggagtgaggacggcttgatgtttcagcaaaaggagtagtggagagggagaatatttgcttgtaggattgggttccacataccatatctacagttttacatccactggtgacaagacaggagcttttctatttttgttttgtatttttatgtttttgtgcactaacagtaatggtttcatgggaacagatggcggacggacacgggcttaggctcttggtttatttcatgttacttgcatgacagccctatggagctgcgtacctgccataggtgagaagccgggagttggggttacatcccggactttgctgagctccaggagtgtttttcctcccgacctgcgctgttccctagacaaccctcagccgaagcagtggggtcatcgggtgactcagaagggacctcttctcaggggccgcccaagatgagcttggctgggtctgggtcacttagcagtgagcagcaggggatggaaatggggccggggtgggtgggcttgaggggagcactttctcagggacgcctggctggagccttgccctggcaagacttcaaactcagccccgcagagaagggtcatctgatgatagaatcacggctgccccatcattcccattagcaaacttcatctgatagttggggtacggttgtggctcaggctgtaaggagcccccctgttgcattactcactatcctcagatgccccatccttgcctgaagcaagtttgttgggacagttttggggaactgttaggagagaggcctggtcatggggccggaggggcccagaggagcggcctgccctatctgtgggcggttcggtgagtgctagatggggtgtctctttacaagactttcctctgagatgctggggctatgcccctgggtgctggggagtgaattgcccgtagatactgatacctgtacttaaccctgtgacggtcaagaccagatccccactctccaagcccctgggaaactggttgatgtagcccctgcagtgataccgcactcaaatccatgcagatcccctgacatggtcggggcagcacccaccacgcaggcttctgttctgagctacatgggatgttgggcgtgtgttttctaagagactgatttcataagacatgtaccagtggccgactggcctgaaacagcctggtcacagcgacatccctgagatcttagcttcttttcctcggggaattatcattggactggaaaactgaggttttgggccactctggattcagatgcttttgttgttgttgttttgagacagggtcttgatctgttgtggactgcagtggtgggatcatagctctctgcaaccgcgaactcccaggctcaagtgatcctcctgcctcagcctcctttgtagctgggaccacaggtgtgccccaccatgcctggctaattttttttacatatttttatacaaacagggtcttagtatgttggccaggctggtctcaaactcctaggctcaagtgatcctcctgcctcagcctcccaaagtgccgggattatataagcgtgagccaccacgcctggcccagataactcttgcctgcctgatttttttataatgatgcactttgttttgttaaaaatttataaatttaaagacaaaatatgcaaaaatgtgccctggtctcagaaataacacagcacattcgagtgaagttgttggcagttccgtgtgttttggggtgattcatttttttcataggttgttggggccgtgcatccattcgtgttctgagcacactccatggtacctgatgactcgaatggatcctgttcaagcccctgggttacccaaagaaatatacttctggcctgctggttggtcagagaatgcaggacacattggggtatcgcgaggtgtccaatggcagcgggttgggtgtgtctgctgtgtgaacagggcaggggtttgggaagatggactctggctgtcttgctccaaagacttccttaggctgttgttgagcatttattgagtgtctcctgtgtgccgggcagcattctagcatagggattgagtgaccagacagtagggaatccttgcccttaaggaactgacattcttttttttttttcgagatggagtcttgctttgtcgtccaggctaaagtgcagtggtgcaatctcggctcactgcaacctctgcttcctgggttcaagtgattctcctgtctcagcctcctgaatggttgggattacaggtgtgcaccaccacgccgggctaattttctgtatttttagtagaggcggggttttgccatgttggcctggctggtctcgaactcctgacctcaggtgatccacccacgtcagcctcccaaagtgctgggattacagccgtgagccaccatgcctggccggaactgacattcttgcaagggggatggaagacaaaggcaaggaataagtgagtgcccagtggcctgggaacagacggagcaggactgatacacaaagccccacagagtcacttctgtcttctgaaggccctgagaaataactttattattattattattattatttagagacagagtctcgctctgtcgcccaggctccagtacagtggtgtgattatagctcactgcagctttgacctcccgggctcaagctatcctcccacctcaggttcccgagtagctggaattacaggcatgcgccaccatgccaggctaacttttttgtattttttgtagagatgggggggtctcactgtgttgcccaggctggtcttgaactcctggcctcaggcgatcctcctgccttagcctccgaaagtgctgggattccaggcctgagctgccatgcctagccccgatttttaaactgaagagggatggttcagttgttggggtgtgtcttagaggatccttctggaagccccacatggaaggcgggctagagtgaggagggaggggtgataatggaaccaggagggtgtggtggtcatggcccagtgagaggatgccaggctgtggccgtgccagactcagtgtgcctggccctggcatttcaggcagggaccactgaggggtgatgggagagatggggctgggtgagtggcatttccacaggcatccagaggggtgcgaaaaactgaggttggggaacagcaggggcagggaacagcctgtggagggtgtggtcatcagtgtcccccaccgacatggcacatccagcgagcccactgtgtccccagcacctgcggtgcagggggctggcaccttcaggggcgggcttcgtgcagacgtccacccagtcagtccccacaggtttatcaaacacaagtggggcgacaggacccacacttcggcgttggacgtgactcacgcggggagttggcttggagttcctttattcatccctatttgctttctgtctgtaatcctttgtaattccctggtttcatgatgtaattctaatggaaataaacccgaacctttcaaaattatgtaattaattgcattcagcttcaatgacaatgactaattatagtgatacctggtggcaaggcaggtacctactgctggggggctcctgtctgcttggtactaggactgccacttctgggcgcgtcggagcggctgcacagggggtcagctggctgtcctgtggcctgctccggtgcctctggtccccatcttaccaggagcagcgccatggccatgcagggaggggccggagagggaggtggtgtgcagggaggagctgcttaggggtgggagggcttggacttgtctgcaggttaaagagaagtcttgctgggaaagtaacttcggggctggttccctgagagcattcttatctgattcatgtattttcctgagaaaaagggaggagggtgcgttcgactgaacgtgaagcgttcaaggatcggaaaggcaagccaggtacagtggcttacacctgtaataccaacactttgggaggctgaggcaggaggatcacttgagagcccaggagttcaagaccagcctgggcagcacagtgagaccccatctctacagaaaaaaaaaaagaaaagaaaagaaattagcccagcatggtggctcacacctgtgataccaatactttaggaggtcaaggcggaaggattgcttgagcccagttgttcaagaccagcatgggcaacagtgagaccctgtctctacagaaaaaaaaaaaagaaagaaattagctgagcgtgatggtgcacacctgtgatcctggctgctcaggaggctgaggcaggaggatcgcttgagcccaggagttggaagctgcagtgacgtatgacagtgccattccactccagcctgggtgacagagcaagaggaagactctgtctcttaaaaaaaaaaaaaaaaaaaaaaaagaatccaaaagcaagcttatggagaagggagaaagtgcgacagtcacctcggggcgtgggagagcagaagatggatgtcaggttaaaaaccattactgtgctgtagtatttccaggaggccaagtccagggctctgggacctgtacactgcggcatcagaccctaaaacagagctctcaggttttcgccttcccaggaagtctgcatcctttttgcagactggttttattctgtgttaggaggaggcgattttgctaagaaatcttcactgcaattttcccccccaaatcagggcacttggcatctccttctaacggggggtgcagagtctgtcctagaatgggacgcacagtgttcacacgagtaccgagtaggtggggtgctgggccggcccctctgatcctgtcctaccctgtgcagccacgtgcctttccttatccccagacttctgttgtcacgattcttccagggaagaatctggaagtggaatccacagggcggtgcccagggatggcctttagtgcctagtgttctgtttcagagagaggcctcttatttatttgaaaagctgattgtttcttttttttttttttttttttttttttgagatggagtctccctctgttgcccaggctggagtgcagtggcactatctcagcccactgcaacctccgcctcctgggttcaagcgattctcccgcctcagcctcccgagtagctgggactacagacacccgccaccacgcccagctaatttttgtatttttagtagagatggggtttcgccatgttgcccaggctggtctggaactcctgacctcaggtgatctacctgccttggcctcccaaatgctgggattacaggcatgagccaccacgcccagccttattttctatttttaaagaaagagcaagactgaaaacatttgcatgcacagtgagttttaaaaagttcctttttttagagaggaccaagaaggtgcagagtactcttgaaaagaaattttttttctgttctaaacgtgccgcttgttgccctggtgcagagagcagttcttttgatacaatacctccgtcccgtaacttttttttaaagctaaaattcatataatgtaacatttacctttccaaagtttaaaattctggccaggcctgtaatcccagcactttgggatgctgaagcgggcagaccacttgaagccagaagtttgagatcagcctggccaacatggcaaaaccctgtccctactaaaaatacaaaaattagccaggtgtggtgagcgcttgtaatcccagctactcaggaggctgaggcaggagaatctcttgaacccgggaggcagaggttgcggtgagccaagatctcgccactgcactccagcctgggtgacagagcgagactctgtgtcataaataaataaataaataaataaataaataaataaagtttaaaatccataggtgtttggtatactcacaatgtcgtgcagccatcaccacgatctagttccaaaacgtttccaacaccccgacaagaaactcccatacctgtcagcagttaccatttgtcctccctcctgtacccccggcaccccgtaaccattcatctattctctgcatctattctctgcctccatgcgtctcgggaatcatggattacgtgaccttcgtgctgtggcttctctcacgtagcacagtgtttgcggggctcacccacattgactcatgcacctgtctgggccgcattcttttttatggctgaataatattccctggtatgggcataccaggttttgtgtatcctttcatcagctagtaaacattcgagctgtttccacttttttggccattgtgaataacgctgctgtgaacattcgtgtacaaatgtttgtatgaatgcagttttccattttcttaggtgcaattgccaggtcatatgtagtcactctgggctttgctttttgagtctgttgtattttatttatttatttttttatttttgtgggtgcgtatatttatggggtacatgagatgttttgatacaggcatgcaattcataataatcacattgtggagaatggggtatccatccatcacagatttattctttgtgttgccaacagtccaattatacacttttagttattttatttgtttgtttattttgagttggagtttcactgttgttgcccaggctggagtgcaatggcgcgatcttggctcactgcaatctccatctcccgggttcaagcgattctcctgcctcagcctcctgagtagctgggactacagctgccatgcctggctaatttttgtatttttagtagagacgaggtttcaccatgttggccaagctggtctcgaattcctgacctcaggtgacccacccacctggcctcccaaagtgctgggattacaggcgcgagccaccgcgcccagttgcttttagttactttaaaatgtacgattaaattatgatcgactatagtcaccctgttgtgctgtcaaatactaggccttattcattgattctatttttttgtagccattagccgtcgctacctccctgcattgttgcattttggcctcttatgtgtaagtcccgtttgttctccagaatgctgcttttaacacccagcccgttccatctctctctcttctgccttgggtgtcatgctgtctcttcctcagatttctcctggggtgcaggtgctcccctgcgaaccactgctgtgcacaaagtgattttgtgctcaggcaggtggatcgcttgagcccaggagtttgaaaccaccctgggcaatacagtgagaccccatctctacaaaaaaaatggctgttgtgcagtttgggatgagagttggttgcccccgcggtcctcccttcccccaaccccacctgccctccttgctcagcaacaagggacccccttcactggactatgaagcctgagggttgtctaaatcaatccttggccaggcgcagtggctcatgcctgtaatcccaacactttgggaggccaaggcgggtgcatcacctgaggtcaggagttcgagaccagcctggccaaggctctgagagcagcgagactccttctcaaaaaaaaaaaaaaaaaaaaaagaatcctggctgttccttccccacggccagtgggcattacactttgttttggctggagaaaccgggagtgcccgttgtctgcctggagacatgcctgtgggagaagaggctgcccccacctgctaccatcatcccagcatgggtgcggtggggggcaggggagacagagtaaaaatcgcagaggacatggggcagaaagatggaaggaacctgggccctcgatggctctgagtgagtcagtcctgcagtgccccgtccccatttttctgtggcctgggaaagtcaaatttcctcatcctttgtagttggccattgtgttatttggagatggaagagcattctgaaacaagccactataatgaaaatccaggtcgtagcaacttgccgtgcacggctttggcttggcatggacttacagtgacatctttgagatgcacttgtccggggtgcaggtatatttgagagtgtgaggaggacatatgtcctctaagctctgttttctaaaggcagcagaattccatttgccaagccagatgtccctcaatacgttagatcccaccaataaaacattaagcaattacaatggttaatattcactaaagtataattagaagctggcgtaaattgtgaatgaaattggcgggttccatacgttacagtgaaataccaaatctttttttagttgtgtatgtgtatctcagtgagtctgtcaactcagatgagtgaatcttacctcctctgtggatagaaacgagctcaatttcaactcagttcactataattttaaatgtttaagaacatcttgccagttgttctatcatgttaaagttactgaaatctggctgggtggagtggctcatgcctgtaatcccaggactttgggaggctgaggcgggtggattgcttgagcccaggagttcaagaccagcctgggcaacatagtgagaccctctctacaaaaaaaatccaaaagtagctgggcatcatggtgacgcacacctgtgttcccagctactcaggaggctgaggtgggaggatcacttgaagccgggaggtcgaaggtgcagggagccatgatcgtgacactgcattccagcctgggtgacagaacgagaccctgtcaaaaaaaaaaaaaaaaaaaaaaaaaaaaaaggataccaaaattctcaagtcaaattataagggttttaacattcccatttctacaccacgtgcaagaaaaacaaaatccttgttttctgcctgcctttatggtccgttctcattttcagccccctttcctcattctactctattaattatgcctttatatggatgcaaacttgtaaaatatgtggcctattttgtgtgtatacgtggttttaattcataagtgtggcactgtgccctaaatctttttctccttccttttcactcgtcacatttttttttttttttaaatgacacagagtctcgctctgtcgcccaggctggagtgcagtggcacaatctcggctcactgcaacctacgcctcctggatttaagtgattctcttgccccagcctcctgagtagctgggactacaggcgcctgccaccatgcccggctaatttttatatgtttagtagagacgggctttcaccatgttggctaggctggtcttgaactcctgatctcaggtgatcaacccacctcagcctcccaaagtgctgggattacaggcgtgagccacctcacctgggctcactcaccacaatttttgagatcttgttgtctatgtcattccctgtgaattttgtttgttatgacagccgtattgaaatccatcttcagggccaggcgcggtagctcacgcctgttatcccagcaccttgggaggccgaggtgggtggatcacctgagatcaggagttcaagaccagcctgaccaacatggtgaaacccccgtctctactaaaatacaaaaaattagcagggcttggtggcgcatgcctgtagtcctagttacttggaaggctgagacaggagaatcgcttgaacctgggaggtagaggttgcagtgagccgagattgtgccattgcactccagctttggcaacaaaagtaaaacgctgtctcaaaaaaaaaaaatccaccttcagaattgacctgtgttaatctgtccagactgccgtaacagaataccatagatggggtggcttcacatatttacacaacacatatttatctctcatagttctggaggctggaaagtccatgatccgggtacgggccaacgtggttcctggtgcgggcccttttcctggcttgcagatggcctcgtttttgctgtgttgccacatagcagagagtgtgcgcaggcaggcaagccagctctctggtatctcttgttttaagtacactaatcccatcatgagggctttaccctagtgacctcatctcatccttacgaccttccaaaggccacacctccaagtaccatcatattggaggctggggcttcaatgtatgaatttgaggggggtggacaacacagttcagtccgtagcagcaccctagctcacacgtccatttccctggggctggtcaccctcggtggtatctgacccccctcccccaagcccctccatgcacagcactgctaggaacgttcttacacacgtcccttaccagtatccaggaaaagccttgctggatccagccagatagtggtccttctttcacgaagcacctccagatcgcttcccagcgtggctgccccacttactcccccacccacagtcgtgagagtttctttcccccacaatctcatccgtgctttgtggagatattttttgccagtgagatggttttaaagtggtacttcagtgttgtgtcattttctctgatcaccagggaagtcgatctttgcgataagcctcattttatacttgtcagcttttcagatttcgccttttgtaaattgtctggtcatatattttgtcctctttttttttttctaaatggtttaccatctttttgttgatttgcaagagctccttgtatgtttcacatgcgaataatttgtcaattttctttcttttttttgttttttgagacagagtttgctcttgttgcccaggctggagtacaatggcgcggtcttggctcacttcagcctctgccacctgggttcaagcgattctcctggctcagcctccccagtagctgggattacaggcatgcgccaccacacctggctaatttttgtatttttagtacagatggggtttcaccatgttggtcaggctgatctcaaactcctgacctcaggtgatccgtctgcctcggcctctcaaagtgctgggattagaggcgtaagccaccacgctggccgttatagttttttaaattaaaaaaatttaaaattctaatagattattgtggtatagaggaaacaattggtttttgttgatttcgaagctgggaagcttgctgttaatatttttactaattaacttgattctgttgcattttctctggaaataatatatgcaaaataatgcaagtttttatttgttcctttccttctgattcttacagtggagtgacttgctggctagaatctgaagtactcaattacatggtggtggtgatagaggctgcccttttctttctctttctaccaaaggagatttttggtagaaggtttaaccaggtgaaggaactaccttaactcccctttccatagtttttagagaattttttttggtataaataggcgttatcctcttgcaaatacttttccttaaaacctattcatgtccatgcagtttttatcctttagtttatgaatgtggtaaattacattgattgactatatgatgttgaatcatttattgctttctgggataaactcttcttcctcttgtattttaaaaatattgttggatttgatatacagttttcaaatctgtgttattaagtgaaattggcctataattttcttattcagttggaattgaggtttactagtctcatgaaatgggtaaacattgtgttggaacaatttatataacatgaggattatctgtatcttaaaatttgatagctcacctttgaaaccatcagggcctgagactttagaatggtggctgggaggcatttaacatttcactttttttgtttttggtctattgaggttttctattctttattttattttattattattattatttttttttgagacggagtcttgctctatcgcccaggctggagtgcagtggcgcgatctcagctcactgcaacctctgcctcccgggttcacaccattttcctgccttagcctctcgagtagctgggactacaggtgcccgccaccacgcctggctaattttttgtatttttaatagagacggggtttcaccgtgttaggcaggatggtctcgatctcctgactttgtgatccgcccgcctcggcctcccaaagtgctgggattacaggcgtgagccaccacgcccggcaggttttctattcttatgccaattttggcattttataattttctaaaaatgttttcattttatcttggttttaaaacttaactgttctgtgatcatagtattttttttttgtaaatctgttttgaactctagctgtctcccatttctacattctgtatttctgaatttatttacaactcttctctttatttttagttgtacatagaggtttgtttatcttactgatcttgaaaaaacagcttttggtcttgttaatcttgccttttttttatgtggcttatttctcaccattattttactttctgagtgcattttttttctaacttatttttttgaatactcagctttttatttcattttatttatttatttatttatttatttttgagacagcctcactctgtcacccaggctggaaggcagtggtgtgatcttggctcactgcagcctctgcctcccgggttcaagtgatcctcccacctcagtctcctgagtagctgggagtataggcgtccctgccaccacgcccagctgagttttgtatttttagtagagacagggtttcaccttgttggacaggctggtcttgaactcctgaccttgcatgagccacccacctcagcctcccaaagtgctgggattacaggcatgagccaccactcctggccttgaatactcagctttttaaattggggttctttcttgttttggataaatctattcaaaactgtaacatttctgctaagtattattttagctgtgttccacaaattttgacatgtagtgctttcatttttattcattttgtaattttctattcattttgtaatttcccttataattttctctttaacctaagggttatttaatactgtatattttttagatttttgacacttttctttaatggcttttaaaaatgttgttgctgtcatttttatcacatatggtcagagaacatagttcacataatcctggttctttggaatctatgaggtcttctttttggtgtcttgcacatggtggatttttgtgaattttccatatgtgctcaaaaagaatgtgttttttgagtagaaaaaaacgttatatatgcagtatacaagtgacatataccatatagtcatacagtttgtttggtatatggaatacattcatgtcactgtttctttgataattttcttcccatagttttttttcttctttctttctttgagacagagtctcgctgcatcacccaggctggcacgcagtggcgtgatctctgctcactgcaacctctgcctcccaggatcaagcaattcttgtgcctcagcctcccaagaagcgagaattacaggagcacatcaccatgcccagctaattttcctagttttagtagactgggtttcattatgttgctcaggctggtctttaactcccggactcaagtgatcctcttgcctcagcctcccaaagtgttgggattacaggtgtgagccaccatgctgggccttcctacagtttttgacagttgttacattatattaggttaaggctgtactgttacattgcatgtatgatcatgatcatgatctttagattttcctgatgtattggttttttttttttgatgtctgtatagactcttattatgtttttcatgttaaattctattcgttttgacattaaaattattctattttttttttttttttttgagacagagtctctctctgtcgcccaggctggagtgcagtggcgcgatctcggctcactccacctcccgggttcacaccattctcctgcctcagcctcctgagtagctgggactacaggcgcccaccaccacacccagctaattttttgtattttttagtacagacggagtttcaccgtgttagccaggatggtctcgatctcctgacctcatgatccgcccatctcagcctcccaaagtgctgggattacaggcgtgagccaccgtgcctggcctattctcctattttttttgtttgtttttggtttccatttgtttgatgttgctttttctctttaattatttccaatccatatcattttgctttcattgcatttgttgcagatctgtgatgtaagatcttgtttttaaaacccaggttgagaatctttgataagtgaatttagctgagacacatttctggtagttgtgttatattaggatttctgccatcttattttgtgttttctgcttaccattacttatttttaaaaaagcttttcttgtaatgctttgtagggttgaactttcttctgctggattttaaagttgtgcaatctattttattcttctagagctcagaattgtgattattcttaaaattattaagagccacttatgtgattagtttttcctatccatttcttttttttttcttttagaatataattgatttttaaattcacttacttgtttcaactgcctggagtagggattcctgtcagtttctaaaggctattaatatctttgtctttctgtcaaacaagttaagtgatagggacctcgtttcctcccttcagcctgttgagatcgtttagattctaggataatggtgccatataggactgtggccctcgggtgtgcagaatcagcgtcaccaggtattagactttcagtattaatgttctctccttgctagaatatgtgaacaaatgtgaaccttttgaaagagccaatccttcaggatggatccagaatggctaaccaggcctaaatctaaaatagagccagacggccatttgcagattggaagtcacacacttagtctgagttccctgaaaacctgcacctttcttaagtttgggactttcagagctcacctgacccaactagtctgagttcaccagccctggccaatcagggctcagctgtgtcaaccaatcagccctaagcacgtttgaatcattcataaagaaatctgactgggaacctgggtgggcactgttgctattaacaaacaccgtccccctccccgcccccgcccccgcccccaaccccagcagcttctgtttacacggaaggctgcatctccctggtttgcacgttgtccacgggaataaagtctctttcctccagattccttttcagagcacttttgttaagtattttaaatgatagtgcatttaaagaagtctttctgtgataaacttcctgagactttaaagtctgagtctatacttattccaccctcatatttaagtgatacattagctggatgtaaaattgtaggtcaaaattctttttcttcaacacccagattattcccctgttttctttttgcacagagagtcacggttgagaaatatgaggacagtgtgattcttactgctttggagggaagtctggtttttctttttatccctgtcttcattcttttttctttttatccttgtcatcgttcttcttttttctttttgtttttccgagacagtctctctctctgtcgcccaggctggagtgcagcagcacgatcttggctcactgcaacctccgcctcccgggttcaagtgattcttgtgcctcagccttttgagtagctgggattacaggcgcctgcccccatgcccggctaatttttgtatttttagtagagacagggtttcaccacgttggccaggctggtctcgaactcctgacctcaagttatccacccactttggcctcccaaagtgctgggattacaggcgtgagccactgcgcctggcctgtctttattctttaatgtcaccaaaatgtatctaaataatgatttcttccacctacctatcttatttggcactttactgaccctttgattctgatgtcttatttttttcttttattctagggagttctcatacatttatctctccaaatattttctctcctctctttattttttcttctttctaggacacccactgtacaggtgtcaacccttcttctgttgtccatctctctctctctctctttttgaaatggagatggggtctcactatgttgcccactctggtctcaaactcctgggctcaagcagtcctcctgcctcagccttccataatgctggaattacatgtgcgagcccccatgcctgacctgttctctgtatctcttaacattagcctcattctcaaacatgaagagagtagccttggtgtagactggccacgaattggcgattgttgagatgggcgattggtagtgagggtacccatgaattggcgattgttgagacaggcgatgggtggtgaggtactgtttgtatgtatttgaaatactgtctgtgtatagctccagttgaattacctcctactgagacccactggccttagcctgtggtgtggggatgaaagtggggagggaatagaggaggaggctggctagataggcttggggctggctgccaggacagttaacatgacttacatggcacatcgtacatttctatggaacagtgctgttccgatttagccccttgctaggcaaagtgattcatgaaccagcaacagtggtatcacctgggagctcgttagaaatgcaggatctggccgagcacagaggcttatgcctataatccccgcactttgggaggctgaggccggaggaccacttgagttcaagaccagcctggccaacgtggtaaaaccccatctctactaaaaatacaaaattagccagatgcagtggcacatgcatgtaatcccagctacttgggaggctgaggcaggggaatcgcttgaccccaggagtcggagatttcagtgagccgagattgcaccactgcactccagcctgggtgacaaagggagactccatctaaaaaaaaaaaagaaaaaatgcaggctctcaggccccaccccaggcctcctgagacagaatctgcatttttatgagattgtcaggtgaatcatatgcacatgaatgtttgcacattaaatgagcactggtctggatcctttaaaaaggaatgattggttttatttaattcatattttaatagagtgactcctcccttatcttccaagttgagctctcccagcatagatggcccagctgccagggctgatgcccatagtctgtgcataaacaggggagttcccgagcccttttccaagccgcttttaaatgcaactcctttttttttttttgagataggctgttgctccattgcccaggcaggagtgcagtggtgcaatcctagctcactgcagcctcgacctcctgggatcaagcgatcctcccaccacagcctcccacctaagccccctgagtagctgggactacaggtgtgtgccaccacacccagctgattttattttttgtattttttgtaaaggcgatgttgttcaggctggtcttgaactctttggcctcagcgattctcccacctcagcttcccaaagtgctaggattgccagcgggagccaccctacccagccgaactcctttcttacacgtagttctgacagtatcgatcatccactcttcaaggtgctaatacattaaaacagcaaattggaagtaggccaaggaggtgctagtggcagccccacggacagtagcaattaagaccagttgctagcttgatagtgggagaccagaaagactaaaaataattgcaggctgtgttggtctggtatggatgctgacttcctgacatgtagctaggtggagtggctcatgctgtaatcccagcactttgggaatccaaagtgagacgataacttgaggccaggaattcaagagcagcctgggcaacatagcaagaccctgtctctacaaaaaaatttaaaaaattaaaaaaaattagctgacatggtggcacgcacctgtaagtctcagctactgaggaggccgagatgggaggatcgctggagcccaggagttcgcggctgcagcaagctgtcattctaccactgcactctaggttgggcaacagagcaaggtcctatccctaaagaaatgacaaaataaacagtcaaccacctggtggagaaggtagtattttcaccaacgctgtagcaaatgtcaaggccaagacaaacacttgtttggaaaatttagttttggggaaactcctctcctctagtgtgctggattcatgatatattgttacctggaaatggcagccctcagtggataagaacctggggttttggagatgacccatgtttggcggcacctgatccctatcagcagccatgcgtcccactgtctaggcagtggccaagggtgctctgtcttggacggcagacagcacatctgatttggaatttttgttccagcacttcttagctgtgtgactttgggcactgctgaacctgcttcctccgtgaaacagccagtgataaaactatttactgtgtagaggattctgtgagactcaacgtatggcagtgcctgatgtactattctaaatttatttttatttttattttagagatggggtcttgctgtgttgcccaggctggtcttgaacccctggcctcaggtgatcctctggcctcagcctcccaaagtgctttttcattttctcctcaaaatgagaaagtaaagtgttatggtgttggcagctcacccatagaaactgctttaaaggccaggcatggtggctcatgcctgtaatcccagcactttgggaggccaaggcaggcagatcacctgagatcaggagttcaagaccagcctggccaacgtggtgaaacccatctctacaaaaataagctgggcatgatggcgggtgcctgtaatcccagctactcaggaggctgaggcgggagaatcacttgaacccgggagccagaggttgcagtgagccaagatcacgccattgcactccagcctgggcaacagagcaagactcaaaaaaaaaaaaaaaaaaaaaaaagaaaagaaaaaataaactgctttatattaaaagaaaaataatggtcataatctggccttaggggctatagcatcaatggtgaggcctagatcgcccaggtcactgggtgtgtattgacgttgtttacatgttttatttcttttatgctttttcccagagattgatttttttttctcccttatgtgattcaaaatatctgcttacacgttaaacccagctcagttggcataatgtctttttaaggcacaagccagcttcctgggtgtgagcagcttccacatcaaatgttcagtgggcaaatgaaacatgtgagtcacacaacacttggcacctctgtggcttttaatatttggtggcaaacttcctaccgcgaggagaaaattttcaaagtggaagtcctttcagatccagatggcaaaagaatttgttgggcgagggatcttgattcttaatgttgaggggactaggaatgtttgaattttctcccccttgtattttcccagcctggtaggcctccatgggggccaaatttagttgcgaatttgcccacttttgtgcagagtgaggctccatctatggaatgtgcttaaccataaggatcagaaaaatttctagtagctttgttaagtgcacagcaaacagaagacaaagtgtggccgggtgcggtggtttatgcctgtagtgcaagcacttagggaggcagagatgggaggattgttgagcccaggatttcaagacccagcctgggcaacatagcaagacccccttctccaggaaacggaaaaaaaaaaagagtttgaaaaaagtgtgtagactaactgaacacttgcaaggcaattttttttttttttgactgtctggagagcttgggttccatgaacacaatacagctcttgttccacgtgacttacaagttgggccccgggttttgttttcttggccgagatcttgaagactgtctccaagtaggtgtttcttccttggcagcaggtttggccagttatgtagtcagccctgtccttctctgaagggtgggtagttgagttgggggtatgagaggggtgacagtggatcatcttagctttttttctatttcacgtcattgttcatggatacaagtgcaggtttgtgacataggtaaacttttgtcatgggggtttgttgtacagattacgtcatcacccaggtattaagcccagtatccattagtttttttttttttttagttatttctcctgatcctctccctctttccacccttcactctccaaaaggccccagtgtgtttttcccccctctctgtgtccatgtgttctcattgtttagctcccacttataagtgagaacatgcagtatttggttttctattcctgagttagtttgcaaaggataatggcctccagctccatccatgtccctgcaaaggacgtgacctctttcttttttctggctgcatagtattctgtggtgtgtatgcgccatgttttctttatccagtccattattgatgggcatttacattgattctatgtctttgctattgtgaatagtgctgcagtgaacatacatatgcatttatctttatgatagaatgattgatattcttctgggcctatactcagtcatgagattgctggatcgaatggtatttctgtcttcaggtctttgaggaatcatcacactgtcttctataatggctgaactaatttacactcccaccaaccgtgtatataagtgttcccttttctccacaaccttgccagcatctgttactttttgactttttaataatagctattctgaccggtatgagacagtatctcattgtctcatgcaattttttttttttttttttttttttttgacagggtctcactctgtcgcccaggctggagtgcagtggcgcgatctagatcttggctcactgcaacctccgcttctgggttcaagctattcttctgcctcagcatccctagtagctgggattataggaatgtgccaccatgcttgtctaatttttgtatttttagtagagatggggtttcaccatcttggccaggctggtctcaaactcctgacctcaggtgatccgcctgccttggcctcccaaagtgctgggattacaagtgtgagccaccatgcctggtttatttcattttaaaatgcaatttttctgaaggtagtcattgtttttgcatgttttcttttcttcaaaacatttttcatttgttaatcaacattttataaggcttaatattaaaaaagaaccaaccccaccccacttctccccactctcatttcctacacccaagagcagccctggttttctttttctttctttctttcttttttttttttttttttttgagacagggtctctctttgttgtccaggctggaattgccgtggtgcgatcatggctcgctgcagccttgaccaggtataggaaatgagagcactgtgcccggctaattgttgtattttttgtagagatggcatctcaccatgttacccaggtggtctcgaactcctgggctcaagcaatcctcccgcctccgcctcccaaaaagctgggattacaggcatgagccattgtgcccagccagcccctggttttctaagtagcaggcttataccacttgtctttgatatttcagtgttaggtgttgacttactgatgtgttttatgagacatggatgaggattctggcctcagaaaaggctgcctacgcctctctctttctcagaatagtcacatttcacctgtaattccagtgctttggaaggccgagacaaaaggatcaccggaggccaggagctcttgactagcctcggcaacattgcaaaactctgtctctaccaaaataattaaaaataaaaaaattatccaggtgtggtggtgtgcacctgtaagtcccagctacatgggtagctggggtgggaggattgcttaagctggggaggtcaaggatgcagtgagctatgaccacacccctgtactccagcctgggtgacagagcgagagtctgtctcttagaaaataacaaataaatacatttttaaaagcatagtcatacttctctttttggctcaatcaattttcaaatatacagtgtttccatagctatgactttgtaaatattagtattctttgtacactacttaatgtatgcctaaactctcctccagcaacatagatctcttaaaatatggaaggccatcagtgaggtagggtttcatctttcttggtgacagcccttcttggcccccctattctgcccagctgggtctcccattcctcatcatctcgggggcttcctcccatctctctccagctttggatctcctgactcgtgtacgccatggctttgttcttcctggttaacctctcatttgctgcggggatgttctccgattgcttcctgatagatggtgaccatatctgcgatccgacaagatcttctttattctgtcctcaaatcccaggttggaaaacacttcctgcagaatgggaaagatttggctccccgttttctagcatccgtcaagggcgttctgcatttttgtcctttgttctaacaccttgtagagttgtctttttcttcttcttctcagatttcatgaacacgcaccttggcgtggttcttatggcctggtctctgttttctgtcttccagagttgcgttagtcagatgttgcactttgtggcctgatctgctaatttttcttacttttcatttgtctttcttctctcttttttttttttcttttgagacagcgtctcactctgtcacccaggccagagtgtggtggcaccatcatggctctctgcaacctccactgcttgggctcaagggatcctcctgcctcagcctccccagtagctaggactacaggtgcacaccaccacgcctggctaattttttaagtattttatagagatagggtctcactatgttgcccggactggccttgaactcctggtctcaagcagtcctcccaccttggcctcccaaagtgctgtgattacaggcgtgagccaccgcacccagccttacctttcactttcatgcctctgtcttttttgatgtgttttctgcaggaatttctcaaccttccagtctttctaaacttttatgcatcttattttagatttccaagttttcttattctttgaacatttttatggtctgttctttcatggaagcatcatcttttatattcctggctacattcatcacagttttttaaaaagtttttggccaggcaaggtggctcatgcctgtaatcccagcactttgggaggccaaggtgggctgattgcttgagcccaggagtttgagaccaacctgggcaacatggcaaaaccctgtctctactaaaaagacaacaattagctgggcatcgtggcacacacctgtagtcccagctacttgggtagccgaggtgggaggatggcttgaacactgaaggtggaggttgcagtgagccgagatcacaccactgtactccagcctgggcgacagagcaagaacctgttgcaacaaataaaaaaattttaaaaaagttttcttctgttctctgcgttggaattttttttttttttttttttttttttgagatgaggtttcactcttgttgcccatgctggagtgcaatggagtgatcttggttcactgcaacctccacctcctgggttcaagcatttctcctgtctctgcctcccaagtagctgggattataggcacatgccaccatgcctggctagttttttgtatttttagtagggacagggtttcatcatgttgcccaggctggtcttgaactcctgacctcaggtgatccacctgcctcgtcctcccaaagtgctgggattacaggcatgagccactgtgcttggcctctgcattgaattcttactgtctttactttgtaaaatgttttttaaaaatatataaacagttgcataccatgcattttggttgcaaaatataatacagtgaacacccaggaaccctccacccaaccctaagaatcagagctttgccagtcaattgcatccacctgtatattcctcccacctcctattccctgccccctctctgggacaggtgacccatcctaagtagtgtatttattatgctcttgcctaaaataatgtattttctgcacccatgaatagatgcttaagtagtatatgattactcttccctgagtttgagctctataaaaatggtattattctgcaatagacttgcaggatttgccttttgaacttgagttactgcaacattatctgtgaggttgtctgttataactgtggtccatttattttctctgatgcttaaacccagttgtgcggctagacccaaatttctttagcctttgtcctgtcgctttgtctgttttcctcgtttccctctttgttttggtcccagttagaggtttcctcaaatgcctagtgacgtgttgttgtttgttcatatatcagagcatggcaatagaaagggtgtgtgtgtgtgtgtgtgtgtgtgtgtgtgtgtgtgtcggggtaaagagcagttttggtggcccccaccgtaagtaattaacccaggtgtctagttgcggggagcccccaggcatgggtatcagtggctcattctcttggactggtcagtttctctagcaaggagccctcagtgttcctgctgggtggtgcagttgggaactgttagtctgaccacctgtcttctaggcaccaggctggggcatgtgctgggatattcactcagccccctgcccatggtcatgagaaaccccagtcttctgcccacagtgcaggagggacctgaccgcagtggcattttgcacacctgcccggcctccaagtcctgcagctcgaatgagcttgcttgctgcaggcggcctgctccatcttgaggcttgtctggaaaggcggcttcggctttccagtgctttccagcgctttccagcttctgagattttgggggcttttcatttgttcttgctttcctgtcctctttgtcaggtgagtttatacctttctgttccaaagcaaacaggatcgtctgccatgttgaactggatgtcggacaattctgaaatgtgtgcatggggcaaggctgtgtgtgatgataccagtttcataggaaacacttcggttttggttttgtctttcaaagtcatcttttgtgagcgccttctagccgggctgccagcgggtaacatatgattaacacaagtttggagtctgtctgcagagcaactttatgaaatgctcagaaagccagtctcctaagcataggagcctgtttggtggtgatgggatgaggaagcagtgggggctttggcaccagaggcctgggctcaaatcctgcctccatcatttaggggttgggcatctccattcccttatctctgggtggcgagaacttcctaagttcttagtgtttggaagggaccccctccataaagtgaggtgcctcttggccactgctcagccagtgggggctgttcctaacagttgcctcctccgattgctggagtaagaaatgacaccctgtctcccatttctgtggcaccccattctcaacagtgatggttctgcctgtttttagtcacacacacctgcacacttcaaaggactaaaaatggactcagttttctttctttttttttctttttgagatgaagtctcactctatcacccaggctggagtgcagtggcatcatcttggctcactgcaacctccgcctcctgggttcaagcgattcttgtgcctcagcctcccaagtagctgggactacaggcatgtgccaccacacccagctaattttgtatttttagtagaggtggggtttcaccaggctggtctcaaactcctgacctcaagtgatcctcccacctcagcctcccgaagtgctgggatgacaggtgtgagccacctcgcccggcctggactcaatttggattgcaatgccccacaatggtgacctccctcttctctgttaatgcatcctcttccctcttgcttaaaaatttccccagtgccgtggcatcttacctcctgctgaagtgtgtgctgatgctttgctgggggctggaccccgtcccttggagcctggcccaggccctgcctcccagtgaaaccctggccgcctttccaacctcagaggctctatctcctcccaaaccctgtagcccttccagttgctggtcactgacttccattaattggcccggtggccttgcctgccagggggaccatgaggtgaggggccgtgtcctccgagtggtctctttctccagggtgctggggacccaagaaatgcctggtcgtttctcataggttgataaggaaaatgaggcctaggtagggacaggcaggatttcacctgaatttacaagatgatgcaatggaagagtcttcagtatattttcacgtattttagaattgagttacaacattcattttggtactttctctgtgttctccccatgtgttaaaaagcagcttaaggccgggcgcggtggctcatgcctgtaatcccagcactttgggaggtcaaggcgggtggatcacgaggtcaggaattccagaccagcctggccaacatggtgaaaccccgtctctactaaaaatacaaaaattagctgggcgcagtggcagacgcctgtaatcccagctactcgggaggctgaggcaggggaatcgcttgaacccgagaggcggaggttgcagtgagccaagattgtgccattgcactccagcctgggcggtagaaggagtttccagctcaaaaaaaaaaaaaaaaatgcagcttaagtgctggtttagcgcctgtaatcccagcacgttgggaggctgaggcgggaggatcacttgagcccaggagtttgtgactagcctgggcaacatagcaagaacccgtctgtacaaaaaataagaaaaattggccaggtgtggtggcgtgcatctgtagtctcagctccttgggggctgaggctgaaggatcgcttgagtccagcaggaggtcaaggctgcagtgagctatgatcaagccattgcactccagtctgggtgacagagtgagaccctgtctcaaaaaaaaaaaaaaaaaaaaaaaaggaaacaagaaagaaaaaagcagctaaattctgctggaagtgtgcagtaaagcacaagttttcagccatcaacgcagggagccgttaatcacgacccataataaccagaatgttattccacggttgcggtttgtttatttcatcagagttgcgtcttcacctatttccctccctactcttaattgtttatccaagttagtgttttccattctttcactgaaggctctaaaaatggtcccatcaagaagtctggtagataatggaagacgaagtggactttacagaaagatgaattttcttccctagagctggaaaacccttcagcgtgtcatgcgttccccagccaggacagacaaagccacgcaatctgtttcctgcaggcccagaggggaaggcttcctccttgtggttagtgacttcaaaagctgtcctcactagagcaagtccaactcttcctctagttctgatgacttcacggcagccaactgagctgctgaacgctgtttttttctacgcagaaaccctcccgactttcacgaggagttgacaggttttcctcttcactcgggctcccttgtcatcgttaaactgaaactgctttcttgtagccaaattctgtggtcccttttcggcctcggcctccttgacctctctgtgtccccaccttggctctcccacgcctgccagccgtaccacaggccccgggtgtgaaccctccctccgcggtcatgcagccacgcctctgctcaagctgtgcctcctcctgggcgcaccctccctctcccatccttcagcctctgaagtcctgcccagctccggttcctgtttctgttaggacgaggcccttcagatcctctccagcaggtggactctgtcctgccccgtaccacccgccgcgggccacttttgggcctgcgccatgttcctgcccttaccccgcccggtgttagcgtcacgtgggtcctgatgtcctccctctcccaggcctctgcttatctgattgggggctgtgcttgactctgaaacccgggcacctcctacagggcattttgcctgtcacaggcctagcattcaatacctatcatatttttgaaatatctgcagaaataaaaagaaataactattttcttcttcaggagttaagatgcgtggccaccaagtacttttcaatacataaaatatgttttcagcacagaaaggcctttcaccgctcttacttacatagtctgcttttggtatgatggggacggatgaaaaatgaggactgtaggcctccgaagtcagctgttttgaattaaagcagcgcacgctttgagtcaggtgaagcgaggatggggtttcacccgttgaggatgaatttgctgggttactttaaactggaactgttcttttcagaaatgagtgaagcaggaagggaaagacggagcttgtctggctgggtcggatgaccccctttgccaggccgtcacccctctaggttgagttagctcagaataacttagctgtgctatagctttgcataattgcaaggagctttgtttcgttttattttgcagggaatttttttccccccttagctcttcctcctggtgtatttgtagaaatcagcttcatcatggtcatttaacagtaagggctgggggtggtggctcacgcctgtaatcccagcactttgggaggccgaagtgggaggatcacttgaggtcaggagttcaagaccagcctggccaacatggtgaaaccccgtctctactaaaaatacaaaaattagccgaatgtggtggcacgcacctgtactcccagctcctcgggaggctgaggcaggagaatcacttgaacccaggaggcggaggttacagtgagccaagatggtgccactgcactccaacctgggcaacagagcgagactctgtctcaaaaaaagagaaaacagaacatactatttttgttgtttctgaggagtagggtttcttaccagggaacctgctttaaaaaaatgcagtatgtagattccttaagaataaagttaagcagcagctaaccaagcacatggctaaaaacccggccaagagcattgtagtatctggttttggggttggtggtggggatcccattttagaggccgactttggtttgtgatggttaggttttactttcttaggtctcagctcacatgtccccttctcagaggagccatcctcacccatcccttcttggtccctcccgccttccctgactttttcttcttcaatgacttatctgcacatgatcccctacttataaaacctgtgtcttccactcctctcacccgaaagaatgtttgaattctgaaaacaatgactttgttcttagcacccacaacagcaaatgctcagtgagccctatgttgagtgagttagttgtgagctgtggtggtttagtgagggtatactttggcccttagaatgcgaatgccttttttttttttttttttttttgagatggcgtcttgctctgtggcccaggctggagtgcagtggcacgatcttagctcactgcaacctccgcctcccaggttcgagagattctcctgcttcagcctcctgagtagctgggattacacacactcgctaccatgctcggctaatttttatatttttagtagagactaggtttcgccatgttggccaggctggactcaaactcctgacctcaggtgatccgcttccctcggtctcccagggaatggctgtttaatcacaagaaagtcttcccttcatgcgttgtgaaaaccagcagtattttaattgaagaaatccggtattgtttggctttctagatttggaagtaggtcaggtggctaatgattgaaaatggaccggcaaccagagggcctttggaaactctagctcgacttcaggctatagttttgtttatgcccttgtcactaaaggcactgcccatgagagctgggtttgcagtccctgctgagcctggggttgagagcagagccctagagtaactcagcaaaggcatccctccctgcacctgagctgggggagaggcggcttatgattaactcagcgatgtctcaaatgccatttctagaggctgaacacattaacttttaaaaaatgatttaaaaattaccaattgaccgtatccggggctgaacctgcgtgattcagcttcttttaaaaatatcttttctcaacaaattgcttccttaacattttaatttgttgatcatcaaggaagcttgccaaatattagctgttcttttccatttcctaccgcctcaagcttcccgtatttggcctatttcagtggagctgtaaggtcactccctatttttcttcccaaataactgtatttattactgtcaggtattggcgggtttgatccagctgtcatcagaacgtttggaaataccgttttttgccagaatgctgatttaatgatctcatactgacatggcttgttctctctgcagacttgataacttgttgaatatgttccctcttcttattgagcaatggtgctttttgaaaatttttcccagccagaaggcttcatgggtagtatctttaagatcctagcagaaggttgcttttctctctctctctctctcagtcctttctttttctcttttctttgcttctttccttctttcctttttctttcttttctttcttctctttctttctcttttcttggcttatttccttctttcctttgtctttctttgctccttccttccttccttttcttccttcccctttctttttccttccctccctccctccctaccttcctcccttccttccttcctctctctttctgtctctctgtctctgcctgctttttcctctctctctctgtctctccccccttctcccctctcctatcctcttcttccttttttctttttttggaaggcccagattagtagcagagactctccttgaaggggatagatgcattgtcgctgtttggtattttgaacagattcttaagaaaatgttttcctggtggaagatttcagacacacatgaggtgagaataatgaaccctgtgtgctgcccccagcatgatcagttccaaactattggcctgtctagtttcatctccgcccctgcctactcctggaattttgaaaaggacatcatattattttctccataaatatttcagtatgtatctctaaaagataatgtcacttcgaaaaaaatacctaataccacgatcacacctaaaacataaatgaacaatatgaaggatgagtttctgctgtgtggcatggcagaatgatgctctgtggggtcccaggggagaggtgagctaagttcagtgtgtcacctgctgtcacctgccatcacctgtcccagggcctggggctagccactgctcttttgtgagcctcagtttcttcatctataaaactagaggattgtactagtctgtctgtctttccttcctttcctccctttcctgtcctgtcctgtcctttcctttcctttatcctctctctcttttatctccccttcctcccttccttccttccttccttccttccttccttccttccttccttccttccctccttcccctctcttcttctctctttcctttttttaaagagacagagtcttgttgtgtcacccaggctggagtgcagtggtgcagccatagctcactgcagccttgacctggtagtctcaagtgatcctcccacctcagcctgtgaggttccgggaacacaggtgggcaacaccatgcctggctaatttttaaattttttgtagagacaggctagtcttgaactggcctcaagcgatcctcttgcctcaggcccccaaagtgccgggtttataggctgagccactgcacccggcctgcactagttttttttgtctctagaaatctgcatctctgaatgtgttaggtcctgacctgctttagaacggatctcagccaccctgctccttcgaacccacatttctgccccgtgtctgctggtcgcaggaattggcacattttcctttagctgcgcccaccagtccttgcacgcatactcctggtcacttttttaatgtctggcagatggtttcaagtgcaatggcgtctctgcgtaatagttgattctctaaagaacagagtctactaagtggaagctgcgtttccacatttagcagttagctgttaagagccagtaacaggtgcaaatttgcaacccgttttttccccaatcttttggaatggaaatggttcagtcatttgaatttaacaaactgcctgcccggcatgcactgcagatgctgggctgcaaagctggttttggtgctggttggccccctgggtgcccctgtctactgagggtgggacaggcggaggactgggggctcagtgctgcagaggcacatgtagggtggggtggggtggggtggagaagaagtcctgaccagtcctgatttggtggtgctggtgcttatgggctagtgagatttctgcatgcccaggctggctggtagccatgtgtcagtcactcataatcccagtaccagagttatcatcacccctaacttttttttttttttgagacggagcctcactctgtggcccaggctggagtgcggtggcacgatctcggcttactgcaacctccacctcccggagtctccctctgtggcccaggctggagtgcagtggcacaatctcggctcactacaacctccacctcccgggttcaagcgattctcctgcctcagcctcccacgtagctgggattacaggcgcctgccaccatgcccggcaaatttttatatttttaatagagatggggtttcaccatgttggccaggctggtctcaaactcctgacctcatatgattcgcccaccttggcctcccaaagtgttggggttacaggcatgagccactgtgcccggccacccctaatgttttgatttatttcctttgaatttttttttctctgaataaatggattgatgatatctattgacatagtcagaaactcaagaaacatctatggagcatctagccatggagcagacactcctgttggtctcgggggtgtgtggcgggaaggtcagagtccttctagtcctccaagagcttccagtctggtgggtccctagaatataatacattgtgtgttgtcgtaggcgggacttgcacgctgtgcagttggctttacggttgacaccaggccaccagtggcctcctccgcctgcccttccagcctgcggttgtccttcagctgctgcctgtgaaatgtgatcctttccataagtccccagcacagagactgggaaggcagtttctaagaaggcccttctgttgggctggctcagaacctgccccctttcctctgacttgcctataaaaaggtgggtttttcctcctgcctataaaaaggtgggatttcacactgacataatttacatcgagggacatattaaacctggtgtaatttgcaagtgtgccctgaacacgtttcatcatcaggctcgttgtggagaccacggtgtccctttccttcccatcgtaagtccccggtgtgtgtgtgtgtgtggaaagtttagagctcccaaagtttagagctcagagaggataaagacccgtattactaaacttatcaggaaaatgtggcttcagattattttttttcacagcaataattgcatttcatgtattttttttttttacttattacagaaaatttcaaatatatacccaaacagaagaagatcatgaatgcttttgtgtccatgactcagcttcaataataattatttacttgtcgctggccttgtcttatctgtaactttctcatcgctcacccgacttaaattttgaaacaaatcccagacatcatatcttttgccatccacagatacatcagtgtgtatctctaaaagagaaggactttgcaaaaagtacaaccacaataccattagcacaccctcgaaaaatgacaaagattcatcaatatcagctatccaatatcaaactgccactttcccacaaatgtcataattaaaaaaaaatttgtttcaatcagaacaagaaaatccaagtgagattcaagagtcccgctgggactggttcatgtgtctttgtcttttgagagttcttttttttttttttcttcttttttttttgagatggagtctccttctgtcgcccaggctggagtgcagtggcatgatcttggctcactgcaacctctgcctcttgagttaaagcgattctcctgcctcagcctcccgagtagctgggattataggcatgtgccaccatacccagctaatttttatatttttagtagagacgaggtttcgccatgttggccaggcttgtctcaaactcctggccttaagtgatccacccgcctcggcctcccacagtgtggggattacaggtgtgagccactgcgcccagccagggctctttttatattgcaaaactgaaactctgcacccattaaacaataacactccatttcttccccaccatgccctggcaaccatgattccactttgtctctatgcctttgaccactctaggtccctcgtctaagtggaatcatacagtattgtctttctgtgactggctcagttcacttagcacagtgtcaaagttcctccatgtcgtagcttgtgtcagaatttcctttctttctaaggctgaacaatattccgtggtgtgtgtataccccattttgtgtattcattcatcaatcagtggatgcttgcgttgcttctaccatttggctgtggtgacactgtgtgaactctggtgtgtatatatctcttcaagacccagttttcgtttcttttgagtttatacccaaaagtggaattctgtttgggttgcaccattttaaattcccaccaatggtgcacaagggttccaatttctccacagcctcgccagcatttgtcattttctggattgtttttttttttttggagacaggatctcactgtgttgcccaggctggagtgcagtggcacaatcatggctcactggatccttgacctcctaggctcaatcaatccatccacctcagcctcctgagtagctgggactataggtgtgcaccaccacaccccgctaatttttatatttttttgtagagatggcgtcttgctgtgttgcccaggttggtcttgaactcctgagctcaagcgatcctgctgccttggtctcccaaagtgctggggttataggggtgagccaccatgcctagcctggatttttttcttttttaatggtagacatcttagtgggtttaaggtggtatctcattgtggttttgatttgcatttccctaatagatagttatttttatttttatttaaagggagtctcgctctgtcgcccaggctggggtgcaggggtgctatcttggctcactgcaacctctgcctcctaggttcaagcaattctcctgtctcagcctcccgagtagctgggactacaggcgcacaccaccatgcccagctaatttttatatttttagtagagatgaggtttcaccatattggtcagactggtctcgaactcctgacctcaggtgatccacctgccttggcctcccaaagggctgggattacaggcatgagccactgtgcccagcctaatagatagttatttttaatacttatttaagcttcatgtttcaactgggggtgcttcatgatatattaatatttaatgagccaccttaattatttctaaaaaagtaaaaaagggaaatactatctcccacatggtattattcatgatgtatatcttttttttaaatgttttgtagaatcggaccaaaatcagaccaatcctctcagtttatcacaaagataccaaaacccagagagaatgaggctttgccttagcctcggccctgggagatagaagaggagcctggggcctgggttccccctgccgtggctgcccagtccttccgctgacaccatttcgaggtccccttgtggaacttctgtgggaggccaggtgcacaaagtccggtttgttgagctacagatgcccgccagcagttgctgttattatagactggttgttctgatttgtcaagaaacccagaacaactgtttttcttctttgcagtggatgtgtgtgcacatgaccttttgagaacatatttcctgatgtggtggaggcactgatgttcgtgcagactagctaagttaaatcttcatttctttcagctgaaattgcctggctgctcctttaagaagtgcactgtgtggagttatcatgtttctcatgctgttaaatgtttactggcaatcctgtctactttagcgtattgttgtcaaatgacaagggagtcccctgtcagagagcaatgacacagcctgtacttttgggggcagccagcgtccgagcgtttccacattcattcttacgcagttggtaggctcaggatgtttgtgaacgccgaagggtgtgcgtgcaccctggagtgtggagatactagcatgctatttaatgatggccaccacgggacgtgcgcactcattcattaagctaacgttttatggtttgttgagtgaaagcaggcacaatggtaggtagtgggtactggagcaaatgactgcaccggccctcatgggacttccatttcagtggattcaggggaaagcagcacgtgtttttgagagaccttggcaacgcaggcgaccttgacgtcgaccaaaagaagagagatttggaatgcttgttttacagcctccggtcaaaaaaaatcatatgggaccctttattgcagactggaacatttatttcaaggtctcaaattaaactagaggaggccaggcatggtggctcacacctgtaatcccagcatgttgggaggctgaggtgggaggattgcttgagcccaggaatttgagacctgtttgggcaacatagtgagaccccaatctctactaaaaaaataaaaattaggctgggcatggtggctcacgcctgtaattgctgcactttgggaggctgaggtgggtggatcacttgaggccaggggttcgagaccagcttggccaacatggcgacaccccatctctacttaaaaaaaaaacaaaacaaaaattagctgagtgtggtagtgcacgcctgtatttccagctacttgggaggctgaggaactagaatctcgaacctgggaggtaaaggttgcggtgagccgggattgcaccactgcactccagcctgggtgactgagtgagacgctgtctcaacaagaacaaaaactaaccagttgtggtagcacttgcctgtagtaccagctatttgggaggctgaggtgggaggatcacttgagcacaggagttggaggctgcagtgagtcatgatcataccgtggcattccagcctgggtgacagagcaagaccctgtctcttaaaaaaaagttaaactagagtagataaatgagcaggcatagttgtttgctgatcattcaccgttgagacaatgaacagctcgttaaataaattgttggtaacaatgaaatcaggagaatttcaatcctgagtcagtgtacacaatacaaggcacaaaacgttgagttaaaggtggttctactttgccctctaagcattttattgacttcaaaacctacaaaggcggcgccatggcatataggaatataggaataaggcatataggaataagaagtttcaaaaagtttcataaaagttgtatttggggctgggcatggtggctcacgcctgtaatccctgcgctttgggaggccaaggtgggtggatcacttgaggtcaggagttcgagaccagcctggccaacatggcgaaacgccatctctactaaaaatacaaaaactagccgggcgtggtggtgcctgtaatcccacctacccgggaggctgaggcaggagaatggcttgaacctcggaggcggaggctgcagtgagctgagattgtgccactgcactccagcctgggagacagagcaagactctgtcttgaaaaaatagaagtaaaaaaagagagagagaaaagcaaattacctgaaatccagaaagatcagagaagggaaggaatggctggagtaagtgttgatcagcggacacactcaagggtttcgtaatgtgctcgccctgccccaggcatcaagggaggtgctcactctgtgcactctgaatcccaccaggggcccacctgccaccctgttctcacctgtgaccactcacggcagccacaagaggcacaggtgttaggtctgccccagccacaacacctcagcacgtggtgtgtggcttcaaccaggtcaccgtgggcacactgggaggggagggcttctgtgcggccacgcttaataaacagtctgcctgggaaactgagcatccaaagtgccctctgaaggagcgggatgctgctgcccgtggtggctccgtcacacgcattctggaaggtacctcccggtaagcaacctgatgtttcatctgtcactgttgatgcatctccatgttagagaattaagcatatggaagcaaaacacctcaggaatacagaacgcattcatgatcaccacggaaaatcaaatcaactcaaagtccaaatgcaactttttttttttttctgagacagggtcttgctgtgttgcccaggctggagtgcagtggcacgatctcagctcttagtagagatggggtttcaccatgttggccaggctggtcttgaactcctgacttcaagtgatctgcccgccttggcctcctaaagtgctgggattacaagtatgagccactgtgcctggcctctcttttttaaaaaaaatagagatgaggtctcgctatgttacccaggctggtctcaaactcccggcctcaagcgatcctcttgccttcacctcccaaagtgctttgattacaggcgagcttttctctttttaagccaacttgtgagtagaatcattcacttgtgcctttagctgttgtctctgtgttgaggaatccagagtccagtccttctagacttatctggggacccgagtttccttctgtagagttaaaacctgttgcatccatccccagtccctttacggcacctgtgtaggcctgtagtggagctggcttttgtcctttgctgtccctggctgagccttggcctcatcttgggccagcgcctcctcccctgggctgctgtgatgtgttggcatttcctgggtagagtcttgtacttgctgttttctcctgtctcagtcttttcccccagggacctggcatgtctgtgtgttggggaccctttgctcatcttacacactgaggacaggcaccttagcgcttggtgccctgggatggaacagccactggacagccagccctgtgccctgtgtccactgcaaacctgatcctgttttttggagcccttcacttggcaatgagaccttcatgggtggggttactgaagcaggagttggtttaagttaaataccatcagccgcaaagctcagaatggatgatgaagtgctttaggggttgacagggcagagctggctgtagggagtgatggagagaggctcccaggaggggaaccctctgacgtgggagttaaaggactggggccatttgtcgtggggggatgggagcagtggcttgggaagggacagaacgggagcaagagggccttgcgcactgatgcttttgaggactgaatctgaacgggagagtggggagagggctggaaacctgggcgagaacaggagaggagaggcccctggatgccagcagagctgtaggcatgatctgggccatgccctgggagacgcttccgcaggagatggtgcggctggggtggagacttcctggcttccgagggcgggcgagggggcaaagggcctggggcatggacttgggcaggtagcaaaggccagaaggagtgggagtcattccacctgggatgtgggaatggctggtgggggcaggtagggggagaccaggatgagccccatgtgcgcgtgacctgtggcagaggggctgtgtcagagccccggctggcgagaggagcatcactgtgtccagaggacgcggtgcctttcagaccccttgagtaagagacagagtgggtctgtcctgtctaggctgagttttcattgcccagcacagtgcctggcacacagtaggtgcttaataaacacgtggactgaacacaagaggttgaggggaaaggtcggaattggccacaggtctcctaatgcctggcatgtgcgtcaacgcatctctgaggatggaatttaaaggcaagagctggaggcccagggctgaggctgtggggtgagcacagcatttgcggggcgcgggaagggagtggctggtggggcgggggagggaaaccagcacgttagaaggtcagccaaggtcaggcggccagcagggcgggaggaggcgttggtgtgcacacgcggggagcctccgtgtcctcaggacaccatggaagacggcaggacacacgtgcgagccacagcaggtgggcgggagctcacaggctgcagaggaagcgcaggggaggcgcaggggaggccaggctctggcatttcccaggaatgtaaaccccggtttcagctttccccgtggctcccctccgccaaatcttaaatcctcttgttaagacgcgctccgcccctgtgtccttatttcccaccgtggtgggcagcttgtctgccatccccttccaggtgccccgcagaaccaccacccttgggaaggcggctcctcgtgccccccctcttgtgccttccctccccagtgccttttctgaccccctcctgagaccgcctccctgtgggccatttgagcacctgtagctttccatccggtgtcttcacccctttgctctttgtagctgtctcaccccgctgcagcttgtgaggccatgcaggccctgatgtttagtgttttttttgtttttttttttttttttaaagacagcatctccctttgtcacccagaccgttgtacagtggcaccatcctagctcactgcagcctcaaccttctgggcataagcaatcctcccacctcagactcctgagtatctaggactacaggctcttgcacccaccacaccgggctaatttttgtattttgttgttgttgttgttttgtggagacagtgtttcaccatgttgctcagtctggtttcgaactcctggcctcaagcaattcacccgccttggcctcttaagtaccgggattacaggcatgagacattccctaatgtttagttttaaagagggggtggtgctatttatctccaggctcaaagcagggcattctttccttaggatctgcgatactccagtcaaggctgtttcttttctgccttttgtaaaactcttgtctagaaattaatggatgagggaagctagggactcttctcagattatttcttgtgaaaacctcaagagtctgaatttacagggaaatcttacaattagctcgatgtggattacagagcggcaaacaaccttaagtggtagagctggttctgcaagatttttccaaccctttgtggtctagttttcatttttccccttttaaagttgttttcagctaaagctgtgaggacagtatagagttttgccttgtaaaattggtagtgagtaattttagaatagatgcttatgaagtctgtaaataaatagtaaggcgcctcgcctagttccacgcacatgtcagtttcgtaactatctccccaagctgagctcacctgccagtgccttggatggacctagccaccaggggctgcagatgagtaggagagcgggtgttgcccagagcagggcggacacccctgttccctgtcatgttttcttctcaaaacctgctgcaggccattggagagcattcctgttgctctctgcacccctctttctgaagcattttactgtgtgatcctagcatccgtggttcaggagatcctgctacattttcctgactgccttgctctgcccgggaatacctggcttatcagcagaatacaggcctctgcttaactgaatttggtcctgtagtgaggactaagaagtgatgtactcagttacatgataattctaaaaaataaaaaaaagcctttttttttttttgttaacacccatcatagtggcagaatcttaagtctgcatgtagagggggttggcagggcagtagaagcagggggccctgtgtcctgttggtagaagagtgagcagaatggccactggagagccacttggtggaggtgcctgcagcacagcgagcagcctccttcccagatgaagcatgcatcttagaggcgaccttgggcacgtgcacagtgagacaggtacaggagtgtctgttgtcatatattccatgggagtgcaagagccggaaggatgcagatgtgcatgggtggtgctggcccccatcaggtggcatctagtagaagtaagtaagggtggtggtggcatgtgtggtcaccttgccagcgtcgcctcgcacaggaaagggctgttgaaaatttgtgggccgggtgccgtggctctcgcctgtaatcccagttctttgggaggccaaggcgggtggatcacctgaggtcaggagttcaagaccaccctggccaagttggtgaaaccccgtctctactaaaaattaaaaaattgactgggcatggcagtgtgtgcctgtaatcccagctacttgggaggctgaggcaggagaatcgcttgaaccccggaagtggaggttgcagtgagccaagattgcaccactgcactccagccttggcgacagagcgagactccatccccccaaaaaaaaaaaaagaaaagaaagttgtgtgcagcgtgattctgtgagttcaagatgcaaagcaatgactttacattattaaagatctagcagacatagaaggatattttatttatttgtttatttatttttgagacagagtctctctctgttgcccagtttggagtgcagtggcatgatcttggctcactgcaacctctgcctcttgggttcaagtgattctcatgctgcagtctcccgagtagctgggattacaggcgcccatcaccacgcccggctaatttttgtatttttagtagagacggggtttcaccatgttggccaggttggtcttgaattcctgacctcaaatgatccacccaccttggcctcccaaagtgttgggattacaggcatgagccaccgcgcccggcccatagaaggatttttttggggggaaagaatctgtaaagtgattattttggaggtggagaggagaaaatgagactaaagaagatagagtgggggcttctatgattttttttttttttttaaatagatatgacaaaatgataaaatttggtaaagctatgtgttaggtacataggaatttatacttttctgtatgcgtgaaatattacgaaaaaataaagccacatacactatctgtttttgtgtgtgtatgtgtcaataggatttaggccttttttgcacttctaggttaaagttttcaagatgagggtattttttccccctctctgttagagaatactaaagttatgttggttttattttttattttatttatttacttagtttttacaatgtaccattttaatcatttgggtatcctttttaaaatctctgagcttttttattttttattttttttgagacggagtctcgctctgtcacccgggctggagtgcagtggcccgatctcagctcgctgcaacctccgcctcccaggttcaagtgattctcctgcctcagcctcccgagtagctgggattacaggcatgcactgtcatggccagttaatttttgtatttttagtagagacggggtttcaccatgttggccaggatggtcttgatctcctgaccttgtgatcctcccatctaggtctcccaaagtgctaggattacaggcgtgagccaccgcgcctggcctcagcttcttttttttttttttttttttaatttttattttaagttccatagtacatgtgcaggatgtacaggtttgttacataggtaaacgtgtgtaccatggtggtttgctgcacctaggtattaagcccagcatgcattagctatttttcctaatgctatccctccccccaccccatatgttttattttattttttatagagacagggcctcactatgttgcccaggctgatctcaaattcctggcctaaagcgatcctcccacctcagcctcccaaaatgttgggattaccaagtgtgagccaccatgcctggtattatgttggctttaattatatttgtggaagaacttctatgttctctttccttattttaaatattgggagatagatgaaacattttaggtttctctacatttgaagaagaggtatattttcttaggttcttctttttgtgagacagagtgcagtggcacgatcttggctcactgcaacctccacttcccgagttcaagcgattctcctgcctcagcctccggagtagctgggattacaggcgtgcactaccacactcggctaattttttgtatttttagtagagacagggttttgccatattggtcaggttggtctcgaactcctggcctcaggtgatccgcctgcctcagcctcccaaagtgctgggaatacaggcatgagctaccgcgtcctgccaggttctccttttgatagaataatataggtacttgcctctgtttctattcagtatcagtgaattatctacaggaaaatgaacacaggaagactgctgaagtaaagaggcccacagtgcctgcattcccttgcctcatgtagtcttagactattcaggatgctttgaaaagagtaaactgtaaatcatatttcatattctttgggccaggagtctggaatggtttcatattgcctgtgaaacaagagatgcttctcagaatgagatttctggcttaattgaattcggattattgcaggcaggatgggagtgaaatggtacattcctttcatgccagttgtggagaggatctccgtgcaggccgttgatagaataatatcctgtgcttccttggtgtctctctctgaggaaataagggcttaatatgtcctattcaattaatcctcaccgcatccttaaaggtgactggaaggcagatagtattaactccattttacttaaaaagcagcggaaacatggtgatttggaactccctgggagccctcgaacttttctctaaactccaccggtagctgaggagcaggacacacgcacagaggaaggacatatttatggcgcatcgccttggtgccaggcaccgttgggaactttttaggatcgtgatgtctttgaattctcaggacgtttctgcgaggtggtgggcggtatcatcctggtttttcagggagaagtcaagtcactggcccaggtcctcaagctggccagtgtggcccggtctgaccccgaggttctgcccgggtttctgtccctccagcctggcatcgtgaactcaggggaaacagatggggaatctgttgttgtaacaaagattctaaggatttgaagcaaaatcaacacactcagttgtagagggtaccacgtggttgataccattgaagacaattgcacctaaatgaaataatttgatggcgtggagtccagtttcagagcgtttgcatcacaccttctgacaccaggctggggggccgcctgtcccagagcatcgaggacagacaccgctgctgttagacctcattccacccctttagtggggacccaccgcgcgctggccgcaagcctattttaatttgtaacaattctgcttgatgacaggaagacgtcaaaaaggagaaatcaggctaactggggctccttgtccacttggggggcatgtctcagtgtcttgcctggggccttgtacacaccctctcttaccgggagtaaagtgaggtttagaaagattacctttgtcctgggtcattcttccttaaatcacagctaggatgcaaacccagacctctctgatgtcagtttgcaagctctttcaggtaccgtcagccacatgccaggccttcagtggggtgatgttttttgttgtttttagaaaatactgctattcactcatgggaaatagggacgagggcttagatttcagctgctttgcattagacaatgatttctcttattataagcagagctctctattaaccaaaaacacttggctgttagacatggtgtttaattgctgttagaatgtatttttgtcacactgccctataataagccaaagaactgtttgtgccaaacagtgaagggaagctaggggaggatgaaaactgtgcctgctactccacctcccttctttcgaggtcgtggtgttttgtttgctgttttagctgtggtgtgtgtgtaccactcgtacctttcacaggaggacacctcatctgaataccagtcaggacctgagacgcgttgagcccctccccacagtgcccacgggtaggtgcgccgctctctgccccttccgggagctctgctttttctacctttagagatttctttcatcctctattacgtaggcctgactttttgcctaataaaggaaaaacaaccatctatttagcactctttttttttttcccaaaatggaaatgactttctctctgatttttacaaagcaaaaaatgagagtaaagattaagaaactacaagaaattatggtgaagggagtaaagatggccatgaatcctatgactgccgatggtttggtcccaggatgcattattcagatattttctccctgtgggcttatgtaaacagaaagctaggtgagtggaagtaacacgtcaaatactgatttgtggctgggtgcggtggctcacgcctgtaatcccagcactttgggaggccgaagtgggtggatcacctgaggccaggagttcgagactagcctggccaacatggcgaaaccccatctctactaaaaataaaaaattaaccaggtgtggtggcacacgcttgtagtcccagctactctggaggctgaggcaggagagtcgcttgatcctaggaggcggaggttgcagtgagccgagatggtgccactgcgttccagcctgggcgacagattaaaaaaaaaacaaaaaaaaaacctgatttgcaacaattttgtgtcctagcctagagtttaccgtgctattgaaaatatctttcggctgggcgcgctggctcatgcctgtaatcccagcagtttgggaggccaaggcaggcggatcacgagatcaggagatcgagaccatcctggccaacatggtgaaaccctgtctccactaaaatagaaaaaattagccaggcgtggtggcacgcacctgtagtcccagctactcaggaggctgaggcaggggaatcgtttgaacctgggaggtggaggttgcagtgagttgagatcgggccactgtgctctgacctggcaacatagcaaaactccgtctaaaaaaaaaaagaaaaatgaaaaagaaaatatctttcaatgatagttaatatatatatacacacacacactgtatttgaagtgacatgttacatggttttccactatatgatttctcatatttcatcaaattgatcctcttgaactcctgacctcaagtgatctgcctgcctcggcctcccaaagtgctgagattccaggcgtgagccaccgcacccggcctctgatctttttttcatctttttcctagtttctgacctcactaccactctgcaccacgttgggatgggtatccttgtacatccgtgcagcttttctatgatttttaatgtctgattattttcttaggttaaatttctaaaagtagaagtgaacagcgtgtgcacatttttatgactttgggtacatttcattacattactttccagaaaagttggaacaattcatagcagtaactgcactgaatttcttgtattacttacctatttttaagcaagtaatataatctcttggttccaaaaacaaagcataaagaaaagtctcctatctgcctacctccccacccactgttgttgattttttggtgtgtatccttccagagtttcattatatacacagaaacaaataccagtgtcaccctcctttgtatgcacatagtctagcatgccatgcacactcttgtgcaagtggctttttattttttaaaattaacaggccaggtacagtggctcatgcctgtaaacccagcactttgggaggccaaggaaggcggatcacttgaggtcaggagtttgagatcagcctggccaacatggcaaaaccccgtctctactaaaaatacaaaaattagctgggcatggtggcgggcacgtgtaatcccagctactggggaggctgaggcaggagaatcgcttgagcccaggaggtggaggtttcagtgagccgagaccgtcccactgcactccagcctgggtgacagaacgagactctgtttccaaaataaataaataaaaattaacagtgtttcttacacttttcaaatcagtacattaaaatccctccaattgtgtgtgtgtgtgtgtgtgtgtgtgtgtgtgtgtgtgtgtgtgtgtttattaaagcgacaccattgttcaatgatatgaataggtatattttatatacttggttccattttgatagatatttgggttgcttccttgaagaatgttgtgcgtacaccgtttgacacaggtgcaagcttatctgcagggggaagccgatttgcaggactcattcctatagggagaggggccaggcccagggacttaagtgtttgtgaatttgtaggaactgccagattacccacacttagcagtttacaccccttccctccagcactggctgcagagagccctgtcctccagggccctaatgctaattctttcatgattgcactaattatatgcacaaaaggaatgcaacagaacaaaacaaaccacctggttttgtaggtgtggaagtgcacattgcagtaaggagtcaatgaaatcggttactgtgggacaggaccctcccctccccttggttattttactaacttggaataacgccacttccttgtaggaaacaggcagtgactgtcagtgagtgtgcctaggagaggggtgggtccttttagagaccaacctcgcagttagccagcaacaggctgcagcttagctagatgaaaagttagtttgagaaactgaagtcattgccgctaaggctggcaaggtgtggctggggccaagttgggggaatgtcgtagtagccggccctgtgcgcctgagcccacaattactgcgtcgctgctggggtctggcaaagctcaccttgatgcagttttgttcaaagcagtgcaatttccaagcctcaaaacagatccttttcaatacaatgtgattgtaaaaattctattaataaagagaaaaaaaagacgcaccagcggcttacaagatctttttttgtttttttttttaagagacagagtttcactgtcgccgaggctgaagtgcagtggtatgatctcggctcactgcaacctccgcctcccaggctcacacaattctcctgcctgagcctcctgagtagctgggattacaggcgcgcaccaccatgccgggccaattttgtatttttagtagagatggggtttcgccatgttggccaggctggtctcaaactcctgacctcaggtgatcctcctgcctgggcctcccaaagtgctgggattacaggcatgagccactgcacccagtcacgagatcttaaagtagaagtaactatggtatttttttcgagaattctgttagggcgagaagcccattcgtactgtgctggaaccatcctgaccctgtctgttctttgcaggaactcaaaccaatatgcctaagtagctgaaactgttgcatttcaaagccttttcaagcatatcttgaggacactgttccctgcagctgaactgaagtcttgatctgagcccaggaggagtccctggggttgtcttgttgggggtggggaagtgggaatgcttgcattcagctttgggggaccttaaccctttgccccctcccctgtccccccttcacatagctttaacatgaaagtctttctgtctgtcagatctcccctgtacaaagagtggtctactctaaaaattgctttgaaattggaatggacccctccctctcttctattttagttctagtttctagctctttaaaataatgcaacttttcgctttattgttctaaatcaatgcattctagccgttggctgtcccagttgcttccctgtggctgggagcccctctctgtggttgaggctggtcttaccattgctccagttgtcttcggccttctggggcttacttcccctgccctggaggcctgaggccagccagccagtgtggtgtgacccccctgacagtgggctctcccggctggcccagttgagggtggtcagttccttttgtggccttgccttcttgggagataaaagtggccccctgggtgccgtgcggcccgcccgcagggtccttggtggagctccagcattgattcctgcaggttcagctcctgccccaaggcagcgtccagctggctgagtggggttctcccagggtctctaagcacaggacagcctgcttctgcatgggggcgcacaggggaccgcagagtcacactcagacccttctaccacctcctgacttgtggactttggtggtgggtggcgacaaactggagtccactgggtctgtggcagagaaaggtggctttgctgggggctgggggagaggaggcgtttttggatcgcagcatataccttgtctagaattgtataaaaacctacaggaaaaggctgatttttttttaaaaaggctgtttttttaaaaacaactaaaggcacaaaaactccaagtgtgagaatatccagaatgcgtttatataatgtgcaccgttgaaaggaacattgaaaaaacaaaaaactccgaggaacaggtcattgggtttggagaagtttccttcagaaagttctcttcctgctcgttcactgtggattaaagctcgttggcaatttcggaagttcacgttcttgagactcggtgcctttggaacaatggctcacaatgaggacggtgtgcgttcccggcaagaatgagtgttgggggcttttctccttatcacccgttccccagacccctctcatcggcctcataaagaaacagatggttcatcaggaatagctcagaaatcacgttggctcctggctgtataaagagtgggaactgggatcataaacatttgaaatctcctaggaaaggacaatgattccctcaatgaaatattgatgtaaagggagcattttaaaaggcagaaatgatgaacctgattcaggttgaagctggtagtgtactttaacctttttgagaattgttaatttaaaagcaaatagaatgaaatatagactataaaagcagattaaatcatttttatgcatcctgggttttttggtgtcacgtgacaggaagagttactacaaagaagaccaggttttggaaagacggtggggttcacgtgatgaaacacaggccatgacccctttaggaattggatggaagccagccaggccaggccccccacccccaggtcctgggttggggctctgtgggcccaaggagtcctccagaaccaaattctccactaagagcaatttttaaaagagcagctgctcatcccatgtccaattagagtgagcagatgtgtaagaaacatgtctttgattgattttgggggagccccccgcagtttgatgttttgcttggaggtaggggaaacgggggctgagttacaagtattacctgtaggaataaacaattcttttgaaacatcagtagggaagaaagaaaaaaaaaggcagcttaagatttatctaaaaaggaagtggaaagttaaagttgctggagatctcattactgtctgtctcgctcaccgtaattaaaaaatgcctgaatgatcttaataacacatgattcagctgacaagcactaattgccctgtatcaggccaagagaagatgaatgttgtcaagaaaaccacaagtcagacaagctgattctctgtgagtctgacaccgtgttcccatgtacagaccagtttttactggagttcttccagcatcaaaagcagcttcttaccttcccattaattttcatcgctggcaggcccgagttgtttgcgatacactgactacctcccttgattcctcctcgctggctcaggagcttgggtctgcagacaaaatgtaaatatgtttcttgctcttatctttgtcctttttcagggaagaaatctgttcccgtccaatatgaatgccctggtgggcttgtcagtaaattacatggtatttgggaattgattttctgacgccaccgatttgtcaagaacttatcctgccttttcagcgatttgacagcacctgttaggctgtagggccatgtgattgggcagttctcctgccgagaaaaaggggactgatgactttctgtcacttgggcatccagaaacctccttgaaggtggaggttattgagggaggaggcaggagtggaaaaatgctattggtttattcctgtgcttttatagaacagccgaaccattctatggcaataaaacagaatcacagggcaaggtgcagtggctcacacctgtcatcccagtattttgggaggctgaggcaggaggatcgcttgagcccaggagtttgagaccaaccttggcaacatagtgagaccttgtctctacccaaaaataaaaaaaaaaaatcagctgggcttggtggtgcacgcctgtagtcccatctcctcgggaggctgaggtgggaggatcgcttgaggctgggaggtgggagcttgcagtgagccatgatcacaccactgcactccagcctgggcaacagagtgagatcctatctcaaaaacaaacaaacaaaaaaggaacttgtttcctagcaagaagcagatgaggctggtgaataagcataccacataagtaagtaatccactaacttagggaatttcgtgaccagtcactcagcacgccctgttgcgaaggggacggctgaccaataggatcatctcagagtcaccctcacacaacttggcttagcctagttggcaaaagtgtctcttcagagacctaccctcctggaattgaaataaaatgaaaatttgtgatgacgatcagctactgtcagtgtgacttaggtgtagaaattaaaaaagaaaaaaagaccactctaaaggcatttgtgcatgaagacacctacagaaataaagccggggtgctgttcttggtcttcattcaggctagcacctctcgtcaccttttcactttggagctcagggcctggttcactcagcaagtgagcggctcacacagtagatgctctgcacatagtagtaggtactcagaatatagcagctgttgatgtacatgtttccagaggggccaacacaggaatctgcacgtgggtccttgctttaagcccagcccctctctgtgggcgtgggatggagtcttcctttcttggtgaccggcgccctctggggtcactggaggcctggacttccccactggcccagtgaccttgtttccttgttccctgtctcgcccagccttggctgtcctgggatttgaaaatctgggataaagcctttttcgggcctctaaggccctgctggttctgcgtgttccagagagctgcacctctgggtggtgagctggcctttttggcatttgatttatgtatagccctgagtcactgggagcggatctagagtccaggccagtgactgatttcaaacgctaacactcttggctcgggctcaggtttcaagtcagcctccaaaggggatgtttgctcatttcgtcatcttcctatcacagcaattttcgtcatatggaggggtggcactcatgtaccttgatgattattattcttttaaaaaatgaagttatttatgttatggggtgagttcgtcacacagtccgaatgtggaatgttgccatccttttcatcccaatcctgccagtgatttctgtttacaatagaactattgacattgtatggggatgaaactagcatgagatagtaattgttggcttgcctgagattttcatcatatgtacacatagacaaaacctggctttagttcctaaagctattgctgtttattgtacttttattagccaatgttacagatccccgtagcatgccagaggctattaagaaatacaggggtcgggggcaggaacgaagtccctggccatggatcatgcaattgatctatagttatttttttttctttttctttaatttttttttgaaattttaaattattattattactgttttttgcgatggagtttcactcttgttgcccaggctggagtgcaatggcatgatctccccctcccaggttcaagcgattttcctgcctcagcttccggagtagctgggattataggcgcctgctaccatacctggctaatttttgtatttttagtagagatggggtttcaccatgttggccaggctggtcttgaactcttgacctcaagtgatccaccgacctcgacctcccaaagtgctgggattacaggtgtgagccaccatgcccggcccaaattattattattttttataagataggatcttatcacacaggctggactgcagtggtgcaatcatagctcactacaacttccaacttttgggctcaggtgatcctcccacctcagcctcctgagtagctgggacagcaggtacatgccaccatgccaggctaagttttaaaattttattttgctagggggtctcgctgacttgcccaggctggtcgtgaactcctggccacaagtgatcttcctgccttggcctcccaaagtgctgggattataggtgtgagccatgcttttggccaatttttagttattgtggatacataatagttgtacatattcatggagtacttgtgatgttttggtgtaagcatacaatgtgtaatgatcaagtcaaggtaattgggatatatacttatagttagcctacagtcttattgataatgttctcagaaatttctgattccagagctccttgctcctctcccataattagataacgtgtttttctgtccggtaattgctgtagtactcatttttagatggggtagggaaggccatgtgccatgttggggcctcatcccaaagaccttgtgctgtttgggacaggtaattatttaaagccccgtgtgaggtgggtgggtgttaaactcatgctctccacaccttcccagagtgcctgggaaagcaggcttctctaagaaagtggaatagcgaataggcagtgatccctgagagagatacataatgattgtcagtttcatggattacagataattccgtttaatgtcctctgtttttcctttttgcaaatttctatgcattatatagaacattgactttagcatagaaagtgctaattcttgatttggcactttaatggatatttacacagtgacaccataaacattggataaacagaggatttgttttaatgagatcttcagtgatttgaagccgtttcccccttgccttctggaatccccggctccagttctgcctggttttggtgatgctgtcacagtggagggctgactgcaggcctcgactgtgagccctcactcggccaccttttcatttcctcgctgggttccaggctctttgaagcactcgcctcctcccctccctgcatgtcctctgtagtgcctatttctgtgatttgcatatagcggaaatatttgttgaactgaattatttttacacacaagcctttcatgtggccaacattttgaggtctgtctcctttggcgggagtctgggaggaatcttccagttcactaagaagtgtttgatagcttcagggcaggcgtgccctgattggggctggatgccctgcctccatccagaggctctctggccaggaggggaatgaaccaagtgcccagattcccccctacaatgtttatgcagaggtgactgtcacctgccaatggtgacagtccaccagggaagtccagaaggcctttggattaaagctacaggagaggcaggtccccttgcagggtcagaaggggaagagagaagagagagagaaccaaaggtgggaggttcagctactcgggaggctgaggtgggaggatccctcaagcccaggaggtcaagtctgcagtgagctatgattgcaccactgctctccagcctgggcgacagagcgagaccctgtcccaaaaaataaaaaataaagatggaaagatgggaggattctccccaggaaggcccaggccgcagggtccccttgtccttaaaggccagctcagtgaggctacaggtccccttgccccagttccccgagcacagagcaggcatggcctcggacgacttcctctttgtgtctcgtggactactcaataaatattaatgttttccaaagatatcttgcccagctctccctgacgaggctgttggcttgaaggaataacaacactcgttgcactcacggaatattaagtctgtgccagggcctgttctgagctcatgacttgtgctactcggtctctccccacaagctcacagggcggatgctattttcaccgccgtttataggagaggaaactgaggcacagggtccttcagtgactggcccccatgagcaggcagcacatctggaattccagcctgtgcagcctggccccaggatccccatgcctctgtgggggacactctggaagtgacaggtgaggcacttctctggcctctctggatctcctgctggccctgaatgtgggtggttacccttttggggtgctgtcggtgcctcttagatgtctcagtgaccctacagggtctgccttccataggactgcctttttctttttttttgagacaggttctcactctcctgccaaggctggagtgcagtggcacaatctcacctcattgcaacctctgtctcctgggctcaagtgatcttcctaccccagcctcctgaatagctgggactataggtgtgcgccgccatgcccaactaatttttttttgtagtttttttggtagagatggggcttcactgtgttgcccaggctggtctcaatcttctgggttcaagtgatctgtccaccatggcttcccaaagtattgggattacaggtgtgagccactatgctcggccggcacccacctttttgtggacttttctttgttgacttggcattcggcaaggtgtaggcttttgccaccaacacgatacccgtggggagaagccccctggcccccgtgcctgccagaagaaaggcttagggtcccctgcgaggacccacacgtgcactgcatgcctggatagcccatgccagcctcactgaggctggatttagttcctgagtatgttatggagaagtgcccagagcagggaccgcaggcacaaggtgggcctggcctttggaggaggctgggcacggccacctgctcctcctctctcccatgggcaggttggccttgttgccattggaaactcttgagagcccacgggtgttttctggccatgtgacctaaatgggaggcttgctgaagggtagatgctgcttcaccagcaacaagaggagcccccagacctcagccacaggatggcccccaccctgctgagcccccactcttcgctccctgctcagcagagcaacacataccattgcccaaaggatggaccaggcacagcgtggggcccaatagcaaatgttctgacgaaggaggtcagtgccggacactgctgggcgttgttgagtcctgggctggcagggacagttttgcagggacggtttggaaggggctttgctggggagggggtctctaggaggggcagcccctgaatagggcagccgagttgctgtgactgcatcttcctttctttccgatgggggcaaaactcactcttctttttaaccattctctgttatctgtttttcttttcttttgaaactttttttttctttctttttttttagaaagaggatcttgctctgttgccaggctacagtgcagtggtgtgattatagttcactgaagtcttgatctcctgggctcaagcagtcctcctacctcagcctcctgagtagctgggactacaagtgtgagccaccatgcctggataatttttattttatttttttagagatagggtcttgctatgttgcccaggctggtcttgaactcctggcctcaggtgatcctcctgcctcggcctcccaaagtgctgggattacagacatgagccactgcacccggccatgtcctctttttctgattcgggaggataagggctccccatgacactggcatcagcattgggagcatttccgtgaccccagggctgctgatacaccctgtggacagggcaggacccacagctaagtcagtaaagcaccatcctctgggagtggctgtcatacgacatttcttgcttttaggaccattggactgaaaaaccaaatcctgccactggatctggtgatgacggtgacatttttttttttttttttttttgtttagaagcttatgattcatcggatctcttttggtttacggaaagcccagatgtcgtggtccctctgcgtgcccactccaggagaacgcattcaatgtcaaggaaccctgtagtgtgcaaagttggatttagggatttcccgaataaagctcactgagggtcaatgagttccataaacattattgaggccgggtgtggtggctcacgcctgtaatctcagcactttgtgaggctgaggtggggggatcacctgaggtcagaagttccagaccagccctgccaacatggcgaaaccccgtctctactaaaaatacaaaaatctgggtgtggtggcacattcctgtaattccagctactcgggaggctgaggcaggagaatctcttgaacccaggagacggaggttgtagtgagccgagatcgtgccactgcactccagcctgggtgacagagtgaggctccgtctccaaaaaaaaagaaaaaaaaattattgaatgtcttccttgtacctgacactgtgctttatcccatttaattccactggataatatgttaaattcagacttgttcgtagatttatatacatgtacatatccctcttaatacattggtttattctgtttctccatgttcataccgccagcctgatgcctcatttgcacaaatgaatggatgagtgaatccagcttattcttttatttctccctgggatctggtatacaagagatggttattttttaatttgagacagagtctcactctgtcacctaggctggagtgcggtggtgcaatctcagctcactgcagcccctgcctcctgggttcatgtgattctcatgccttagcctcctgagtagctgagattacaggtgcacaccactatacccagctaatttttgtatttttggtagagtcagcatttcaccatgatggccaggctggtcttgaactcttgacctcaagtgatccacctgcctcggcctcccaaagtgccggaattataggggtgagccaccacaccttgccaagagatggtcattaaagttgaattttggcactccttgcagaaaccctacaaagttggtatcacctctattttgcatatcagaaaactgatgctggccaggtgcagtgactcatgcctgtaatcttagcactttgggaagctgaggcaggaggattgcttgaggtcaagggttcaagaccagcctgggcaacataaccagaccccgtctctacaagaaaattaaaaaatgagttggatgtgtacctgtgatcccagatacttaggaggctgaggtgggaggattggttgagtcctggagtttaaggctgcagtgagctatgattgcaccactaaattccaacctgggcaatggagcaagaccctgtctcaaaaaaaaaaaaaaaaaaagtgctgagagagatcgtttcccgagggtctttggatagtttgtagaaaaacagtactgttccttctaaagccctgtggctttttccctattccaggtgcacattggcctttgaggctggaaaacacttttacttacttccagctttatgggattcataaaatggccttgagaaaagtaaaccgatttttctccttctaaaaacatccagtgggccgggtgcagtggttcacacctgtcatcccaacactttgggaggccgaggccggcggatcacttgaggtcaggggtttgagaccagcctggccagcatggtggaaccccatttctactaaaaatacaaaaaattagctgggcctggtggtgagcacctgtaatcccagctactcaggaggctgaggcaggagaattgcttgaacctgggaggtggaggttgcagtcaggcgagatcacaccgctgcactccagcctgggcgacagagcaagactatatctcaaaaaataaataaacaaataaatacatctggtgcaggtaaagtgttcaggaagtaatttcctggaagagggaactctgcagttgcaaatgcggccttcttacaagtcgcttgtagggtgttgaaactctctcgcgatcccagtgacttgagatgctctgttttctggataactaagcttttccaccttcactacggggtaccagggtctttgtagcagagaggcagctgtcttgatggtggaaccactcccgccagtgtgtggtggggtgcccccggggatttagggagagagaaggccagtggcagggactggctggaggaagagggtgcgaggaaaaacactggctgacatttgaaggaacgtgcttcagtatcagggaaggccagcgtgggataatcggtgtcttggcagatggggttgacggggagccctgaagccggcagtgtttagagattcaaagaataggggggctgtggggagtcttttggttcacagcagtgtcccccaaaccggcacagtgggatgagagtgggctggccagggaaggggacagggtgttaggtccagaggtgctaaaatccccaaccatggtcaaaatggggacatgagagactcggggttcagagctcacatgaaggacagctgtccccccctccacccccgccttgggtcagagctggctaggagagcccaccctgcagcctgtccttcgtgggaatcagcatgaggggtgcaaagtgctcagcaaggcccggcaccaggtttgttcttgggatcagagtgatacacgcgccttacattttttttaagctgctggttttgcgggtcagtacggggaaaaacggtgagtcccttttataaaatatatagagaggttggtgcgaaaatagcagcttgtttctgcttgcgtatttctactcactgctgggacacaaatctacccttccattttctgaattgtattcattcaaactctgatttaacctctatttagttaatgaattgggcaagttaacctcgaactcttccaggctgtggctgttaccgtcaccatctcctgcttctcactttacacactcatatgagaccttttttatttctgaagtgtggcctgacattgtttaggctgttgtttggtgcttatttttaactcttcttttgtcacttaagtaggatgtcttaattcttgtttagtgttagatcacttagcaggattttttttttgagcgggggcggggggaatatgattttgtgtcacattttgaatacttctctatggcagtatcttttagagttattatggaccctgtaattctgttctcaaagacgtttaaccactagaggtagacaccaaaaatgttttatttgtctcatttgggactctaattcagtgaagttggctgtttggagtctgagactggatctgtttttttattttgttttgttgttgttttgtttgttttcagacagggtcttgctcttctgcccaggctggagtgcagtggtttgatcacaagtcactgtggcctctaacttacatgcttaagcaatcctcacgcctcagactcccgagtagctgggaccacaggtgctcaccaccaggcccagctgacttttgtattttttctagagacaaggcctcataagtagttgtttcccaggctggtctcaaactcctgggctcaagtgatcctcctgcctcagcctccccaaagtgctaggattataggcataagccctcacacccagccaggactggatcccttgactcacttaatgatcggggtttacttctgacctgcatggggtgctgtggggaacccagagatcaataagacagcccgtaccttcttggagctgtatttagcagggtcatagaagacgcactcataatcagaaaccatccagaatgtgacttctggccagggagaatagggaagggttcatggagatggtggcatttgattgaattctgaatttggggttgtaggtttcaaatattagtttggggacagtcatccttttattttcttctctaaatttaaagaaattgttatttttaaaaaccaattggaatgggtattgaatttctgtgtggagaatgtctaccagtttttcatcattttctccactgtatagtgtcaataagtgttaaatgcaatggtctgtaagactttgttgataattttcttttctttgacatagacttgtaaactggaaaccctgtgtgggtaatgggcagtgcctatttcagcatcttgtccccagaaatccactccctaaaaggcttgttgaatgaatcagatctaggagcatctcttttgtgttggagcggagagtcagtccggactttgagcctctccttgcactgaccagcggcaggctgaagacagttggacttaagaaaacttaatctagaagcaatatgctggtcagattctttcaatgctaggtttagtatcgttcctttttctcccatttggtgaagtggtgtaatgctttagcacattttaaataagattacacaagcggctgttagttggcatcaagaatcttttaatctggaaagaaaatgttacctccttcatttgcaaaacagagtgtttctggcaccgtatcccaaagtgtcttctggttgttccgtttttcagaagttactgtgggcttctaattaccctcatttagacatccaggacagaaattgccacttcaacaagaaaattttgtaatgagccggaggaaatggtctcatcattactacgttatacgcagtctgagagtctgcgtggatttttatttcacaagaatgtgactgtttaattgaaaaatgttgttaaaatgtgctttctgttcctatcagtatgttgttagtgcttatatagccatgctcgagtcagtgaaaattggtgccctttgccaaaatactttttttcatttttgtgtataattttgtgagctaggtctatttttgtttaattaggccctgcaagagaatgagggagagctgtatttaaatttttagaccattaaagggcctaaaactatcctagatgaaaggcccccaaaattagctttaatatttattatatgaataaaaccaatagggaaaacgtttccagaaaccctttctctttttccttcttcagacagctggctaagattaattgcaggcctgaacgtgggcatgtttgctagtttctcttgttctattactagaaaataactcttaagagaggagagaaataccgtcttcttgtatttggggggcaggctgtacattttataactcactaatataatgaaatgtttgttgataacatcatattttgctttctgatagaaaagtcctaatttctattttctttttactttttatttttattactttttttttttttttttttttttttttaaaatagagatgagggcttgctgtgttgcccaggctggtctcgaactcctgggcttaagcaaccctcctacctcagcctcccaaagtgctgggattacaggcatgagcaactgcgcctggcaagtttgttttactttttatttttattactttttgtttctaatttctactttcgacaggattccttttaaaattttaatctaggaaacaaaactgcacgtgaaagatttgccttgtagacggaaagttctggaaacatcagctccaggctgtggtgtgaagctgtcgggctgatttgcctggtaagaagcgcgtttggggcacggagggtcaccttgccccctgcgagcgttctttcatcatttgagcagccaagcatcccttttgggccaagtttgccaaagactctaacgtagagaagtggacagacccagttgcatgctgatgttaggggcagagagaaagaaggaaagatccttgcctagcttaagcccttgtgcttcttccccacatttatttgacttcccaaattggattggctgttgtgattgaaaagattgtcagcactatgtaaatgagaatgagaagtaaaagtgcatctcatgcagataatttctatgtagataatttgccataaaaatttatattgcagtccttaaaaccttcggagatttagtctgtctagggaaaggtgatttatacggcattaaaacactttttatgtcccagtcctttagatttaatgtttattgcctataaaaatgaaatcttcttgtggatatttaaaagttttggtactgtgtgaaatatatattcaagttagaaatgctttggagatgttgtaaataagtggcaaatctcttgctccaaagtccactgtgttgtctgggcccgcatcttggctttgcacgcctgaaaagctgcctcgggtaccggtgtctgatcatcaccatagtgggtcgccaagtaggagaatgtcttatgtagggatttggtggtttttcaaaaaacttaaattagctaacaaggatgggactattataattcctcagaaagttatgcaaggtctgaccagaatttcattccaatctgcagaaagactgaattatggtgcagtttttttggttttttgtttgtttgttttttgagacggagtctcgctctgtcgcccaggctggagtgcagcggcacgatctcggctcactgcaagctccgcctcctgggttcacgctattctgcctcagcctcccaagacgctgggattacaggcgcccaccaccacacttggataattttttgtatttttagtagagatgggatttcgccgtgttggccaggctggtctcaaactcctgacctcaggtgatccacccgcctcggcctcccaaagtgctgggattacaggcgtgagcccctgcgcccggcctatggcgcaggttttaaagagtggaagtgctttgacaatggaatgcccagtacaaagcagtttttaggcttttgcagccactcagattcataacagcacgcttcaattctggtcttaaataaaactctcatggagtaaataaatcatatggtggggacagcactgctgtggaggagggtactgtttaagcattttgggggttcctgaaagatgtttctcaaagtgagcgctggagaggagtacctggtttgattgttgaactaaagtgtggtttctgtaaccctagggagttcttccctaggtatgattgagctccctgagtgctgggatggtgacctccccagcctgtctccaagtctgagtactggtcggcttcctagactccttaaaacgctgggtattttatttaattaatttatttatttttgagatggagtcttgctgtgtcgcccaggctggagtgcagtggtgcgatcttggctcactgcaacctctgcctcctgggttcaagcagttctcccgtctcagcctcctgagtagctgggattacaggcatgcaccaccacgcctggctaatttttgtatttttagtagagacggggtttcgccattttggccaggctggtcttgaactcctgacctcaaacactgggtattttggaaatcatgtgggaagtgcttttcctagagttttgtagctcctcaaaaaggcagaactaatcaaccaggcttccccattgtagccacagttggatcccaatggtaagggccattgggaaaccaatggtctgggtgagtctggcctgggaccctggcatggggaagagactggacttgaaggctttggatgggcagcttggtctggacagtattggaaataaaggaacttgagactttgaaattgctgtgatgggggtgttctcacctgtccataggggtgggatgtcagtaagctttgccggtgtctgtcccatagatagactcagctctgcattgcagccccaaaaggagcctgcattcttaaaagaattttaggggaagaaagatttaagagagcacctgaagtcctgaatcccttcagaaggaattcatggctgcctgtagtcagctgccagtccaaccttgccctccaaaagaagtcacagagattgagttttcagcgaggcagggagaagttgtcacatttgcctaattcttgtagaggtgagagtgggagtaaactggaagggggcggattattggtgatttgggggccacgtttccttgtatcacctgtaaagttttttttttgtttttgttttttttttttttttttggagacagggtcttactctgtcatgcaggctggagtgcagcggcacaatcacggctaattgcggcctcaacctccccagactcccaagtagctgggactataggcatgcaccactgcacttggcgtatttatttatttatttattattttttcgaagagacagggtctccttatgttgcccaggctgttctcaaactcctgaagcaatccgcccacctcagcctcccaaagtgctgggattacaggtgtgagccaccatgcctggctcacccataaaattaaaatgaaaagagcagaccacagccagcagtcttccgacctccagctcttgcaggtcgtgggcagccttgccccaggtgcagcaggtaggccaggaagcaggtgtgggaacagagcaacagcaggcaccgtggggacatgcacagtaagcgtcgaatcggtgtgcgtttgcagaaacgtgaatgggtgaatgaaggggtgtatgaaggtatacacaggaacgccacagtcagctttgtgtaaagtagaccagtgaacagattgctggtattgcttctgacagctctgctcctcaggggaaaatggtgaactcactttagaactcgcctttgtcagctccaactagactctggaaggaacacaaatgctcagactttcccatgacagactgtgaagcaaagccagttacacagctaccgtcactaatatttttggtataaagcagttgctaaaattaattccagtctgaaacttgatgaattctcagtcatggaattaacaggtcttaaatgggaaaaataaaaaattagcttgattaaaaataaatgtttgtgctgaaatgtggagcctgtctgtccctaacaaactaaatatgaagtttttcatcttagaggatttgtttgcctttgagtattcatagggaaagtgcacgtttgtaccagaaatttagagacgcactcccagtaagttcttacgagcagtcagtattatcctttttgtataaggcaagcagtcagtccctatgaagagtaagatacaagcctggctcagcagtggcccccctgagcctatctgatgtgcagaaaagtcacgcacacacaactgtcttgaagggcagcctcctttcagccagcacccatttactccctcttattaggccttcctctgaatttatatcaagcaaactatttaggacgcatctgcgaagcaggaagtgtgtttcattttgtttttaatgaggtttcaaactctctcttcccatctctgtccctggatgacagcgcagagttttacgtcatttgctattagacatcttgtggcttgacatcctcgaaggctcagccacccctgggtgtgtttggttaatacagcaagtgaagcctgggcaacatatcgaggcctcatttctacagaaatttttaaaaagtagctgggcatggtggcatgcacctgtcgtgtcagctacttgaaaggctgaggtggaaggattgcttgagcccaggagttcaagcccgcagtgagctatgatcgtgccactgtactccagcctgagtgaagggcgagatgttgtctcttaaaaaaaaaaaataataataataaaataaagaaaagaaaaaagtagaggttctgtgcttagttagaagatatctaacaacacaattggttagactttcataattatttctgctgatgtaagtatcacagcgcaggtcatgggcaacagtttactgttttcacacccagcttcaatgttaaatgaaccccagactatagcgtgaccagtctgatattatcatccccaaatctttatagtttcagctcttgggatggatgactgaataaccattttttttccagtgtggtagtcttagggttttgcttattggtgtgtgtgtttcaagaggaacctctgttccttggacttgatgtgagtggcaagtcatgtaaaaagctggattttatcaatagtttttgtctaaaaaccaaaaccaaaaaattcttcccctgcagtaccagtgcttgaaataaaccaccctcctacccccacccagcttgcctgcgtggatccagtagcacccccggtaccccggtgggcctttttggcagccccgaggggtcagggatctagggggaagagtcaccgcagggagcgcagatgtacttggagtggggaatggttgggggggacccattcccctgctttaaaccgcaaatgtcttttgatatctagtaaaattggcaagcagaatgattgaaaacatgtgagaggtaactggatctaagtctcaagtagtacatatttgagaagttttccccaatgtaaaagtcactctttaagagccttaaactaataaaaacaaggaaattccatgttacggctgccactcggccttttcatttttattccagaagtcagatctgacaggtcagcagctcactggctctgggctccccgtgtttaaagcagtggggacgaggagaagaactggcagccgccgggacggggaagtctccaatgccattcagtgccaggctcgtaattccctcttagtttatcctattttctcttcttggggcggcttcctgtatgtactttattcactgaagctgcttcaggattccttcagagactattcttgtttctttccatttctgtgtctttttttttttttttttttttttgagacagagtcttgccctgtggcctgggctggagtgcagcggcgcgaccttggctcactgcaacctccgcctcccgggttcaagtgattctcctgcgtcagcctcctgagtagctgggattacaggcacgcaccaccacacctggctaatatttatatttttagtagagacagggttttgccatgttggccaggccagtctcgaactcctgaccacaggtgatctgcctgcttcggccccccacagtgctgggattacaaagcataagccaccgcacccggctaatttcctttatagttacactagcttggaagaataacatactgagtggcgtggaaggcgttggtgcacataggtgcagcatcccagagccccgtccactggcggctatttgtgcatggctgcctgtggcttcttatctgtgatggaacctcgtgggcagagaagtggctggagagcatcaccaaggctgcctggtccaagttgcttcctgttgctgcatgggcagtgttctggggtccagaccctgggtggtagtgataagatggtgatggggtggagtgggtccttatagatcccacattactgagcggccttttgcccttcaaaccagatcacaatcccctccctgccagttggtcctcaagaaatcacaggaggctgggcgcagtggctcacgcctgtaatcccagcactttgggaggccaaagcaggtggatcacttgaggtcaggagttcgagaccagcctggtcaacatggcaaaacccggtctctactaaaaatacaaaaaaaattagccaggtgtggtggtgcactcttgtgatcccagctactcgggaggctgagacaggagaatctcttgaacccaggaggcagaggttgcagtgagtcaagattggattgtgccactgcactccagtctgagtgattctgtctcaaaaaaataaaaaaataaagaagtcacaggaggcccagcatacagagaacatcaggtatagagagatgtccttcctgggccaaaacaggtggtgtcattttgctgagtttgatagagaaaaagtcctgatgtctgtgtacataagaactcacgtctagagttcgagaaaaaccggtgatgagaacttgaacttggaggagtcacagggggatcaggaaagcttggtaattggcatgaatttcctacctccaggggcctggcacagagacctaggatgaagagggggccatcgagcatggtgtgaacttggagagtgtggggagctgccccagccgagggcactggatgggaattcatgccagaaccccatcacatagcggcaggagctgtaattgtgcttcttaattgtgtatcttcatttagtgcgagtttaggtggttagcaatagctctttagctagctttacagagtctaagttaaagagcccctcagctatcttgtagaaagcgccctggacaggatggggtgatgctgacagctggagtcactgttccagcgcccagaatggggagactagcagcacttctgggcagcccatgaagcagcctcttccctctgccggtgtccctcatgtccagcagagctagaagtgaaactcactgaggattgacgcggcccctttaaaatcgcatctccgctcttggcaccaggagctgtcatgtagtgtaacctgttggtgcccagaacccaggtttcctggtggcagccagcggtaccggtgccaggaggcagcgaaggaatcacttgcgacgcccgctctctctgccatacgagtgtcgttctgcggggccatctggctggcagcagctctcagccaatggcaggatgttgtaaacctcactcgctgaatgcggcaccgaaaatcttgaaaattaactgcaaaaataaaatcaaagctggctccgagatggtatttcttggcctggcataagctctccggatgaacttgctctgccttgttgatagatgcctcttactagtttggttttttcccaggagccagttggcatcttttaacttttccttgtaaaatccaggcagaaacattttgagagctttctggagtttttatttgctaattaaaatgtgagaagggaacacagccacaggtagaggtctagtgcaagccacagctgtgattcagaagaagaaaaaaaaaagccaaacctgacagtttcaaaatgaagttattagcacttcacctataactgtgatagcttttaacttgcaggatccttctcttaggcaccacctcccatccgaaccccagagcatatgggaaaaggagctaatgtgtgtaagttgcaggatacttaatcactgaagaatctaacaatgataactactatctctctggaacttttttttaacttagaagagtatgtcttgttctgtttatatatcacatagttttccaacgaccctgggaggtgaggtaggtggtatattttaccaatgggaaaatcgatgctcaggaagtcttggtgacttgctcaagttcccataacaagaagctgctgaatccaggatggaacctggtctaccccaaatgcccctactgcttcctagggcccagtaatgcccctgggtagggcgggcccagctctggaagaaacagggctatacaaaaaatcacccaatattgggtcaccagccttcttctacttgcaaaataattaagcaaaatctgtttttatttgtttttgagacggagtcttgctttgtcgcccaggttagagtgcagtggtgtgaacttggttcactgcaacctccgcccctagggttctagcgattctcctgcctcagcctcccgagtaactgggattacagacttgcaccaccacgcccggctatttttttgtatttttaatagagacagggttttgccatgttggccaggctggtctcgaactcctgacctcaggtgatccacctgcctcggcctcccaaagtgcgggggttacaggtgtgagccactgtgcctggccacaaaatctattttaattctgcaagttataagcagccagtggcccaccaggcccagctgtacgttcccagggaccccccaaagcgtatatgtcccgggcacacacacactaggtggtttgttttgttccccagcagcccgtgtctgcccgggcagatgttagtggctgagaaaccccaacagggagtgagccacaggcccgcgggtggcttccctgccagtgttctcctcgcgaaggggaagggagcccttgccagaatggctggtgccctaacaaattgattcctgccaaacaatagaaataaatattttcagcagacagaaatgttggctctgaaagcattcaaattaaaggcttatttctgaaacaaatactttaggaggaaaacatttttaccagcgcagatgagatcagagctattccttttggcagtggcaggactattttgagactcagccacaacggtttccctgccccgtctcgtttttcactgatgacctcgccccctgtttcatggagacagggaattgcattcagctagaggcatggggaagagatggtggcatggtgttctgcagagagcctcagttggacagtcggccgaatctggattcaaatccaggccctacctctcctgctatgatttcgacaaagccggtcagtcatctgatcatcagcttcctcagtctgtgaaatggggcggtacctcccttgcaatggttaatagcgttatcctcaggacctgggggtcattggaggccagcactgtccctagaactctctgtgttgattaaatggtctctacccgccccagcaaatataattgccactagctacatgtaactgttgggcccttgaagtatggcagctggaatggagggaacaaattttaaatttaacttagatgaaatgtaatccacatgtggccactggctaccattttggatagtgcagttcccattcatccctctcatttcattagttggtccctggagccaattaattggttggagggtcaacccactacaaatctcccaagtctttctctgtgccggatgcagctgtgcggagttgggacctgtctgttgtctttgacatccgtcttctgtcctgcagacggagcagtggggcagtgccatcgagctgggcagaggaattaatatcttagccatcaactgcccaaatcaaccttcatgggcatcttttaattttctaagagatggggtcttgctgtgttgtccaggcaggactcgtgggctctttccgcctcagcctcccgagtagctgggactacagttgtgcaccaccacacccctctgatatttcttaattttaatggctgatgtttcttaattttaacaagttcccatatgtctcatgatgtatgctaagtataaaaagaataatagaaggcatgaagtcaaggggcctgtttcccgggcatttgtttcagtggtgagtcacattcatgcgaagcctcggtttccttatctgtaagaccagatcagcaaaccacctgtggctgcctctctccctggttgaccccgaggccaagaggaggggcagggtcagcagccggccagacctcagtagcccctccccatcctggtatgggggaacacaggaggtagaaaacaagtgacctacacaaggcgggtggtggcgggggaggtcccactttaacaggaggcaagatggccgggagaaagctatggggaacccaggcaaatggagatgagcagaccccaagaaccgtaccctagggggctggctgggtcgggggaattagggtcctttgggctccttgcagagccgaagattgtagtggggagcactgcgtgtgcctacaaggctgagcctggcaggcagaattatgtgttgttttgagataacagccacaacagagcagtaaagaatactgcttataaaacggacatttttttgtagctcaaaaatggtcaaatatcagtaatgtcatgtggtttgagtaatccataaagcagagcccttctcgttagggctgagaattatcctcccctctccctgccacagagccggccacgtggcctgccccggcacctgctccgccttacatgtcattatgcgtctccgagacagcgtctctcacatctcaccgtttaaatgagcgtctagcaagtattctatggagtgcaatgcttgttggatacatctggcattttcatcttcgcagagtgggtttgtgacggggtgaaaaacaaaaaaacaaattcttgattcttgatggaaatctctcagtcctgagagatttataaaaaaggcttgtaggaaaactttgtacgcgtagcttttatactcatagaccaaattataattttttattcaatcttattttctgaataggtaacgtgttcacttggtctaaaatcaaaattttagccaggtccggtcactcgcacctgtaatggcagtactttgggaggctgaggtggggggcggtcacttgagctcaggagtaacatggcaaaaccgtgtctttacaaaacacacacacacacacacacacacacacacacattagctggacatggtggcacgcgcccgtaatcccagctactcagatggctgaggcgggaggattgcttgagcccaggagttcgaggctgcagtaaactgtgattgcatcactgcactccagcctgggtaacacagtgagaccctgtctccaaaaaaataaaatttgtatgtttatatactgagaaattttgtctccgcctctgtccctttttacccctactgtctaccctaagtcagtactgtacttctgttcattttctgggggtgtgctgaacagattcaagagaatagcatttccatggaaaggccgcagcttgtaagtttcacttgaatttccgtgattgggagttaatatcaaatgatctctcagaatcaagaaatactgatacatatcaaatgtataataacattttgagaattttttttttttttttttcagacagagtctcactctgttgcccaggctggagtgtagtggtgtgatcttggctcactgcaacctctgcctcccgggttcaagcgattctcctgcctcagcctcccaagtagctgagattgcaggcgcccaccaccacacccagctaatttttgtatttttagtagagatggggtttcaccatgttggccaggctggtctcaaagtcctgacctcaggtgatccccctgccttgccctcccaaagtgctgggattacaggcgtgagccactgcgcctggccccattttgagaattaaaggaacatgggcacgtaatctttatacgaggtggagtcagattgaatagcaagaggaagagaaactgacatccacgctcattgcactgggcgttttatgtgacttaatcctcatagcagctctatgaagtatgtatcagagggtgtccccattttacattaaatcacttgcctggatcactcagctggggagggtgagagccaggtgacctacccaaggctgtgtctctgggtggggggctcagaacctctctccctcgttttgtagtagccagacattgtctcgtataaactatggcaactggaagtgaaccaggtcttttcctgccctctgattttggtggaaaatgtgacctacccaggaaaagcactatgattttaggagtttaggtgcacaaagctgttttccaagcatgctcattcttctcccaatttgggactcattgctgcctctctgccctcatctgtggggccaagggagctggagcgacagccacagcagaccgctctgcatccctgtatgcgttgtgggaaacagcagaggaggtggcgttgcgcccatcttacagactccagattctgttcacccgacaggcagtgggaatccgtgttcacgctggtcccttggatcagaaattcagtacccttccctccacaccatgctgtagacacctctttcctctcctagacccggaacatcctctcttcttcagggtactggggaccaagatccaccctcgtggtgagaaaaccacaccataaataaacacagccaccatacgccgtgagatctggccaagaggtttccttctgttcattcggccctaatctccaagatgggaaggcattgccagctgccctgtgtagagattcctgaacacgcagtgtttcttattaacccgccagataaccagaaaatcagtctttgggcaagcgcttgcttctccacgtgcccagtattttctttctttctttttatttttttaatgagacagggtcttgctctgtcgcccaggctgggctcgaacttctggcctgaagtgatcctcccacctcagcctcccaaatagctgggactacaggtgtgcgccaccatgcccagctaacttttttttttttttctggagagacagggtgttactatgtggcccaagctggtctcaaagtactgggctcaagtgatccccccacctcggccttccaaagtgttgggattacaggtgtgagccactgtggccagctattctttaatttactagcgctgactacatgcctgtgatgtccccaggaccctgcaaagttctgggaaattcatagtgagcaaaacacagtccttgctggagttcacagcccatggggagacggcaccaaccctgtgcccagactaggggagctgccacgcagccactcactgagctgggcacacaggttcccatctcttatgaggtgaggcaggaggagcagggagggagctggggaagtggcatcagaacattttttggaagagagaaaggaaaggtttccaagcagaaggaacagcctgtggcgaggtccgaggggaaaggaggggaccctgttctctggggacactaggggaacgtcagcatgccaggtcagggttctggggagccctgggtggtcttatcgatggcccccaggaagccacagaaggcatttgagcagggaacgccaagctcacggcgggctttggcagggcgcgccccgtgtcctggaggactgtgtcctggtcatctttctaggcccccactgcatgcccttgaggactaggaagggtgcctccttctctgcatcaggctgactcctagcagctgccgtatctccagctttcctgctttcaactatgctttttgtctccttttcctcattgcgagcctaggcctgtatggggtggtggagtgggtgggagctcactgcttaggtgggtgggcagtgtgggtggtggtggttccatgggtctctccctcccactgtcccatctttgccactcatctgctgccccccactcccggaccccttttggaggtcagtctcactctgtggaaaccctggcttcctggttcgagatgccccctctggcccacgtgtctgacatcacgtaccagaacactgtggccatcattcaggattttttatgacacagtagtgaatcaaagcctgtcagtgggaaagtgatggggaaggattaagtgtctgagaacatttgggaaatatgaggttagacctggttctcaaacttatgaaataagtgaaaacatgaacgttcactttgggaattctgcaagattctcctttaaatggagtccatgaagagaacaaaatgaattttctgcagcgttacgcaggagcacttttctggaaatgaggtttcctaggactttgtcagcccttcaaagcctaggtctccttactagaggggaagaaatgagattttatttatttttatttttattttttattttttgagaccagagtctcactctgtttcccaggctggagtgcaatggcacaatctcggctcattgcaacctccgcccccagggttcaagcgattctcatgtctcagcctcccgaatagctgggattacaggtgtacgtcaccacacccggctaatttttgtatttttagtagagacagggtttcaccatgttggcctggctggtttcgaacttctgacctcaggtgatccacctgctccagcctcccaaagttctgggattacaggtgtgagtcacccactggccacaaacttatgaaataagcaaaaacatgaactttaactttaggaatctacaaggttctcctttaaatggagcccacgaagagaacaaatgaactttctgcaaatgagatgtcctaagaccttgtcagcccttcaaagcctaggtctcattactggaggggaaaaaataagattttaaaatatcaatgtttagccagactcagtggcttacccctgtaaccccagcactttgaggaggctgaggtgggaggatcgcctgagcccaggaattcgagaccagccaggacaacatagcaagacttccatctattaaagaaaaaaaaaaccatcgtttacttttaggagtaggcattacatttacgtgcttaaaataccaaaggtacccaagtgtagatatgaaagactttcccacccccaagtgagtgcccagccccttaatttccctccctggtatggatactaccagtatcttatgtttgtagaaccttctacagaaccttgtgtaggtagaagcagattctatgcatctatgtgtatctgtgtatttgcagtgactagattgattgctgttgatggacatattctggggaggtgtttttacacttccattactgagcacaggctcacaggatggcactttcccgcatgcaccaccatgcctggctgatttttgtatttttagtagagacagggtttcgccatattggccaggctggtctggaactcctgacctcaggtgatttgctcgcctcggcctcccaaagtgctgggattacgggcgtgaaccactgcgcccagcctgttttttgtttgtttgtttgtttgtttgtttgtttgtttttgaatagagacagagtttcactgtgttggccaggctggttttgaactcctgacctcaggtgatccacccacctcagccttccaaagtgctgggattacaggtgtgagccaccatgcctggcctcaatttctcccttttctaagccccccacctctgtttttgtcccatggtctggtcctgtcggccttgttgcacctggcagtcagggttgacttatgatttacttgaaccatccctggagcccctggcctggtgggggatgctggtggcagaatgaattcgggtctgaggtcaagcatgtgtctgtgagagtacacaaaatgaactgtgatgtagcgtttactgtgccacaaacttgaaatgcatcatcttgattatgtccagagaaaggaagtcatttgaccacagccacacaggttacaatggggatgcggcctggagtccaggtgtgagctaccacacccagcccacatacactttaaagatgagcaaatccaggctgtaatcccagcacttagggaggctgaggtgggaggatcacttgaggccaggagtccagtcaggtttgggaggccgagacaagaggatcgcttgagcccaggagtccagtttaggtttggtaggctgaggcgggaggatcgcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggtgggaaaattgcttgaggccaggactccagtttagacaccactgtttgaagcgtcttgggatgttttcagtaggggacttggagaagtgatggaaagaggctggtgggtggggcttaggcccaccacccctttctagccagagaaccctccattcatcgaaatgattctgttgttggaaatgaaacaaaaaataaaatggtcttaggaccttcctgtgcaggaaccatggccgacctttccctttttgtacaagtgatctatttttttcactagcaaaaccatttaagatttctatataggatgtgctgtttgattagtttgacagataatcccccaagaaacatcagatgaactcactctttggattaaagtttgagataataaaacaagaatacttgtgttgctgatgtggccagcccaagtatgtttttcccaccagcccagaggttctgggggcaggaggcatcctttgcaggcctagaaggacccaccctgtgggagcctggccctgtgcatctgcagagagcacttgctggaaatctcagtgggaaatggtggggatgcctcccatacccccactttaaaacaaacaactgacaattacacttttttttttgagacagagtctcgctctgctgcccaggctgaagtgcggtggcaccatctcagctcactgcaacctccgcctcccgagttcaagcgattctcctgcctcagcctctcaagtagctgggattacagatgcacaccaccatgcccagctaattttttgtatttttagtagagatggggtttcaccatgatggccaagctggtttcgaactcctgacaattatactttttgagacagggtctccctctgtcacccaggctggagcacagtggcttgattatgactcactgcagccttgacctcctgggctcaaacgatcctcccgccttagccccccaagtagctggaaccacaggcacccaccaccgtgtccagctaatttttgtattttttgtagagatggggttttgccatgttggcaggctggtctcaaactcctgggctcaagcgatctgcctgcctagacctcccaaagtgctagaattacaggcatcatccactgttcccggcccacatacactttaaaggtgaacaaatccaagccaggcatggtggcttatgcctgtaattccgcactttggcaggccaaggcgggcagatcgcttgaggccaggagttcaagactagtctggccaacaaggcgaaaccccctctctactaaaaacataaaaattagctgggcatagtggctcatgcctgtaatcccagcttctcaggaggctgggtcttgaaccctggaggtgaaggttaaccagtgagccgagatcacaccagcgcaccccagcctgggcgaccgagcaagactgtctcaaaaaaaaaaaaaaaagatgggcaaatccaaatggatctctggtgttatttaaatacttatttgggaaaaaaattttcccactatttctgttaagcagacagctggttacatggtagttttttaattttgtttttaataacatctgaaatgcctggcagaaagtctggagttgggggcagagagaaacttaaaatgttaggagctttgccctttgaggagctgtcagaattggagaaaaaacatcccagaaattgtaatcagtgaggaaaacaggattccagctatccacagcaccccagctgtacaccagcgtcacgggatgagggatgcctgtgtgcacgtaggccttggtttctgagctgagacagcagcagccaggccgacttggtgataggcttggcctgcccctgcagtggactgcctgggcctgggcctgggccttggccttggtctcagccctgtggtggatgatctgagccttggctttggccctccagtggatggcctgagccttggccttggccttggtcctgccgtggatgacctgagccttggtcttggccttggtcctgcggtggacgacctgagccctggccttggccttggccctccagtggatgacctgaaccttggccttggccttggccttggccctgccgtggatgacctgagccttggtcttggccttggtcctgcagtagacaacctgagccttggcaattggccttggccctccagtggatgacctgagccgtggccttggccttggttctgctgtggacgacctgagccttggccttgaccttggccctccagtggatgacctgagccttggcgttgaccttggcccgccagtggatgacctgagccttggcgttgaccttggcccgccagtggatgacctgagccttggccttgacctctgaagctcttctgtgcaagggtggggctcctgttggtgacacccacttgctgagtctacacctgggaagctcttggtcagctcggcccattgacttgagagaggaatagttgccgtccagcgagtgctgggggtgtaaggtggaccgggccacacggctgccaaggggccggctgggtgggactgaaacctgacccatgtgggtcctcattgcctcctgacatcagtcatcctgtgatctcttagaaagataaaaacacattttctgcgttctggtgcctctccttgccagacattttctcagtaaagtttctgtctcagcctcgttggaagtgccaggttctgagcccatcagtttgctgctagcctgccagcttcccatgacctgggacctgggaccaggggcccgcaggtgtttctagctggagaggagttctagatagttctgagcggataccctcctctgtcttcctcgggagagttctggcttggtttggtggtgttttctgtgaccagcagtggccaccgccaccaccaacccctcttccccctcccctcttcctccccctcccccctccctcctcctcctctatctccatacgccctgagactggccagtgggcagcatattgtgcaagaaacagctgttgttttgacaaaggacataactcgcctcacttcttgcatcaccagacccacgaggctctggattccaggcctctgcccctgcaggtggacacacagaccgtaacgcagaggctcacgtgtcccacactatgcattaccatttgtgtacgcactcgttcacatttagcaggattgtaaaaattaatagttagtgcagttcttccagctagataatgcatccaaatggcaagacagtccaaagatacacactatggagtaagtccctctccccaccggcccctctggagagagccaggcacggtcacaagtttcttctgtatccctctggagataatcacagcctatgcgagcatatggatggatattcttttaaacattgtgttgcggtttgctttttggcttggatgtatctgatgattatcatatcccttacaatacaccgtgtttttttacattacaggaaaatctgtgaggggctaaaccgacagggtattgctgggcatggaggaggttgggtccaggttttttgctctttgtgactttttaatgcctttcagatgtgacgactctccatacgccttctcacacgtgacccgtgactcatgggccgaggcctctgcatttgggacccccacctccacctccccaagatgcatttcattcccttgttaatgtgtcattgtagttgacgctttgaggataggcaggcttggtagataataaaacagtatttggcttatgtttaatcgctgtctcctcccacagcccgagaacgccttagcgtccttcagaaaggatttggtggtactggtttttatgtgtgtgtgtgttgttttttaaaaaaattttctccaagggacctggtcaaagatttcaagccttaaatctgatcaacccaatctggggcggcggcagctcagtctctcctcctcgctgtgccaatctgtttctgtggtggcgggtggcggctcggtgttaaatttggagacccccgtgggtttcccatgccgacctgcatatgtctgcgggcacggggaagggagggccgcagacccccgttgagtccccgactgccagcagcaagttgccgcaggcgcactggctctgcagccccgggatcaaggtgggttcaccttgcaccgggccacctgtttcagtttcctcctccaccaggcaggctctctgacagatcagcccagggaggggcaggtggggaccgagggggacggagggggcccacagacccccggctcatctggcatcttccccagcgtttcccacacttgacccactagatgagaagttgggggtcggggctgggaccccaccttcatacctccagcgcctgccaactcaaagacatcggtagatgcccaccgattgggtaaccgcccccagcacccccaccctgctaggcttccatgcagtgggggaagtagggacccccggccaaaagcagtcatgttctttttgtttttctcctaagttttctgcgtctgtgtgcgattggaacgaaacatcaactctttttttttcttttttgtcatatttcaatattggctttcttccccgccttctttcgaaggctccttttataacttcggctgctgctgcttaaatatagatgtcaaagccctcctccctccagattgtttatatttttgaagagccttctgcttcgctgtgactgctcctctcttatctgtatcccccgttccaccacattggtttcggttgctcttttttttttttccctgccttcccttaactgggatgtgtttcaaatgtggtctatcaaaatgttcagtgtttcccttttttctgcaatagctttgacatctgttcttgaattctagcccacgttattccttaggacttgtttgcccaagatgtgcctgaatgccagaaatactaaggggagaagagtgtggtgtggtggtatcttcccctcattgcctggtttgttgttttattgtcgttgttgtttttttttctttcctcccctgctttttaaagtgtctacgattccttccttcttccttccttccttccttccctccctccctccctccctccctctttccctccctccctccctctttccctccctccctccgtccttccctccctccgtccttccctccttccttccttccttcccttcttccttccttccttcctttcttctttctttcttttttcccttgggacacctcactcatgcccaggctggagtgcagtggcgtgatctcggctcactgcaacctctgcctccccggttcaagcgattctcttgcctcagcctcctgagtagctgggattacaggagcccaccaccatgcctggctaatttttgtatttttagtacagacagggtttctccatgttggccaggctggtctcaaactcctgacctcgggtgatccacccacctcggcctcccaaagtgctgggattacaggcgtgagccacctcgcccggcctgtccatgatttgtaagttgacagcatgatttcatcccatccggcatggcccaccccgtagtagtaccaaggaagcatttcccagcaagaacttgtaacgtgtaggtttgctggttaacttccgccaaggaggaaagcctgtgggacttggtgagctgggtggtggggggtggagaaggagaggctctagtgtgcttcttggaggcgtggggataaatcttcagctttgatttttctcgccgttcagctctgcttggactcagggtgatggtcccaaccgtgagaagccagctagagcagccaccttggatcccagcagaacgggccgctgtgtgtctttagttgccaaagcgactcggcaggaaaacaggccttttggtggcgacagcagtgtgtccttgggcgcctgctgtcagcctggaacaccattctggggccatctgctgcaggcttgttggaaacagatcctcttggcagctcttcccagaatttctgaggccagggcacaggttctctggcgcgttgattatcggtttgttgcggggagcagagcccagagtcctcagccccctagcgggtccctcatggggaacccactcctggtggtcctcagcgttcccgcgcaagtaatgtgatttgagaataactgccaatggtgcctcatttctgaaaagtggttggaaataattattcttggaatttaccttttaaaggtccctcttgaaaactaatcataggttaatggtctcgaacatgatgcttggcctagagtgagctcaccataaacatttgttgaatgaatacaaaccaagtattactctcagagatcccaggcccacagcattgaaggacggccacacggaatgccccgaggaggggatagatcagcagaaggactagagctcaggagagtggctggctggaaggaacccttgggaagaagaggcgtggagcaacttggggaggcgggtgctttgggcattagcctgatagttgtggctggagcaagaaagatgtttctgtgtattctgttatgggaacagagtcatttatggcgtgcacattgaggcacgacccatgatgttgaacgagcttggttttctcaaccacttcacatgggacggacgtgggatggggggataatgttcatttctctgccttcccgccaccctccagcccctcctctgccaatgagttgatgttccttagagccactggggtctctcccccagtgttctggtcaaatgcaaataggaccctcctctagtacacagtgcaattacaatctcacttttcctttcctgtttccccaacagagagaactcgatgccaccgcaacggtattggcgaaccggcaggatgaaagtgagcagtccagaaagcggcttatcgaacagagccgggagttcaagaagaacactccagaggtgaggcgcgtgaccatcgtgttcgctttgaagggatcttagaatgctggtgcatgttcaggcgacgctccgtgagcgtttcattttcatcagatgaacgcacggccggcaaacaacccgtttctttccccagatgtcttcagccccatttccagcagaacgcatgccatcctgcaggctgtggggatgtggaaattgataggttgtctggaaatatgaaagtcagagccaattccaggtgcagatactggacaagcttggtctgtaagaacacgtgggcaggtgtgtgggtgtctcagaccctcgagctcatcccagaccctgtcccatgtcagttagcaagccaccaaagtccataagggatcctgtggggtggaaggtccgcggggcctgcttccctgttgctggtgcaggcggagtgtctgaaggctgcacgcatctgggcatagcagtgcgcctaacgcttcttgtaaaacagacatttcgcctgctaggccttttaaatgcctctctgtttcttgaaatatgccgtaaagggcaatggaaatgtgctttttatatactcctgttttttctctcgtgagtgtgcaatcgggggacagtgttgagttgctggggtggcgtttttctgctcgtttcctggccccttcttccttcccttcaaccctatcaggggcttactaagaaaaaaaaaaaaacatccaagcgtgttgcaggcagatgagcagtcgcgggaatggctttccgggtgacatctgccagtttggtccccatggcgctcatcccgcgggctcggaccccagcctctcttacatcttccccttgtatgggaaggggtcgcagcagcccacagcttcggcccggcttccgggcttggggaatcttctccgtatcgtagctcttggctcctccatataagacataggaacatgcctggaggcaaagctcctttctaggagagatgcccctctcttacttacataatattgctgggaaattatatgtgaattgcatttttaaaagcggactcatttaaaatgtttcaaaagaggcttgctagtcaagggactgctggcatgaatcattatggaaaacaaattaataaccttctgtcttcagaataaatattttaggagaaagcttggtagcagagtagaaagaaggcagcctttggccacagagccagctaagggttcaaatctcacacccgctgcttgcctcggctgcccctaaatgtgggtactccatgtttcacgagaccaaaaatgcaggtgggagtcactggtgcttgggggtttctgccttctctgccagtgttggggagtggggggccctattctccatgtcagccttgccatgagtaaaaacaggaggaaaaaaagagctggggacagaacgtccttcttctgttgcctccagcggcttcagagcagactttcctggaactccggtttcctgagcgcttgtccttgactcagtttccccagcccaagccccgccacatccatcgtgctagctcctcttagtgccgttcctgtagctagtggtcacccaccgttctgtattgtcactgccctttcctcggtgaccatatgtctgagggtttccatagaaaatcttagaggtttggctgggcgcagtggctcacgcctataatttcaacactttggaaggctgaggcaagcaatcacttgaggtcaggagttcaagaccagcctgggcaacataacaagactcatctctgttataaaaggtaaaaagaaaaaagaaaacgttttgtggttaaaaacaaacaaagaaacaaaaaaacccagaaaatcttagaggggcaaggccatccttcagaggccacggacaataaatacacgagtgtattcagccagagaatgaggttcctaagaggcctggcttcctgggtgttcctcagaagtccccaactcctagtgacagtggaggaggagcgtgtcccccttcggtcaccctgtccgttccttatgctctgctgataaatgccgcttgtactgcactgagccctatccctccatcgtgccttgtgtcgaattccacattagttactcaaagacacctggccttaaacttggcgtttttatctccttctgatcccaataaatggaagaggcttggggaggcggcagcctggtaggtacctgccacttggggcatttcttctcaggacacatttttagactctgtcttcatggagaaaggggctagaacccaccaggaaggggaggcagatgatggaaggtcaccacctgcttggccctgaccccgccactgccagtgggtggagggtggtgcccacttcctcatctttggctgtagtaacgagggtctcactgcagcatgcggtcctggggaggtggggagaggggagctggctgcaggctcctgccccgccagccctatgcactttctcatccaaggaccaacctggaaatctgtggggcgcccacgcggaaagtccaagacgagacccacttcacttgtgccagcagccagagcttcctgctggtaactttttttttattttttgagacagagtcttgccctcaggttggaggaccacccaatcgctcaggttggagtgcagtgtcacaatctcggctcactgcaacctccgcctcctgggttcaagtgattctcctgcttcagcctcccaagtagctgggattacaggcacatgccaccaccacacccagctaatttttgtatttttagtagatttcactatgttggccaggctggtctcgaactcctgacctcaggtgatccgcccacctcggcctcccaaagtgctgggattacaggcatgagccaccgcgcccagccctcctgctggaaatgttgaaaccacataagaccagaacagtggtgggagtcgggggctgtggccggagtgtgctgggtgtgcaggaggcggagttccctgctgttccctgtgacagcaggtgtgtgtgtgtggggggggagctgtgacagtacgtgtgtgtgtagatagcacatgtgtggagcctcagctcagtgcctggcctgtgtcccaaggggacactgggtcaccgtttgtttggggtctcagtcttgaggagccaccactgccctgacactggttgctcctctggccacaccgcaggattgattactaaccgtggaggtgacgtcgggttgttgcatgtgtagaaacgaggcttgcttagagctttcgcccgttgggtaggacagcctggcttaccgggaggagggtatcctcttccctatggatgcagcccacgatccccatggcaacataccttccagggcacagcgtggcagagccagggctggtggtgttcctgctggtgtgacaccaagggtgttgatcttgatggaaacgcccacgtctctctttgttctgggaaagaaggaaaggtttcctggtgtctgatgaatgtctaatgtgttccacagggaggattaggcacccgcgagggttcagtggggagtaaagtttgtctgccatcggagatttcaccttctagactggcccttcccagatgtcactgggaaaagctctagtccaggagggaaaaggtgggctgtgacggggaggtggccagggaggggtgctgtgtggtggctgggactctgacaggcgggagaagccacaggaacatcaggaggtgagcgccaggatggctggagccttgaagggtttttctggggacaggatcctgctctgtcacccaggctggagcgcagcggcacgatcacagctcactacagcctccaactcctgggctcaagtgatccctccgtctcagtgtcccgagtagctgggattacaggaacgtggcaccacagtgcctggctagtatattttattttattttatttttatgtgtttttttttttttcttcaagtgtcttgctctgttgcccaggctggagtgcagtagcacgatcttggctcactgcaacttccaccttctgtgttcaagcagttcttctgcctcagcctcccgagtagctgggattacaggcatgcgccaccacacccagctaatttttttgtatttttagtagaggtgaggtttcaccatgttgcccaggctggtcttgaactcctgaccttgtgatccacccgcctcagcctcccaaaatgctgggattacaggtgtaagccaccgcgcctggccgtagtttttaaattttctgtagaaacagagccttttgctgttgcccaggctagtctcaaactcctgcgctcaagcagggtcctcccactttggcctcccaaagtgctaggattacaggcacgagccactgcgcccagttgaaggttttctgtttagaattagttttttaaagtttcagttttatatcattagattaatatatttgccatcatatgatattgtgtctttttaatccagaaattgtagttaatttgcagaagattgcagttactctgcagataaaattgtatacgttttctttgaatctacaaaaagagtccctttgaaagaaaaacatttttaaatgttctaactgaacatccattccctattgaattaagaatcaatcgtggaacataataggcggtggagtgtttctagggtatattgctttctatatttttgttttttttggaatatagtggcacaatcatagcttactgtggcctcgatgtcctgagctcaggcgatcctctccttatagcctccagagtagctgggactataggtgcgtgccaccacaccctgctaattttatgttttgaagagaccgggtctcactttgttgcccaggctggtgtcagactcctgggctcaagctaaatcacccaccttggcttcccaaagtgtcgggattacaggtgtgagccactgcgcccagctctgatttttgtatttcttacttaaggcgacatacttagtagctgtgcgtcttggggcagatacctcccaaagccccagttctgtcatctataaataatgtaacaacagggccccgctcgcagggttgctgtgtgcacatatgtgtgtgtacgtacccatgtgcctgtacgagaagggctgcgcacaggcctgtccctagagtttagcttatgttcgttattagcattaacctgggaatactcaccgtgtaactcatgagatacagtggatttctgttcctcagagctagcttggggaatttctatgttttattttattttatttatttatttatttatttatttacttatttatgaggcggagtttcactcttgatacccaggctggactgcagtggcgccatctctgctcactgcaacctccacctcccaggttcaagtgattgtcttgccttagccttctgagtagctggaattacacgtacccgtcaccatgcccggctaattttttgtatttttagtagagacggagttccaccatgttggccaggctggtcttgaactcctgacttcaggtgatccacccgcctcggcctcccgaagtgccaagtggcatgagtcaccacacccggccttagctcgggcaactttaaaaaaaaaataacaacaaatataggtagtttcagcttaaagtgtttcaaaagttggtttgtggccagacacagtggcttacgcctgtaatcccagtgctttgggaggctgaggtgggaggatcgcttcagaccaggagtttgagaccatcctgggcaacatagtgagattccatctctacaaaaaaatcaaaagattagccaggatggtggtgtacacttgtagtcccagctacttgggaggccgaggtgggaggatggcttgagcccaggaggttgaggctgcagtgagccatgatcataccactgcactccagcctgggcaacaaagtgagatcctgtctcaaaaaaaaaaaattggtttgtaataacaattaatcatcttacaaatatttattgaacaccttccatgtgccagacagtttggccctgggaataaaaccctatctccattctttaaaaagtttcttatctttcttagtaagcaaatagaacccaatggcagagcgtgttaagtgctaggatagaatgactggaatcttctgactgtagactttccccacagaaacactcttatgtcagtggtgataaagttctctggataagccacatatggctcagtaaccctttttatagataaacagttctgctttttgagccttggttcttaacctttaaaatatccatgaaagttgaggacctacgcacctgggaaatgcacgtttgcagtttctggggggctcccagacactcatccatgcagccttagtttagaacaccagttctctgggcccatagtcccagtttcagctcaccattccaggagaaccagtgggtcacctctactctccttctcctccttgtgtcctggggtggaaggggatgaaggagggaggaggggggattctagagctttggggtgggtgacagatgagtaccaaggcctgaccgctgggcagggacagggtgtgcctggccttgggctgggtgctggggagtgggagatgggtgaaggagcaaggccacctgatgtgacaaggggctccacgggctggcagcaggggcagcacctctgcactgggctggccacagcatgtcaggagggagcagcagcagctatctggaagcctggtggtgttagaatcatgtatgtgagcagtggaggctgaaagcctagctctcgcaaaccccagaaagtgtctcttagcttttccgtttgccgtttgcttttccatggctttgatcgcggtcaaactccgatttcccgcgtgtgtgattccagagttcttctggaggcgaggttacgggaggtctgcagcatgtctgacctgcagccccggctcactggcctggctgtagggagttagtggatggagagtggctggacagtttggagaccaggtaacccagcgtggggtcctccctggagaaacccccagtgctcctgcgacatcggcctggcttcagggctctgctatttgaatgtgatgctcaactctccaataaatggtcgtctgtgttaggcttgcttccagaaagagctcagggatggttttgggttttgttctgcttcttttcaatatgggaggaaccttctctgatgggagaaaagagaggaggagaaccacattcctgagatgctgtgattttatcatgaaaccatccccagccctcatcctggtgacgtcagtcggcccagtcctactccagaacgcttcttgggtgtctgtctgcaggactttgctcagttaatttttgtctcctctaaaacagaccccgttgctctgggaggagagccgagctgcggctcaggggccgtcactggtcatttttgccctgatgtatttttgcctctacatttcttgatctctggaacgttaatcccaacgatgcctggtctgcggtgctcacagtctgtgtctgtgctttctacacctgtcctgctcagatgcacatgatgtcacacccaggtctccatcctggctcttgttggctgcggcggcagccctgactgtcggagacgcctggctcagcatgcccaccttgcaacagggagcaccctgtgctgctcacagaactgcccatccactttcttttcctttcctgggtgccaacatcttcctctgccccttctacgccggcctggcgcatttctctgatttctgtgttcccgggtagcagttgtaaaaattcaggcttgggagttgtcttgagataggacttggaaaggaatcttttaccatcgttgaaattggctagatttgtggattccttcccgaccctggcaggcacggtgaggggaggaggtccctcctttttattgatcaggatgcactgtgtgcggggtaagccaggaagccacgcacctgatgctatctctgccatggggaggaggacagaggatgggaagatgctgtgaacttttatgattcgtttttcactctcggtgagaaaaggagctagcaggatgggtgagggagtggagggtagtaatatatagttgtggcctgggcccaaacgcatttagtcactgcctcgacagcctttatatagacaccaccagagtgactcagcctggaaaaagagagtcacttaaaaataaagttgcgactccagtggacacgtggtgcacaggctgccctgagatagtcaccagggctccatggccctgcacaccccccaggaccctgggcgagtcaggtggtgaagtgagggtgatcgttgtaaccccatcttggcattgacgtgaggatttagcaaagtcacatatcatcccaattacttttttccttttttttttttttctttttggagacagggtcttgctctgtggcccaggctggagagcagtggcatgatctcagctcactgcagcctcaacctcccagcctcaaatgatcctcccacctcagcctcccgagtagctgggactacaggcgtgcaccaccacacctggttatttttttttattttttattttttgtagagatgggggtctcactttgttgcccgggctgatctcgaactcctgggctcaagcgatcctcccacctcagcctcccaaaatgttgggattaccggcgtgagccaccacacctggcctttgatgctttctaaacatgaaacagcatccaggcatcatcggctactccttgatatgtcagtgttacccactggactctcaactcttctctgttatcaacaaatcttgttttactcctcattagaccctaaaaccactgcacacagaaaagtgaaaagcccagcctcattttcctttcatcacgttgagcccattgagttggcttcattgaaggcccacagccctgatgtgacacaatggggcctttttttgagctagaattccactccgtcacccgggttggagtacagtggctcgatctcggctcactgaaacctctgcctcccaggctccagcaattctcctgcctcagcctcccaaatagctgggactacaggcatgtgccactgtgcccagataatttttttgtatttttcatagagatggggtttcaccatgttggccaggttggtctcaaactcctggcctcaaatgatccacctgcctcggcctcctaaagtgttgggattacaggcatgaggcacagtgcctggccaaaagtagatttctatagagatagaaacccccaggggtgaggggatagaggaatgaggaatgactgatagttggtatgaggtttctttttggaatataaaaatgtcctagaataagacagtggtgatacttgcacaactttgaatatgccaaatgccactgaactgtgtactttaaatgggtgagttgtatggtatataaattatacatcaataaagctgttatttaaaaaaaaaattcagccaggtgcagtagctcacgcttataatcccagcactttgggaggctgaggcagatggattgcttttgctcaggagttggagaccagcctgggcaatatagtgagacctcacccctacagaaaaatagaaatattagctgggagtggtggtgcgtacctatggtcccagctactcagaaggctgaggtaggagggtcgcttgagtctagcaggagattgaggcttcagtgagccatgattgcaccactgcactccaatgtgggtgacagagttataacccccgtctcaaaacaaacaaacaaacaaacaaacaaaaaacctaaactaaattaaaaaagaattcctctcttcatgggggtgtcagaaacccccgaagagatttcttattcagttgttctctcatcctctaaagaaactccccacagaaaagtatcttgtgaattttcatttttgcagggggcagtttggttttaaaaagtctactccaggatttggcaaaatgagaaaaccccagtaatcaacttgtgtgtttaatcattctagaatcacctactgttaagttataataagcctttaactagaaaaagtttaaaaattaaaagtgaacttttaactgttaccaattaaaccctttaagccagtttatcaacccaagacattattttctttcttttgggtctctaggggagaagaggtgccttgagtgggaccagtaatgaaggcaatttgaacctaattcgggccccagtcagggaaggtggctgcattatccccctacatcccagcaagactttgccgcatggtctggagggcaccagcaggggcctgtagggaagaggaggttgcctgggcccagggacattgaatgctagtcaagccctggtttcatttgctccaacagcattaatagtattgtgacctccatggcactgtgacagaaacttaaccccagtttcttcgtctgcaaaaaacataccctgcctacttcaaggggtcctggaggctgaatgtccagtctcaggccaggagtagaacgcataactagtaagtggtgacgtgcagtgaccttgagcaaggtcaaaaactgttctaagacttggtccccttatgtataagcaggaagaattggtgctatcccatttcacccaggaggtgaaatgaattcagatgcacagagcatatagtaggtgctcaacaaacaccctcctctcttctttccttccttgctttcttttacaagtagtcctgagcccttttctagggccaggggcagtcagatacagcagggatggagggagaagattccagatctcacagagatctggcagtggccaagtaaacaaatgatgcacaagataatttcaggtggcggtaagagctcagacagaacaagatggcagtgagtgatcaaggatgggcgaaggtactttggggagtcagagaacgtgttttgatcttaagaatgcaaaatgactttttgtatcacctgtcaacacaacacacacacacacacacacacacacacacggaggctttagtgcaaattttgaaataaccattgattaattttggcaagctgttagcagtggagtcccccacatttcttccatgtaaagccctgatcatcttggctgtaaccactcacttactttgaagcgtcagattcagtctctctgctttctaagaccagggatgctatttaatctgggcattagaaaattcagttggccaagtgcggtagctcatttctgtaatcccagcactttggaggctgaggtgggaggactgcttgagaccaggagtttgagaccagctggggcaacatagcgagaccccatctctacaaaaaaatgaagaaattagccgggcgtggtggtgcatacctgtaattcaggaggctgaggtaggaggatcccttgagcccaggagttcaagactgcagtgagctatgattgcgtcactgcaccccagcctgggcggcagagcaagaccctatcttcaaaaaaaacaaaaacacacacacaaaattagtcaatgaattgtggagtttcaaagagaccttattttgtttgtttgttttctgggccaaaggcccagaaattcttaggtaattcttcggtaattaattcttaggcaattcttaggtaattaacgaggagctaatctcccagttgctctgttccttgtcactggaagtggtcagagctgttgcggggcttggcccaggggcggcgggtggcatctgaagaccccgcaggccctgctttccttccgggagcatctcaggacggccgctttgtctgtctgcccccgccccttgctgaaacgtcaacaaggccggcatcccctttccttcctgagagccatgtgtcgcttccttcatgtgtccagccgtttttacagggctattttaagtataaaagacgcattatctgagagtttaataactgtcaaaagggaagcactgtcattagattcatgtgccctggaattttagtcaaaaacatgctgcgttctatcacgtctaagcctctattttcttatctcaaaaaataggaatgataacgacctcggagtcattatgggctggatgaactcttatagggattcagaacaacccaggcaccaagtagaaggtcaataaatggcttattgtgttcatgttaccaaaatctactcttttgagaaattgtgttcacaaatggccttttttttttcttttttctttttttttttttgagatggagtctccctctgtcacccaggctggagtgcagtggcgcgatcttggctcactgcaacctctgcctcccaggttcaagtgattctcctgcctcaacctcccaagtagctgggactacaggcacctgccaccacgcctggctaatttttgtatttttagatggggtttcactatgttggccaggttggtctcaaattcctgaccttgtgatctgcccgcctcggcctcccaaagtgctgggattctaggtgtgagccaccacacccggcctcacaaatggactttttttttttttgagacggagtctcgctctgtcacccaggctggagtgcaggggcgcgatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgagattacaggcgtgagccactgcacccggccacaaatggactttaaagttataaatgtgacggagggcagtggctcacacctagaatcccagcactttgggaggctgaggctggcggatcacttgagctcaggagtttgaggcaggagaatcgcttgaacccaggagatgggggttgcagtaagccaagatcgtgccactgcactccagcctaggctacagagtgagactccgtctcaaaataaataaaaataaaataaagctataaacgaacacttaaaaaaattattaaagcctagggtagaccctagtttctactgcggacttgaacagatacagtaaaattaaaacttgccttcttccatatgtgtctagagagtaattttctctccttttgcattagtttcactgttcatagagtggaaatgtttgctgctggactttcttttttgaagctattctttgagagtagcccataacttgtctttctggtcaataacctcaactgaaatgcattctgaatggagaacgtcattctgtgtaggatttaataataacttcagcacagaaaagcactctctgcctcttctcagcaaacaactttgttgagcatgattttaaaggtgtaacggctaaatgtgaaagccatatgatttggttgaaatcgtggtgagctgttattaatatttattgagtacttgctaggagtcaggcattatgctaagtgcatgaccatcatttctctgcccctggaagtcaccctgggagctaagtatcatcggtgccacttaatgaagcgtaagccacccacccacctaccaggattttcccgggcagacagactcctgggaatgaggccatataatcccctgaacaccctgcctccttagggttccagaagccaattttttttctttttttgagacagatttttgttcttgtcacccaggctggagtacagtggcctgatctcggctcactgcaacttctacctcccgggttcaagcgattctcctacctcagcctcccaagtagctgggattacaggcaccaaccaccatgcccggctaatttttgtgtttttagtacagatggggtttcaccatgttggctaggctggtcttgatctcttcacctcaggtgactcacctgccttggcctcccaaagtgctgggattacaggcatgcgtcaccacgcctggcccagaagccaaatttttagtcacttaaccattagcaattcctcttctattagattttttttaaaattgcttttgagtatttctttgaagtggcatactcatttaaaggattctatatgtcagggggaatgttttctaggagggtacttaggaaggaacatatcgttatagcctaaaatttgccattggcctgtgaaagccttcttaacttacggaattgattataagccaaagcgtgggaaaatctccccttccactttgagattatgtcagtcaagaaaatgacaattggataccaagccatgctaactctgatacttgctgtcttcgttttcttctttctttggctagggggatggagcgcgtgtggtgtgggtgggactagtcactgagcatgttattgactaacattggcttttcattttaacttgcaaatgtgagtggcataaaagtgagtttacgaggagcatgactggcctgttatgcagagtcttgtaattttgtttgtggccctttattttaagaagatgttgtgttatatagttggtgtccttaaaggagtatataattggatctggaagcttagattgtgattctgacttggccacttaatgaatgcaagatctgagcaagccatgacctctctgttgttcagtctaagaaaggaggtgttggtgctgagcatggtggctcatgcctgtaatcccagcactttgggaggctgaggcggacgggtcacttgaggctgggagttcgagaccagcctggccaacatggcgaaaccccgtctctactaaaaatacaaaaattagccgggtgtggtggagtgcacctgtaatctcagctattcaggaggctgagacggagaatcacttgaacctgggaggcggagattgcagtgagccgagatcacgccactgcactccagcctggatttcagagcgagactccgaggttctgtgtggctgagagccacacattttgcaacaagagactcgtcccttttccataggtgtccttattcctattgatcttacctgtgggcccaagacttaggcacatccctttcttcttaaaaggcatcacctcctctgcctcttggagttttcctacccagaattcattcatgtgtgcagcaaatattcctggcagtcccattgtgtgtggaatggggtaaaccaggaagactgttgtgagggctcagtaacttcagggacacagccgtcgtagcttataatggcagctgatatttagtgagcacttactgcatatccagtactattctaaacactggaaaggcatttaactaacttaacactcacaggatccctacgaaacaggtacagtgtttatttctgtttcaaagagagggaaactgaggcccagagaggaggagtaacttgcctaggcccacaggtggcaaagctgcctgaaggttttttttgagacagagtctcactctgtcgcccaggctggagtgcaatggcacaatctcagctcactgcaacctctgccttccgggctcaagcgatcctcacttcagcctcccaagtagctggggctacaggcatgcaccatggtgtctgactgatttttgtatttgttgtagggaggggttctcactatgttacgcacgctggtctcaaactcctgggctcagtccctcccaaagtgctgggattataggtgtgagctaccgtacccctcaggaattcttattttttagatggaaattttaaattggcttttattggaatctcattaaatttgtagatttggagaggctttagaaggcattttcaagttttgattgattgttttagatttcattcataggtgaatttcattctctatattttacttgagggatccacggaaactacctacatggacttcacttactctggttcattgtgtgggatacaaaatcgtcaaaattgaaggattgatcattgtgtctggagccaggcataaaaataaacctcactctgttatcataggtggctgtgattaagatcgagggaaatgtcggccctgggcctcctaacattgacagtttccttcagaagattaagtgcggcttcatttttggcccgggccatcagtagcttaaagccattactgtctattggctgtttggtttgtctgaaatatggggccggcgtcagcctatttccctggggtcaggtgtgttcacataatcaaagtgccaggaacccatatcgcatgcaagcgtgtgtgttcaaattagccttctccagggaggaattcacagcaccaggaatacgcgcagagatgttcttttgcacttttgcattttaaaacgtgcatcgcttacgagcgcagcattttcaagccttttcttgagatcagctcgttcagttacatgtgcttttgaagatgaccatttgtgaaaccatcagccactggcaaagtgaagaaaaatgaagatttcggcctggttgatgtgtgctcggggaaaggtgatagcttctgtttccttgaattaaaagctgcagacaagtatattttcatttattttgtttataaatcaacaacccacgaaaggtatttcatacgtatttaaatgattgctttgccgccatcaagaaaaaatactgtttcacttaacagtgaattgagacaaggaaaagtgatgtgtgaatagaaataaagaaattaaagtaaaaaacaggatcagggtaggttctagggctaataatttaagaacagaacatgtggtttaactctttttgccactctaaggagaggtgatatttgtatttttctttttactgaaaccagatcgtgagacacgcttttcattcatacttgaaacttgataaaatgtttggctttatattaattttctcaattataagtgtgggaaatgaattcgttgataacccttttcaagtaaatgaactgattagaaccagaagagccgagagtcatttttattttaaaattctttttgcatgaacacatgtagtgttgaggaatatgtggaaaattgaaatattgcttctctcctaccgtgtctccagtgcctcgataaatcaccttttttttttccttttaaaatgtctggccttataatttatgtttgcataacccattactaaattcatagtaggtgttttagttggcaggcattattccagggatttggaggagtttaaaaaaaatacagagcctttgttagtatttatactaagtggacattttccttttttaacaacaacaacaaaaaagaattagatttttaaaaaagaattcagagctagctatttacctttttcctagacaaacactattaagtccatattctcacattattcattgtcttaatggagattaagatttcttaatggactttattatagcttttctttctttttttcaaaattagaactggccgaagaaaatgcttctactattaagatcagatgaatttctacagaattttcagtaggtgtcatgttgtataggaaataaacatttctgttttagtaggttttcgatttcttacctcccgttgaccgttttgatcataaagtgaagatgaatacattcattcatttactgcagtctttggtacttgaacagaaatagcagtgttcttggtttgttcgcatacttgtggcttacctttgagactttctaatttttaaccagacatttaaaaatagccattctgtcttttagccctaatttagaaaaacttgtagcgctttcctttgaaatgatgaaaaaaaaagttctttctgttttctatcatcaaagtttaaaaagcgatgtttggatattttaaaagccggaaagaccatgtatggcgtgctgaggaagtttgctttgtttgatcattttctcttcccctcacccccatcagctggctaataatgttttccatgttaaatgtgtatcacagcctgttgaaatccctgtggttaatcagaagagaagttgtttctatcctatggaaccttaatacagttgtcaggaggtttgtgaacagaaattcagaattcatcacactgtaacgatgatctaaaggtcaagttgtacagtataaatttgaaaatctctctctgacttcctttctacctaaattagagcctaaaagtcatgagaattttgtcttctttttgtttattttagagatagcatagtcgatgttttaaaaagttgccaccttttcactataatgcgctcccattatcagagatgtttattctggttgtatctctctgacaaccttcaatacttaacagaataatttagtttggattcaaagaagtgcctcttctatttctgtgtttgtttctagaaactttgaggtggaggaattattgttccttcttcttggcaatgttcagggtttcacgaatctgacttttaaaagcccagctctcagccccgagcctctcatgagttaaagaaagggttttgcagcttttggtagacgagaaacacattttatggctcttcatgaagttgcccgctccgtccacgtcctgtcctcttcctccttcccagtttctgggctccctggctcttgtcatgaggctttcagttttgtgtcccagaaagcgcttcccccggggacagtgccatgccaaggctgggagaagggaaaaaggaggtgtttatcgccttgaagatgccttccagcctttattattaactcccttccaaagtaaactttcgggtttttttcaagtctgttctggccaaagtacagttgggtttgccgtgttctctaggagtagaggtgaaaacagcattgcccggggtgaggagcaggaggaggaagggtccacgtataggagtggatggaggggatctgtgagacagctgctgggacagatccgacttggagactgtcaggcctctgagcccaagctaagccatcatatcccctgtgacctgcacgtacacatccagatggccggttcctgcctttactgatgacattccaccacaaaagaagtgaaaatggcctgttcctgccttaactgatgacattatcttgtgaaattccttctcctggctcatcctggctcaaaagctcccctactgagcaccttgtgacccccactctgcccgccagagaacaaaccccttttgactgtaattttcctttacctacccaaatcctataaaacggccccacccctttctcccttcgctgactctcttttcagactcagcccacctgcacccaggtgaaataaacagctttattgctcacacaaagcctgtttggtggtcttttcacacggacgtgagtgaaagagactgccattcatgaatggacaaggcctggctccgtccacgctttcccagctctgtgtcctgccatcggacatgctggcacatctgctgtgggtgccctgcacttctccgggcactcctggcccagctggggaggttggcatggtatccaccattttgttctaaagtagtaaatgaaactcttgggagggcagcacccagcagatgtttggagctagagacagggctctggggatgtgtaggaacccggacctggtgtggcaatggtgtggggctgtcacgaggcgtgaggaggctggggtggtgttggggacagcacacgatgctggggctcaggccaagtgaagcttggacttcactctgtctgaggctttgccaagtgtcagagggtgcacacttgggagtcacatggccaggctcacatttccagccgaagttacactctacagcctggcagcagatggacgtttggggacagaggtggagccggaacagctgagacactgttttagaggactctgcgagaaacacgctcttaaaacaaggaagcggtggttatgtcttattcaacaacgatctgttgtggaccagctgtgtgccaggcagttgcaggccctgaggctgcagcagtgagcagaaggccaaggtccctgccctcgcggtgcttacattctagtggagacagatgttaaactacagggcaggaaaacactgtcaaggagatgcaggtggaggattctgactgtggaactggggcatagagacagtgggttttgaaagcacttggctgagaaggatgggaggagggaggagggaggagggcgggtacatctgtagatggaccaggttaaggtatggacttccccatcctgacaagggggagccccaagcttgttttcaggtgtgacgggggtggggagaaagagagcattccaagagaggcacgaacgtcatttccagagcgagatgaaggtcacagagtttgggaggagatgggatccggcactcgggctggcgagcagacaggagggaactcagggagatgggaaccccggggaggaagttagggcaggatcccctgggagttttcccggatacataggagaaaaggttatccttcaagggtgagcgggggctaagtgcaggggacagaagagaggaaagcccggcgaccatcatgcccggctgccgtgggtggtctggattggaggcggcagccgggctgtgtttgtgcggagggtggcagggggccagcggaggaaactgcccaggcgccagccctgccatccccaccggcctcctcgctttggggttttgctttctgccctggccacgtgggaccggctaggtggagatcatgcaatcagggttcccagctctcagaaccataatggttaagcaagcagcttcgtttccaggcacgcaggagctcccccgtgtcagcgttttcctaacatggctaatcataaaaacctcctgggtgtgtgtgtatgcttgttaaaaatactgtccctgggccccaccctagacttagtgagacacagtcaccggggaagggcctggggacttgcatttagaaccagctcctggaatgcttactctgaggccagtttgggccccctcccatggcctccctctgtgtcccttcctccagatgctgattgaggatgtgtcccctgccgggactgtgtttgcatgtctctgtctctgtcacaaagtagatgcctggggagtgtgtgctgcgtggccccctgaagaccctgtaccgggatgtcagcaccccagcccccagctcctccccctgtgaaagacattagctcctggaggggctcaggtggtggaaatgaatcttagcatcaatgtttagacctaaaagccatctccaggtcatcatagcacatgacagagatagaggcagaacctggtggccataggattatttctgagcaaagatcgcccaagctttggcataggccagggttattcacatgtccgagtccctggaagtggggtgtgaggaggttgtggggggccttcagaatgagggaaaagggataaatcaaaatcaagtctttttttttttttttaattgagacagagtctcgctctgtctcccaggctgcagtgcagtagcacgatcttggcccattgcaacccctgcctcccaggttcaagcaattctcctgccttagcctcccgagtagctgggactacaggtacgtgccaccatgcccagctaatttttttgtatttttagtagagacggggtttcatcatgttggccagggtggtctcgaactcctgagctcaagtgatccacccgccttggcctcccaaagtgctgggattacaggcgagagccaccgcgcccagcctaatgatataaatattagtagatttctgcttactcacttcaccaccagcattttctagcaaatgtgagttcagcagacaccaaagatttttataaatcaaagtagacagtctttaacgttgagaagattctgttaactcatctgttctacccacactcttgcccttccctcctcacagaaaagccaggagaagggtgaataattgaattacagatgacagtaaatatttggatctagctgcttatgaggccttaatgatatcagtcagtacaaaaggttgatatccatgttttttggtgtgtgtatttttttttttttttgagacagtctcactctgtcactcaggctggaatgcagtgacgtgatcacagctcactgcagcctcaacctcccaggttcaagcgatccttccatctcagtctgctgggtagctgggaccacaggcgtgtgccaccacacccagctaattttttgcagagacagggtctcgctatgttgcccaggttggtctctcaaactctggggctcaaatgatcttcctgtgtcagcctcccaaagtgctgtagttacaggcatgagccactgtgcctggccgatatccaccatgtttggagcctgtttttggttacatttcatcctcatctactggcctggagatattggtgtcaatcagttcttcactgggggaagagatttttttaaaaagtcagatttacactcagtaagattcacccttttcaggtgtccactttgatgaattttgacaaccacatatagtcatgtgccaccaccactattaagatagaggacaggctgggtgcagtggctcacacctgtaatcccagcactttgggaggccgaggttggcagatcacccgaggtcaggaattcgagaccagcctggccaacatggcaaaaccctgtctctactcaaaacacaaaaattagccgagcgtgatggctcatgccggtaatcccagcactttgggaggctgaggcgggcagatcacttgaggtcaggagtttgagaccaacctggccaacatggtgatacttcgcctctactaaaaacacaaaaattagctgggcatggtggtgtatgtctgtaatcccagctacttgggaggctgaggcaggagaatcgcttgaacctgggagatggaggttgcagtgagccaagatcgtgccactgcagtccagcctgggcaacaagaccaaaactctgtctcaaaaaaaaaaaaaatacatatatatatatatatatatatatatatatatatatatatatatatatatatatatgatggttccactgtcccccctattctcccaggcctctatgtagtcagtcccttcccccaccctcagcccatggtaaccacttatctgttttttgctggcatcattttgtattttctggagtgttacatagagggatcataccatatgcagtcttcgagtctggcttctttcacttagcgcagtggatttgcagttcaacagtgtggccgctgtcagtgccaagtagtattccattgtatggatgtaccacagcatggagggatttttaaggctggtcaggcagtgcttatgtcacaggtccaacatccagtcccctgggccatttaaagccaagcacagccccacacctaaccctcgtctgaacgatcttgtacagccactctgcagtttcacatcctgaatgtgagcagtctttttttaaagaaggaggttttgggccaggtgcagtggttcatgcctgtaatcccagtactttgggaggctgaggcgggtggatcgcttgagcccaggagtttgagactggcctgggcaacatagtgaaaccccacctctataaaaaaaatacgaaaattattggtggtggttgcctgtggtcccagctgcttgggaggctgaggcaggaggatcacttgagcctgggagtttgagaccagctggggcaacatagtgagacccctgtctataaaaaatacaaaaattggggctgagcgcggtagctcacactttgggaggccaaggtgggtggatcaggaggtcaggagttcaagaccagcctgaccgacatggtgaaaccccatctctactaaaaagacaaaaattagccaggcatggtagcgggaacctgtaatcccagctacttgagagcctgaggcagagaattgcttgaacccgggaggtggaggttgcagtgagccgagattgcaccgctgcactccagcctgggcaatagagcgagactccatctaaaaaaaaaaaaaaagccgggcatggtggtgtaagcctgtggtcccagctacttaggaggctgaggcaggaggattgcttgagcccgggaggttgagaatgaagtgagctctgattgcaccactgcactccagcctgggtgacggagggagaccctgtctcaggaaaaaaaaaaaaaagaggaggttttaatgttcgcaaagctggtcagtttccaatctggtgtcaccagtggaaaaaagatgtaagtgttgttggcaagagaagctcacccagagacacgctccatgaagtccctgacccccgctgggggtgcctgtgatggagggtaggctgtggtgcctgcgggcgcgcacaggtgagatggaaggaataaggggttattccttctgggtgcagctctgcctggaggccagagctgtcctcctcccttcgatctctgaattaaagacgctcttctagtattttcttatgttgatatatatgtgtatatatatatatgtgtgtgtgtgttttcttattgttctagttcttatattgtcatttaattcctttgtcctttagcttgcaagggaatgtgttttcttattagattgtaagctctggggaggtaagaccagcacttccaccctcccagatccttggttgggcacgttattgatcagtccacatctgttgcttggctgattgattaaatgctgtggtgcccgtgttcactgagggattccagacccctgtctagcccaaggatgcctcacagtgggaatgctggcacagctgtcttggcaatcagtagaccatcctgtcagttcttcaagcccagagagggtccgtgacttgctcagagtcacacagcaatccattagcgaggccagccccttccctgggctctgcatttctcttgtagtgaagagctcctcacagtttatttgcatactgtaaatttgcaaagtcagaaggaaaagggcagggagccgggcttccttgaggcaggtggctcttttaaagctggggcatgttgtcgccaatctgagcttgtttccatggacgcagccagccgggcagcctgttcccgtcaacctgagccctgatggagcctcggacctgacaggctgcctggggaactcactgggaggagggcgggttgggggagacccagaagccatgctggagtctctctctggcctactttttgccatagtttgaagggaaagttagtgaattgccaggatcaacctgcagtttccccaaaacttgcacaggagtggctttcatcgctgcatggggagacctcctttgcgggtctgcttagcggtagctggattgtctctgagggatacctggctttcctaactgttcctggagaatcttaaagacgaaaatggaagaaagggctcacatctttgttttgtgctgcaagcaaagtcttggaaaaatgaatgatgccaatggaatctatttcttgtaattaatttcctcaagctactggatctccttttcttgctgagattgtggtttggcagctgcagtttgatagccccattctgagactggatccctctcttccctcatctggtagttttcacgtcggggcattcctgaactccgtctgcctcgtttcaggctgggatcacagatcaggagcgaaggctttatgatattaactagtcaacagatacattctttgaagaatttctgtgtttttaattaccccacgaaagcctttggacgcacgggttatgaggggcattttgcattgctaaattccagccttgattgcaaacctgaaaagagcagaaactgctcagaacaagttgttaaaaccacagacacaagggaaaggtttctctctctccctccccctctctctgtccctgtttttaagtcctttcagctggaggtgaaactgcaacgttatcaaacatgccagtacacactgtttcccaggcctgtttttgcatgagttggggtagaaatgtacccagcttctgttccagtaggtggagaaagatgcttaaatcctagaagcactgttcacctacctttttagggtactgcaggtttagctcgagggttggagggcatccagaaaagcatgactaagagagaaaaagactactcccaaagctaacagggtggagtatcatagccaggacaggaaaattcccagcagggaaacggcctgtctgtaatgcagacacattgggtcataggtttgctttcacagaataagtgaaatggaacaaaagtcttttttgaattctcattccaagaggcccagtttctgcaggtgtgtcttttcgatcttaccttgtattcagtattatttcaagcaatctccattttaggcagtgtctactccagaccaaaaaacctggctaagaaagaaattttgttgattttgagacagggtctttctctgtcgcccaggctggagtgcagtggtgtggtctcagctcactgcagcttcaacctcctgggcttcagcgatcctcccacctcagcctccctagcagctgagaccacagatgcctgccaccacacccggtgaatctttaaattatttgtagagacagggtttccctgtgttgccccaggctggtctcaaaccactcctgggctcaagtgatccccctgcgtcgacctcccaaagtactgggatcacaggcgtgagccaccgcaggcctcccagactctgggtcagagggcagcttgagctcctccaccgactgctccaagcctttgccccagctcttggtgcctggggtggtgggagcagcatgggcttcgctgcacacggacctgggcccagatcttggttccatcggctgctgggagatcagttcccttctctgcacctccattcagcttggacgggaatctgtccttcctagaacagctgtgattaataactgagaccacacccatgttcgttgtggcttagcgccatgcacacaggtacctagtggatgttaactttcctctccatcctggtcagtgctttttttttttttttttttttttttactttttctttttctgtttttgagatggagtctcgctctgtcacccaggctggagtgctgtggtgcaatcttggctcactgcaacctccacctccctggtgcaagagattctcctgcttcagcctcctgagtagctgggattacaggtgcccgccaccatgcctggctaatttttgtatttttagtagagacgggttttcaccatgttggccaggttggtcttgaactcctgagctcaagtgatccacccgccgtggcctcccaaagttctgggattacaggtgtgagccactgcacccggcctctggtcagtgcttctgttgagttcaagaaaaatgaccaattcatctaaaaccccgagctggcagatgctctcccgcgcggcggcggctgacgtcagtgctactttcagcgtctttggtgcagtcttggtgttcgctctcaaatgggctcttttcagtatcacatatcatatgcaggatgcagaggggcccggcttacataccgagagtcagaggactcatgcggccacaagtaggttgggaacagtgtcccctaataggatgagttttgggctttaaaatttaaaaaaaaaaaaatgggggcattgatgagtctcgttggcaccttttggcttgtggaggctcgtgatctaatattggtctctgctgtatacccagcacactacctgccacttagccattccataaatatcgttaaataagtgaattaggccgagtgccatggctgacacttgtaatcccagcacttacagaggccgaggtgggaggatcgccttgagcccaggagtttgagaccagcctgggcaacatagcgagaccgcgtctctatttaaaaattaaaaaaaaaaaaaaaaaaagacaacttgagccgcacacaggttcttgccaaagcctctattagtgctgtgactcgggaaagaaaacttgtttttttcttcagttgactgggctcagccatcccaggtgtgagtgactcaggccttgagagcaggtaatggatccatagggagccctgtccccacccagggagactgtcccagcccctcccgatggctccttccagaaaggggcgcagtgggctgggttgcagggggtagttgtgtccaagagtcctgcaggatggagtgggaaggggcaggaggggtgtcctgcactgccagctgttcatctaccccagtgccatggaaacagagctcctgcttttccccaggaaggcgttgatacatttataggctagcattcaacatcagcgttgtgctctggcagtctcagcagtaagacataaacctaccaaggtctgggggaagcactgggtgttaccatcctggctcacgcgggagacgcatgctcctccgtgactgtttgtggccagtgagccaccagttgacaccagcaatccagccttctgcccctctcacttcacagatgagggaagtggggatctgcctaaggtcacactttggtgcatttctcaaatcaaacccaggagccggaatttttctactgagctcctgctaagacaccctgggtcgtttcctccgggcagtccatgtcatctgctgtggcgtgtatgttcatgggtgattctgtttctgtttttaaaccctgtgcctcttggttggtgcttttcctcctggaggatgctgcagacctgcagcggtcacctcgggccacccagggagcaggtgggcacacccaggttgcatctgtcgccacactggtgcaggccgtgttgcacatcactgctgccgggttgaccccacttggtatgaaatgagagggcctcttttctgaagcaaggtgttgcaatttagcctggggatgaagctgcttcttccaatacccagagttaacaccaaatgccacgagagtgagaaaataagacagcattgcactttcccagaaattgtcaccccagggtgccaccccacctcccaagcccactctgggactccttccacacacagtcacccactggttaccaagcctgcggggcaggtgctaggtgcgtgctgggagtcaggggtggatgaggtcttttgcagacagggcagagcgacctcagggcagagccatgagggcctgtgtgcagcggcttccacccaggcaggctccggctctgcaccttcagctacaggatacacttgctttcgacacctccactgtcatttagacacaaagcacaccaccaccgaaaccactccacagaatgtagagtttcttgccaggaaaataaaataaattaaaagtcactaatacttttatttaaattgcgagtacatttcctcgctgttgcattttgtaatttatacctgggagttaatttattgttatttacagttgcacaaggactcatggaaatgccttgtgtatcgagtgttctcattatgctgggcacggtcccaggtgccggggaggcaggtcatagtcctggcctcgtggagctgatgttctgaacgagagttgagtacccagtgggacatcctgagagcccaatgcaggtcctggtcagggctgtggggactgtggggaagacctggatggcaagaggagtagggacaagatctacaggattctgcatgcagggctgcaggccaagagggaggagttgggggttctagtccgctaggttcagggagccagacgtgtctgctgtcccaaacctcctgtgctcaggaacgtggttctgatgagcctgtatcaccttcccttccctccacctatgggtctgagtggcaggaagagttctagctgtgtcagccaaggccggggacaccagaggcacagggcttggtttaggagtcaagacaaggcatttgcttatttaaagaatgagttctatgcacttccaatgagtggttctgtggtcaggagggcggcacctggagagaggtcaaggtagaattgtggatttggaagggtggaggatggaaggccccagaggaaaccagcagtcagggactgaggaggtgatggcattctctagtgtgatgtgtggacagacagagtagaagaaccaaaaccagtcttggagcgacaggtgggtcagacggcagctttctctggacccgggtcaggaagagaagggtttccagcaggagggaagattgcgcttaggaagagaagggtttgctgggctcgatggctcacgcctgtaatcccagcactttggcaggccaaggcatgtggatcacctgaggtcaggagttcattttgagaccaacctggccaacgtggtgaaaccctgtctctactaaaaatacaaaaattagcccagcgtggtggtgtgcgtctgtaattccagctacttgggaggctgaggcaggagaatcacttgaacctgggaggtggaggttgcagtgagccaggatcgtgccactgcactcaagtctgtgtgacaagagcgagactccgtctcaaaaaaaaaaaaaaaaaaaaagagagaagggtttccagcaggagggtcagtggcggtgaagcttgcagctggcaaatgttgggttggatttggggtggggagtgaggccaggagctggtggaggggggcagaggaaggaaagatcactcactgctaagcctttcagatgagttccccgtggtcatcagaggtaggccttgctgtcttaattttacaaaagatgaaagccacaggaggcatagacttgctcagagaattcatactcagttcagcagactccagtattgatgctcaacccatgctgctgctggggagggctcaggggacaatgttaagtgagaccaaggaggtggcacccctgaaccagtctctccgtgagctcggcggtgagaaaacagtgcacagggagaggagccacagaaggcccgggatgtgtcacccagggtttcagctgggaggggacaaagccgatttgggtgggagagtggaagtaggtcccaagaacttttattttaaatgttttgatgacagatttaaaacttgagtaacttcattgtaaaatggccaggcgtggtggctcacacttgcaatcccagcactttaggaggctgaggcgggaggatcccttgagcccaggagttgggagaccggccttggcaacatagtgagtgagaccctgtcttgacaaaaaattaaagaattagccaagtgtggtgacatgtgcctgtagtctcagccacttgggaggctgaggcaggaggattgcttgcacccaggagctcgaggctgcagtgagccgtgatcatgccactgcactccagcctgagcaagagcgagactccgtctcaaaaaaacaaaaaccgaaaaaaccacctcactattctaggcccgagcccgagcttaaatatttaccccatatccaaccataagttaatcccgcacacaccttcatcagtttcttaaagaaactggtgccccagcacggggcatgccaacgtattagacaggcaacaacttagacatggggatgaaatgaattccatcttaaatctcaaagtgcacaatacagtctctaaaattaaagaaaagaaagatttatttccaaaaaagcccacagtgaaataattgtctcagtctgtggagagagctaatttggacagaatcacatattttgattcctgggatttttttaaaaggaatcttttaaagcagtaaatgaaatatttttggatgtagacaaaaatgacttacttagccattccactggcaatgtggaaaggatgaagaccaattttgagttagcaaggacaccttcagaaagttcagctcccaggaattgttgaccctagccatccatgtctgtatttcctgaggactattgcttacggaattaattgggactaatttctgttgcacctgatctccagccaaaacactcacattttgcctcatctgcagagacctgggctgagttttatctctgcgtcactgccgagttccctgcccccgctctgttaacagagctataattaactcacaggacgccaggcagccagattcggccaggcgccaagaaatcagccccaattactatattcacattgtcagtaatgcccacttcacagcttctgctaatttgaaatggcaagttccaactttccatagtaaaattaccatttttgtcctattctattacgtggtgatatttgtccattatttgggctccgtaaacttggcattatcacgacaattagttgttgagggttttctaaaatgatttgcaattacatctcttaagcggaaaactgtctgctctgatggagtgagaatccattccctctgtgccctagatccactttaggaattggcttttcataggggaacgtggtgcctcgggattttataataaagtcgagcctttaaaataagggctagccttggaacgttgcctgctttgtagatttccagtgttcaagttgtctgatttctttataaagatggagaagtgtctctgtccctctgggtctccgagttcccttgagtctgggcctctgtatctggatcccctcaagccctactttgttgtaagagccaaattagccaggggctactggttggtggctctgctgggggggcatcacagagtctctcttctctgacatttgctgaccttcaacccgccctggtacaggagcaccccattgaggtcctccgttttccagagtcctgtccctgaggaatcacctgcctgagtccctgagcttgggactggctggcctgattgggttgtacattttgttctcttttcagcagagaaatctcaggaggcaccatgccaggccactgtgcccctgcaagtgtgtctgagtatggcccaggaccctgcccatcactggtctgcaacaagataagcacagaagttcagagtaggtgtctagaaatgttcatagcaatttaacgtgacggtgacatccaagtggcattttaattttattttataaagatctgagtccacaatgggctggaaatgtaaaaatctgttgtgtgttcttctcccacagattgtttgacaaacattggtcattattattattattattattttgagacagagtctcactctgtcgcccaggctggagtgcagtagtgcgatctcagctcactgcaagctccacctcctgggttcacgccattctcctgcctcagcctcccgagtagctgggactacaggcgcccgccaccacgcctggctaattttttgtattttcagtagagacgggtttcaccgtgttagccaggatagtctcgatctcctgacctcgtgatccgcccgcctaggcctcccaaaatgccgggattacaggtataagccaccgcacccagccaaacattggtcattatttaatctcctcatctctgattggatttcactgtgatcatttactgtggctaaggcagagtgcttgctttttttttttttctttttcttcctttttttttctttgagacagagtctcactctgtcgcccaggctggaatgtagtggcacgatattggctcactgcaacctccacctcccgggttcaagtgattctcgtgcctcagcctctcaagtagctgggattataggtacacatcaccatgcccagctaatttttgtatttttagtagagatggagttttgccatgttgcccaggccagtctttgaactcctgacctcaggtaatccacccacctcagcctcccaaagtgctgggattacaggcatgagccaccacgcctagcgagtgcttgctttttctgctagacagtggtcctcaggcccaatccctgagagaggggcttctgagaggtgaaggaggcaggagttcttgcccctgactctcaggagctggtgtctcctgggcatcactcacggatgggctgattattgctcattaccccacaggatccgacagttccagtacaagctgcttctttgagacagagtctcaccctgtcgatcaggctggagtgcaatgctggcgcgatctcagctcactgtaacctccgcctcctgggtttaagcgttctcgtgcctcagcctcccgagtagctgggattacaggcacccgccaccacacccggctaatttttgtatttttagtagagacgaggtttcaccttgttggtcaggctggtcctgaactcctgatctcaggtgatccgcctgcctcagcctcccaaagtgttgggattacaggcgtgagccactgcgctcggcccagaagacttatattttatgatataagaaaattatatgaaattcccaaaaaaacccagaaaattatatgaaattcaaatttcattgcccatagtttgttgtttttttaaaaaaaaaattgtagtaaaatacacataacataaaatttaccattttagttattttgaaatctacagtttagtggaattaggtacattcagtgttgtgcaagccatcactgccatccatctccagaactttttcatcattccataactcacctccataaataaagttttattggcactcagccatactcatttgtttatctattgtctgtggctgcttttctgggctacagcagcagagttgagtagttgcaacagagaccatatggcctgcaaaacttaaaatatatttttttcttctttcttttctttttttatagagatgaggtctcactacgttggccaggctggtctcaaaaatcccagacctaagcagtcttcctgccttgcctcccaaagtgctgggattacaggcgtgagccatgtagaatatttactatctgaccctttccagtaaaacttggccaacccctgtcctggtgcacactctccttacttcttagttaccatagcaactgcctaactggtctcacttcctttggtttcattccctttctgtatatctgccccctggaggagtttttccaagatacaattctgattgattaacttcgctggttaaaatcttttagcaggctggtgcggtggctcaacttgtgatctcagaactttgggaggccaatgtgggcagatcacttgaggcctgaagttctagaccagcctgggcaacatagcaaaacaccatctctactaaaaatacaaaaaataagccgggtgtggtggcgcacgcctgtggtcccaaccacttgggaggctgaggtgggaggatttcttgagcctgggtggcagaggttgcagtgagccaagatcatgccaccgcactccagcctgggtgatagggtgagacactgtctcaaaaaaaaaaaaaattcctttagcagcatcctgtagactaatgccatgtctgggaacaccagtcccaggataactgcactagttattaaaggctctataaactcttgcagaaaagaaacctgctgaacatcgatcaacccagtacccttcaaaactcattgactgggcaagtctttttccttttttttttttctggagacagtctcgctctgttgcccaggctggagcgcagtggcatgatctcggctcactgcaagctccgcctccagggttcatgccattctcctgcctcagcctcctgagtagctgggactacaggcgtccgccaccacaccctggctaatttttttttatttttagtagagacagggtttcaccgtgttagccaggatggtctcaatctcctgaccttgtgatccgcccgcatcggcctcccgaagtgctgggattacaggtatgggccactgcatttttcttatcacccattctcattagcctacagcagggattggcaaactgtttactgtaaagaaccagatggtaaaatactgtaggtttcggcagggccatatggtctgttacaaagactcaactctgctgtaaagtagccatagataatacaaaaatggtgggcgtggctgtatgccgataaaactttatctaaaaagacaatcaggcccatttgaactcctgtcctgtagagcagtggctgtcaaggtgtggcccaggccagcagcatcacaggacctggggacttgttagaattgcagattctgaccaggcgtagtggctcacacctataatcccaatactttgagaggccaaggtggaaggattgtttgaggagttcaagaccagcctgggcaacatagcgagaccccgtctctacaaaaaaaaatacaaaaattagctaggcgtggtagcatatgcctgtattcccagctactcagtagacttgaggattgcttgagacctggaaggttggagctgcagtgagccgtgattgcgccactgcactccagcctgggtgacagagcgagaccctgtttcagtaataaataaattaaaagtacagattctcgggtctactccagacctgctgaatcagaaaatacgcgggcaggcccagccgcctgtgccttcaccagctctcctggttaaggcctgagaaccctgctacggaaccccgagtacctttcagaacatgttgacctcattcgcagggatcagtggccctttgtcatctggtctctggccagtgtccctccctcatctggtggacttggtactgatgccgaaccacctgtgggttccaaacgtgccattgtttctcccacccacgcatttgcacaaatgtggtcctgtgtggctcactcccttttctgccgccaccttctcccccactgcgccatgctggtctcagctcggggcttacctggtcccagaggtgtgttgggaggtccccaccccttgcctctgcccgttgccttttccacccctgcactgggtgtgcataggtgcgcagggcacgtgtgtgtcctctgcggtcactgacttgattgtctgcctttcccaggaggacatgggctctgtcgggacattttatccgtctgtttacaacatgaaatagacacctccgaaatgtgtgtgtgttccgtaaatgaaggagcagagggaccccttcggagcatctcagaggccaggaagcctggcttctggccgccctgcccgctcctcacgtgtgaggggaactggggaagtcgagtcagcccgctggggttcctgattctctgcggttctgggaagagcttgcagtggaaggcctcccagccatttcctcttctcccccaactgtgactcactgattgattaatgtttggaaattgtgactcatcttgttagagaaggaaaaggaaattttattctcttcattctccctccctttcaaataagtaataaataaaaagtggctgatcttccacttggtgcggtaagaagcatttaaatacattcccggccctcataattggtggcttcttggagaaaggtacttattagaagaaaaacacttccctatgtgttgttgttcggccttctcgttgatgaaattacacggtgagttggtgagcgaatttaccttgcccctttttaaaggtatttgtggcagctcttgttgtaggaatcaggggagaggagccacttctcttttagtaagaaatgcgaagagtggcctctccatcttcagagtttcaaaatgagttcactctggtggtgagtaatgatgtcttaagctggcttattaaaggcggaggaataagatgttcttgctttacctcacgtaccaaatatagataaggcgctggatcagcagagcctcaggcccgtgccaggacacagtcgggcctggcgatgtctgttttgtctcacgactggagggttgaaggggaagcacagcctttgcttttaagggttttcttctgggaaatccacaaaaaaaaaaaaagcatttgttcacttctcacgttgtgatgttgaaattatggcttggagttttacatttgccttttaattctctttatgggcagcatgtctgtatgtcttaggctcttggttctggaagaccaagtaaattcagtatcttttcaaattgtaaccctctggtctgggtaacacagcaagacccccatctctacaaaaaaaatttttttaagtcagccaggcatggtggtgcacacctgtagtcccagctactcaggaggctgagacgggaggatcacctgagacacgagtttatgtgtctgagacgcctgagacaggagtttatgaccatcctgggcaacataacaagagcccatctctatgacaaaatgtgaaaattagccaggtacagtggtgcacacgtgtagccccagctacttgggaggctgaggttgggggatagcccaggagttcaaggctgcagtgagctatgatggtgccactgcactccagcctgggtgacagagtgagaccctgtctcaacaaaataaaattgtaacccaaagtaagggctcaataaatgttagccactgtgattattctattattcccgtcctcgttgtaaatatttgtgtggcttggtgcctagcgtcttttgtagctgtatgtattgccaaggagaatcccaaggaaaaaaagtagaaatatggttaaagctggctgggcacagtggctcatgcctataatcccagcactttgggaggccgaggcaggcagatcacttgagtgcaggagtttgagaccagccagagcaacatagcaagaccccttctctacagtgtgctggcatttgcagtgcagccaccattgcccatggtagcgatgaggaagctgtggcttagaccaacttccagaatcactgctctggtcacacagctgctcgcaggtggcatcatgaacacacctagtctgactgttgcttaaccacgacaaactccatctccttccactttgcctggctgaggatcggatgcattacatagaaatatttgaatttggaagctgttgaaatacaggttcaggccaggcatggtggctcatgtgtgtaatcccagcactttgggaagccgaggcaggcgatcacctgaggccaggagttcgagaccagcctggccaacatggtgagaccctgtctctactaaaaatgcaaaaatcaactgggcctggtggtgcacacctgtaatcccagctactcgagaggcaggagaattgcttgaaccctggtggcggaggttgcagtgagctgagatcatgccactgcactccagcgtgggtgacagagacagattcagtctcaaaaaaaaaaaaaatgcaggttcaaggaagggagaggatgatttgtgttccgctctgcgcctcctccctggtccattcccttctccctgttggaccattgctgtgacacaggtgatctgagcatcaagaaaaaggcatttcttgcttctcagtgatattagcaagcacctgctgcttgtattcactgtgctgagttctacccatttattctctcattcagtctttacatctccctgatgaggaggcataataatatcatgcccattttatagacttgagggaactgagcccaagccattcagccagagagtaaccgagctggagttccaccaggtctgtctgctctgatagcaggcatgcctgacctccgcacctacccacttccccacttctgcagtctcatgtgtcccagggaacgcacagctggggcccctctcctaatttgcacccttcctgagccagttcagaagtcccagactgtgtctttctggctggctgtgtcactgggcccaaggatggtgctacggggctaaagatcttctacactgaccctctccactaacgggaaatcagaaaagggaacttgaagagaacattggcaccaatggttggacctagggatttgtagccacctttctaagggagatagaggacagggctaagagtcacaacttttgttctctacccttgagcaatcgaatacttgcaaagccctgtttctaaggttaaaaaaaaaaggctgggccctgtggctcacgcctgtaatcctagcactttgggaggccaaggtgggcggatcacgaggtcaggggatgagaccatcctggctaacacggtgaaaccccgtctctactaaaaatacaaaaaattagccgggtgaggtggcacatgcctgtagtcccagctactcgggaggctgaggcaggagaatggcgtgaacccgggaggtggagcttgcagtgagcccacgtctcaaaaaaaaaaaaaaaaaaaaaaaaaggaggcagctttgggggacaaaacattcagcgtggccggctctccgcatcttacagtggtagggatgaaatgcacgcgccctcatttgaaatgagaatcgcagtgcctcagttaaacagcggcctctccggatgccaagctgagatcatttccatttctgtgccgagatcggccttttgcagagatagatgggttatatttatcaccagctaacttattagcatgtgacaccagatacaccaaattgtaatctgactcataaaaggatatgtagttcatgacttgatggtgaagcaggtcagtttaaaaaaaaaaatcagatggattatggagtcaacgtttccttcagaaaacttcttcaggggtaaactggtataataggaatgtctgttcagactgttttgaaaacagttaccttgagaattttgtattcctttgacccagcaatcccacttttgaaaatctatcccaaggaaaaaaattagaaatacagttaaagccgcctgggcacagtggctcacgcctataatcccagcactttgggaggccgaagcgggcagtgcgggttgagtgcgggagtttgagaccagccagagcaacatagcgagaccctgtctctacacaaaatacaaattgtttgctgggcatggtggtgtgcaccagtagtcccagctatctgggaggccaaggcgggaggatcgcttgagccagggaggtcgaggttgtggtgggctgtgatcacaccactgcattccagcctaggtgacacagtgagaccctgtctcaaacagaaaaaaagaaatgtggccaaagctttatgaacaataatgttaattatagtgttattgatatactaaaaacaggtgggagggaacaaggctagtgtccaatatagaggaacggctaaatgatgctaaaaatcattcattcaaattattatgtaactgatattgtttcccaagaatatttactaacacagaaaagatcatgatatcacctaaagtaagaattaaagatgctgtatcaccctagtttaatgaaagaaaaatgttcaaaaatataaagacaagatgaatatatagacatacagcacaatagatgcaaatacctgcacatcacacaagggctggtgaacatgaggacactggattcttccaggcctttttctaagtcttagcagggattatttttggttggtgtgagattggcttttttctttgttatgcttttctgtgttttgcagattttctccatagagaatgttacttttttttaggcagggaacggtggctcacgcctgtaatcccagcactttgggaggctgaggcaggcagatcacctgaggtcaggagttcgagaccagcctggccaacttggtgaaacaccgtctctactaaaaatacaataaaaattatagccaggtgtggtggcaggcgcctgtagtcctagctagtagggaggctgaggcaggagaatcatttgaacctgggaggtggaggttgcagtgagctgagatcacgccactgcactccagcctgggcaacagagtgagattccatctcttaaaaaataaaataatttaaaaaaaacaagagaatgttactttttaatttgaaaacaataagaaaatgtccaagtctgcaaaatagagtctttttgaaagactcttcgtacttattaatttattcaccagacatctttaaacggaaacagtggttaagtgtgagagtttggaagtcccacagatcagaaccccagctgccgtttactcactgcagtccctgggcaagtaattcagtcatctgagtttccttgtccctacccgtgtaatgggggatctctggtacccatctcatggagctgctaaagtgattaaatgagacaaaagtatgcgagccctttgctggaacatgtttctggaatacttgctgttattagtggaaatattgccaccgtgccatgtgccagactccgtgtgaagtgtgcagagtgctaggtgggtaaaaatagcccccctccttctagaacctccaacccaaaggtgggaaggggcacacaggtaacagaaatgacagcgttgacatctggtgtgtgctgtgtaagtcatgtcatctgtgctgaaccctggggctcaggagagacgtagtggggctgtcgtgggaactgggccctacttgggagccaggatgtgggcccggcctgaagctgcagcagcagcagcagcagcaagatgtgagaatatttaggagatggaacttggttcagtgggaggagtaacccaaaaggactctagggtggtcctgagattttcttttctttttttttttttttttttgaggcggagtctcactctgttgctcagacttgagtgcagtgacacagtctcagctcactgcaccctccacctcccaggttcaagtgattcttcttcctcggcccctcaagtagctgagattacaggtgcgcaccaccatgcctggctaattttgtattttcagtagagacggggtttcaccatgttggccaggctggtctcaaactcctgggcttaagcagtctgcccacttcagcctcccaaagtgctgggattacaggcatgagccactggccagtcctgaagttttcacagaagcatgaaaacacagagagaattccttttctgtcataaggagatgatgcccttttttttttttttttttttttttttttaagagacagtattgccctgtcgcccaagctggactccagtggtacagtcgtggctcactgcagcctcgacctccctggcttaagcaatcctcccacctcagccctcctaagtagctaggactacaggctcatgccagccaccatgtctggctaatttttaaattttttatagagacacggtctggcagtgttgcctaagctggtctcaaattcctgggcttaagtgatccgcccacttcggcctcccaaaggattacaggtgtgagcaaccacgcccagcctggatgattggatggtgcctatagattcaggaaaaacagacttttcccccagaatgttttccttacctagctctatgtgtgtgcagtgtgtgtgtgtgtgtgtgtgtgtgtgtgtgtgtgtgcaagagagcgtggctaagacaagggtattcacctggcatcctcattcccaagttgccaatactcctctccccttttttcttaactcaccacctgggaagttttcctatttctctccctcctatcccagataagaagaattgccttctttcctcccagctgatttgcttttctcgtcattatatggcaaaccaggctgcactcccctcctaaggcaggcggtggttctctttgggctctgagtcctcagtgttctgcctcttcgggtgccaaccaggaaagccgccttccgcttttagagcaacgtgaagaaatcatggcagcccacgtaagatctctcattatttctgttgaaactgattctatcgagggtggagtgcattgcctttaatttctttgtttgcgtgtattttttttcccctctctctcacaagaagtatattcttttctttcctgtttgttcctgctcgatttggggaggctgctgtttccactgcctaattaatgggaaggtgttctgcggaggatttcaccgcgtacatattctctgtttggacatggtacaacctgtggacccttttaaacatagttacatgtttgactctttatagggtaataactcgattaattttgcaaggctttttagaataccattgttctcttgaaaagaacaggtttgctgttttaacaagactttaatgccatcgagatgcctcacattggcacggttgcgtaagaatcgcacggtcccatgaaatgaaattgagagagctttttccggcgcctggttggttggggcggcctccgttcggtgcttttttcatcctcgacccagtgaccaactgtgtttgccctgatgtttctttcaattccaccattccgaaatgtctccggaatctgtcgttttagcttttgcagcaaggttcgttgtgtttgtcttgcccgcttcaggtttctctaatgagattcacgtgtaaaggaggattggcaattaatcggatgactgattaattgtgagattcttattcttaccaaggaatgctatggaagtcctggcttcagataaaattctcaatgagggccagttgcagtggctcacgcctgtaagcccagcacttgaggaggccgaggtgggaggatcacttgagctcaggagtctgagaccagcctgggcaatatgacaagaccccatctctgcccaaaaagaaaaaattagctgggcatggtggcacacacttgtgatcccagatacagctacttcggaggctgaggtgggagaatctattgagcctgggaggttgaggctgcagtgagcagagatggcaccactgcactccagcctggacaacagagcaagaccccgtctcaaaaaagcaaattctcaaagaggccttaatataccttttttaatcataagctttaagagcctggtcatgcaaagataattcagtgagatgaaagattgtttatttcctactgtgcattggtcacaactttgattccacagaagggcagtgtgctgtcctaacagagctgagtgtgtggagtcttaagagcttcctccctctcagcaaatgtgtattaaatgtttctgctttgccagttccagtgccagtgccctgtgattagaaggtgagcttcaccgaggcctcctggtgttgtggagagggagccccgggaatggctggatgcagaaggtgaaggttgagatgcaggagagggagcagttagccttctggcttgggctgtggtgggtggtgccctccatgagattccaaaaaggactagtttggggaggaatgaaattggcatttggagagtgtaagatactagtggagtctccaagcagagctgcccaggagacaggctggccatgaggagagtagcattcacctggatatagatttgggagccactcaccgggagagagattccatctgtgtgtccctgggcagcgtgatcatgggaatactgcttaacctcaaatccttggctttctctgtaaagtaaatgtaataagatctccacagggtttgctgtgagggttgaacgagctcagtgcacatgaaaatgccctatacactcgaaaccagctataaatattggttattattgttaggatgctgacgttcaaatataaattgccaaaatcatttgggaagcattgcatactccattcccacatggagagttgcagggcatgtgattatctgtttgttcatttagtcacaatattgatcaatatagaacaaagcagtatattttaaaaatcaaccaggagcagccattctttgaagtgttatgcaaccattaaaaattaggtttggccaggcgcggtggctcaagcctgtaatcccagcactttgggaggccgagcaggcagatcacctgaggtcaggagttcgggactagcctggccaacatagtgaagccttgtctttactaaaaatataaaaatcaggcgtggtggcaggtgcctgtagtcccagctattccagaggctgaggcaggaagatggcttgaacccaggaggcggaggttgcatcgagccaagattgtgccactgcactccagtctgggcaacagagagagactccatctcaaaaaaaaaaaaaaaaaaattgcagagagtttgtagtacatgggtcaggcttaagcaaaaagaaagcaacttaggaagtatatatacagtattattacaactacaaaaggaacaggcagaaaaaaccctggaaggaaccatgccaaaatattaagtctcctttagggagcaggacttggagtcgtatttctttatgtttttctgtgctttaaacatactctgccatgacatattccttctgtgatcagaaaaatataaactaacagtaacagcagaacatcccttccccccaaatacaggtgggaattagatgtctgaagagctgaaaacacaaatgtatcgatttcatctttttaatatttccctgcaattcatcttgccttaatcaccgttttctctctgtccgtggaatcacagagctaactgcacagaaacggtgtgaatgaaaccaagttggccctacgtggaatctcaaatcgctctaccctttcgggatcttccgtttaagtttttggataatgaaaatttgatcttgatttcaactaaagctgttgtgtataaatctaacctttctatttagcgaaggtttttagcggtccatagaggccggagataacgaactgttacttgtcttctgtctttcccgtgtctgccatgggttctggtttgtaggcagatataaatgcagatacgtgtgcccctgtcgtgtctgaaaggatgatagaagcgagctgaagactccttcctgggagaaatggatttctcccttgcttttagaatcctcaactcctcccattcattctgagcaatagccatcataccatatttcatcaatctcagatttcttttttcttcctttttttgaaacagggtcttgctctgtcacccaggctggagttcagtggtgcaatcatagctcactgcagcctcaaactcctgggctcaagcaatcctcccacctcagcctcctgagtagctgggactgcaggtgtgcaccactgcaccaggccaatttttgtattttttgtagagacagggtcttgccatgttgcccaggctggactcaaactcctggcctcaagtgatcctcctcccaaagtgctgggattccaggcatgagccactgtgcccagcccaatctcagctttctggtttggccaagggatttactttcaagttgtaaagtaaacaacttgtgcttttctgcttttgccatctcctggttccccctgctgatgccacctctgatgccacttgtcacctttctctaaaccacccccttctctcacctggcaggaaaattccctgcctatccttcagtgaccccagcaccggtttcagtgccagaaaatgtgctgtcctccctgtatttggctcgcctgtcctccccctcactgatgttttctgctcattgggtgggggaggaatcacatgggttaggtgcccatccgtccactcctgtattccatgcgcgaccacggtggcccaaagttggattccagcatgtgatgttgaatgaggcaggcgtggctcccgtccccgggctgcacccagcagttcatcccggatccaggcctctgccttcctctactctcacctcttctcctctgcagagaagtgactgctgctggttagtagggtgggaagtggaggctggagggcatttgagagggcagagctgagttctggcctgatccagtcactcaacagcccatttcctcatctaaaaatagaataataatcaattacttagtacctgtcaacacaagcctatgtatatatatatatattttaagagaccaggtcttgctctgttgtccaggttggagtgcagtggcgtaatcatggctcactgcagcctcagctcttgggctcaagtgatcctcccacctcagcctcccgattatctgggactacaggtgtgtaccacgacatctggctaactttttaattttttatagagatgggatctcactatgttgcccaggctggttgcgaactccttacctcaagtgatcctcccacctcaccttcccaaagtgttgggattacaggcatgagccactgtgcctgggcaagccaatattttaacaggccctttacctatgtaatttcacttcaacttctcggcaaccctgtgaggtcgggagatcgggtgttcttgtcaaaggcacatcaagaaatgacaaggcggtaccgggcacagtggcttatgcctgtaatcccagtgctttgggaggccgaggcaggtggatcacctgaggttaggagttcgagaccagccttgccaacatggtgaaaccacgtctctactaaaaaatacaaaaattagcctggcgcagtggtgagcacctgtagtcccagcttctcaggaggctgaggcaggagaattgcttgaacctggggggcggaggttgcagtgagctgagatcatgacagtgcactccagcctgggcaacagagcgagactccatctcaaaaaaaaggtgaaagaaatgactgagcaggaatttgggcccaggtttcgtcaccaaattttgtatgttttagctatcattattgctgtccttgttattgatgttatcggccctgagggtataatgatgagcagaatatatcccgattctaagaagtcaagaggaaaggaagctagctttgctttatttcaagtttctcattcttttttgccgtcattcttttttgatcacaaaatgcccacctgtgctctagaaaccacgcctccattggacaggctttgggagtactggctccagtgatttgggtggttttgcactgatttctcatccagcaagcaaacctcaacaccttcagactgtccccagcaaccagaatattatcgtttcagagtttcgagggaccatagctgtcagcctgtctgtccaccctgcctggcgctggccttaattggaggatggttgcatttggaccagagcagaggcagatatctcattcctccaatgaaatacgagggcttgtgcaacaggcttcttatctcatctccacctgatcccaggagcctgattcctttccagggagcagcagatgagacttttctctttccaacaccagtgtgtgtgagcgagtgaatgagtagggtttaatggtgattaaaggcgtggtcttcattttgacaccttttgttctataacaagcctgacaaccatgaacctacttcttgccagacagaaaagtcattcccgtgccttgcccctgagcctcctcggaaatggcagagctgcacatgaggaattatgcttcctcgaacagcaacatatgagtcgtgcctcttccctaacaccgctttgcagtttgtgactataatctaatgaatccagctgacgttgatcaggtccttggtgtgggcgaggcactgtgcggcggggagggggcttccttcctttgttcctccctagtgcaaagcagtgggtatcacagacgaaactcacaagccacaaagaggttcccaggtcgagctggcctttgtgcccatgacgtctccctcccagacctgttctccttccaccatccttggttcccagtcagggcatggtggtgggggaagggcagggtcagcagggcatatggcctggccctgtcctgcagtggggttgactgcggtactgctccagaaaaatggactttgttgccagcgttaaaaaatgatgacttggccaggcgcggtggctcacgcctgtaatcccagcactttgggaggccgaggtgggcggatcacgaggtcaggagatcgagaccatcctggctaacacagtgaaaccctgtctctactaaaaatacaaaaaaaattagcggggcgtggtggcaggcgcctgtagtcccagctactcgggaggctgaggcaggagaatggcgtgaacccgggaggcagagcttgcagtgagccgagatcgcaccactgcagtccagcctgggcaacagtgtgtgactccatctcaaaaaaaaaaaaaaaaaaaaaaaaaagatgacttggagattgaaagaggttgaagagatagctaaaggcaatgtgtggacctcatttagattacagttggaaacaagccagcagaaaacgtgtttctgaaacaactggagaaattagaacagtgggtttctggatattttatgatattgaggcgttattgctattatttgtgaagtgataatagtgtttgttttgttttgttttgggacagggtctcactctgttgcccaggctggagtgcagtggcaccatcagggctcactgcagcctcaacctccccgggctcagctgatcctcttgccccaacctcccaagtagctgggactacaggtgcgcgtcaccatgcctggctaatttttgtattttttgtagaggtggtgtttcagcatgtcacccaggccccggattatagtgttttgactgtcttttttttttttttttaaaggatccttatcttttagagaattcacactgagatatttctggatcaaatgacttgatatctgagatttgcaacaattaatacagtaaatgaaacaagcctggccgagagttgatactcattgaaagcgcatgatgggcacatggggactggtgttactgtttgcttgatgtgggcttgtctttgagattttcgtagtaaggtggtattttgcacaaaaccccagctctgatttttctgggaaagtgggaaggcctggtgattgcaggctgctggagctttagatgggtgggaatgtcctaggtggcggatgtcccatggtcatgtggagggaaggatagaaagagcatggcagggggccaggtgccccgacaggtgagggccacctgcagggaacatcagaggtgtgtgcttcttgagggtcgttacccacggtctgtatctccctatattcaccaaaatacacgtgggacttcccttctgatcaggtgcacagcctaggggatcctctgggccgagcggacctgccagggaagctctcaagtggtctggatagaacaagcagggggcttctgcaacaagccggcctagctccaggacacccccatccaagagggatttgacagatccatcccagccccataacttggttcctttgcagagggatcatttggaatttttttattttattttattttattttattttggtgagatggagtctcactctgttgcccaggctggagtttagtggcgcaatctcggcttactgcaacctccacctcccgggtttgaatgattctcttgcctcagcctcctgagtagctgggattacaggtgccctccacttatgcccaggtaatttttgtatttttagtagagatggggtttcaccatgttggccaggctggtcttgaactcctgacctcaggctatccacccgcctcagcctcccaaagtgctgggattacaggcgtgagccaccgcgcccggccagaaatctttttccatttgccacacttgtgacttagccaagtgtctttttcaaagactaataaagccttcacagcttccgaaacaccgcgctagatctggtagccgcggacaatttggattccttctccagtgggaaagattcaaaactgcaggtttcagaagcctttaaaagcttcttgtctgtgtgatgttcattgaatgcaaattctttcgcaaataatggcctgcaactgctttaaagaaataaactcatcttgctgagcccgggcatgtatgcgtcaatggtgaaaaactgcaaacacacattctgttagcagaatcgtttaattaaaccacattcttgaaatggtctgcactataggaagggatgttgtgtgcaccacactttctaaaaagatatgtaaaaggtccccagaaacatataatcagaatttatcctagacaagtaatttcctctccccatgtctgtgtcctcatctgtaaaatgaggtagtggggccaggacgtctgtaaggtccttgtagtgatgctgttcacaggtgctgttacttgggggaatcataatgctctagggtttttggtttggggatttttctttgtttttttgagacagggtctccctgtgttgcccgggctggaatgcagtagtgtgatcgtagctgcctgcagcctcaacctcctgggttcaagcagctccccctgcctcagcctcccaagtagctgggactataggtacacaccaccacaactggatatttgttaaaatttttgtacagaggaggtctccctgcattgcccaggctggtctccaattccgaggctcaagtgatattcccaccttggcctcccaaaatgccaggattacaggcatgaaccactgcacctggtactagggttgtatcgtttgtcttttaaaaaatcttcacataaaagttaattgtggggtgggagggagttcctatatcaaaagtatgttgaaatacaagagtcaagaggttgagtctggggtccaggtgggtcccctggacaaccctctgcagacttgctgctgcttttgttaaagtgtctgggagtcccaagccacatggggtaggggcatcagaagagtctagaattattatttttgagacgtggtctcgccctgttgcccaggctggagtgcagtggcgcgatcttggctcaccgcagcctccgtctcccaggttcaagtgattctcctgccttagcctcctgagtagctggggttacaggcgcgtaccaccgtgcctggctaatttttgtatttttagtagagacagaattttcccacgttggccaggctggtctcaaactcctggcctcaagtgatccacctattttggcctcccaaagtgctgggattataggcatgagccaccatgcccggcctgaagagcctagaattcttcagccttctccaggatatccctgctgcctgggtgggagacaggggagagttggtagggagaggactgtgctgtggaggtatgactctgcaaggtgaccccggctcagcagctgatcagctctgtggccttgggcaggacacggggctccctgaactcctctctccacattggtaaagggtctggtcaggccagctgtgggctagtggtgagagtaacagagatactgatctgttactggaaacgccatgagctgattgctgtcattaacctccctgtactgagagttaaacaaacaggcacctaggatgggtgcagtggctcacacttgtaaccccagcactttgggaggccaaagcaggaggatcacttgaggccaggagtttgagaccagcctgggcaacatggtgaaacctcatctctacaaaaaaaaaaaatgcaaaaaattagctgagcgtggtggcgcacacctgtactttcagctacccaggaggctgaggtgggaggattgcttgagcctgggagttccaggatgcattgagccaagatcgtgccactgcactccatcctgggtgacagagcaagaccctgtctcaaaaaacaaacaaacaaaaaacagcaaaaaaaaaaaaaaaaaaaaaaaagcaggcacccagattttcctgtactgtaaagagaaaaaccttgaatttggattaggaaggtctgaccctgtcacaaacaaaagtgaccaaatcatacattttgaaattcacctcctttgacaaagccaggatcctcatgaaagagaagattctgatgtgaagtcagccctgcactttcagcctttccagcgtgcaggttgatagaatcccacactttttagcggtcgaagggaacttaagatgtagcagttatttcagagttgtgaagcagagaccaaaatagtttgaagctgaattttaagcctcttttggccagatcaaagaaacccaaactcctaaaaataccaaattagctttttaagcatagtttctatctttagttgaaaatgtgtgcagtgtatacttctggaacctgcttaaatgtatccattgaaatgaagatgtaccttgaaaaaagaggcgcctgatctgcagtaataattaagtaactttctctgcccttgactcttgccccaacgcgtatcaggattccacggtcccctttctccttcctttttcaattctgaaaccatccttgtcttcttgccggagttagcaccaaaaaaaaaaaaaaaaaaaaaaaaaagttactcttgtagtttacatgtcataaatgaaaatggatattccctcccagggcataatctgaaatatttgtatttgggtttcaaatgtgtgataagatgctctctgtggcagatcggcctttctaattgctgtgcttgttaaaattcaaattaggctttattctcttagcaaacgttgactgacagttgcagagagtggcccagaatggcactgagtgatgggtggccaggaagcctgcggtaggaaattcacaacagacctttcatagagaaacggctggccttgactttgagtccttccatcccaggtgctttagagacagagccgcctgacccttccttagcttggcccgggggtgcgttggagggggctgttcccacctgcagttcctaaaggacaaactgtctgatacaggcttcatgtggggctggccaaaccccaccgaggtttgcacacaccccaggattgcagaacctgagctcgaggagtgggacatgacctccccacgcctctgctgagtatcccagaccttcccatgtctttcttttctttctttcttttttgaaaaggagtcccattcagtcgcccaggctggagtgcagtggtacgatcttggctcactgcaaccttggcctcccaggttcaggcattgctcctgcctcagcccctcgagtagctgggattacaggcgcgtacgaccatacccggctgatttttgtctttttagtagagacagggttttaccatttggggcaggctggccttgaactcctgacctcagctgacccacctgcctcagcctcccaaagtgctaggattacaggcgtgagcccctgcacccggctgaaccttcccatttctaatcagaactgaccctgggatcaactgacctccttggagtgtagaggcatcctggttgtctggggactttgggtgggatctctgccagttttgcctgcagcagaaggaaagggaagtgacttatcttaggcacctgctttgaacaaggcactgagctgagcacgttcacatgtatctactaatttaatcctgacaacagtcctgaaaaagatactttccccattttccatctggggagactgaggctcagagaggtcactggcctgcccagtatggcgctgccagcaagggttgagctcatattgagtctgggtcggtgtgaccctacagccatgcccttgacactatgccattcctgccctcctggctggttgtgttctgctcacttccaagaatgatttccaatggcttgcaaagttacagttagcacagtatgacaagcaaggcatgagactgggagtgagtgggaacgaagaggaaagaaagtgagaggaggctgggcatggtggctcacacctgtaatcccagcactttgggagaccaaggcaggaggatcactggagcccaggagttcaaggtcagcctgggcaacatagggagacccaatctctattgtaaaaataaattgtaaataaagtgagaggaaaaggcagttagaaccagaattagacaactatccaaagttccccaggccctgtgtactttgtaaagatgagatacagacttgattgtgagcttcccagcaaccaatgcaaaaagggcaaccagataagtcatgtgacttacgctgtccacaagctcaaaacaaagcatgtgttgagggaaagcacagctcctctggtgttggcaaaaaaaattctccctaaagatcctcgtaaaaagaagtcacttggtttcattgccggttacaagttgctggcaaccaagtgccactggcaggtatcttacagcttaatagaagcagcattacattggtctaaaagaagacaagagaattacaggcccatttttaggagtggatacacctctttctataggtagaggaacttctgtctggatttgtgagttgggtgatttcagatactgatttatttttatttatttatttattttgagacagagtctcgctctttcgcccaggtgggactgcagtggcgctatcttggctcactgcaagctccgcctcccgggttcacgccattctcctgcctcagcctcccaagacgctgggactacaggcgcctgccaccacgcccagctaattttttgtatttttagtagagacggggtttcaccgtgttagccaggatggtctcgatctcctgacatcgtgatccgcctgcctccgcctcccaaagtgctgggattacaggcgtgagccaccgtgcccgggccagatcaactgatgttttgagttcagatacagagtaaatgtagcttgtaaagtactggtcattagaaccagagaatgaactctgtccctcttttaaatctggttggtttagtctttttagacacataccgttcggggacaaagagatcgatcagaattttcttgcctcctcggacggcatctgacctggctaggttgcggggatctgttggagagagaagcgtgtcatggatcccgcatcgaaaacagccttgaagagggccaggagcacggaggacctggggagggccctgaccactggacacatctgccctttgctcctcctttttgtctctgctggtggccctttctgctgtattcacgcgccctcaccacctcctgtgtattcgtgtgctggagttcagccgccaaggtggagagagactccctgtcggggaaggactccggccccaatgcctcctcctccaggccaggccgccatggtgggtgggaagagaggccactcctagagaaagagacactgtcagtaggtgtcaggaggtgtcccgggagctcgccgcgtggtaaccaacagacacagcccttcttggcattcaaagttgcaccctgatgcctgtgagggagtcgtgactttctgttaccactgacccagggcagagttttaaacagtgaccttaaggcgaaaagctccagatctcgttactgaccagtgcagccagccactgccttccttcctttttgattctaaaaatgacactcgggttttagagggttgcttttcaggcagccgaaatccccgcatgcaccttctcgtacatttcaggagagaagaatcaagtccatccacggtatccttgcccaggtaccggtatccatcagagcgtgattggggtttcagcagagccaggcctgcttttcctggcagaggctgggcccctttagatttttcttgtagattttgcttgagcctcccagcccttccttgctcagcacctgtgacccactgggtcacagtgacccacatcccatggctctgaccgcagctggactcatctcacactcacgttcatcacggctcccagaaggcacgtgtttttaatgagaggctcatttccaccactgccccccagccctccgcagcaagccagtgcaacgccaggacagtctgctgacaggggaattggagactggagggagcaagttttacctttttggtttgaccatttaaattgaagtcatgcatacagggaaagttatgcatatagaaaaatgtacacttcatactgcgtgcattcaattaatttgcgccaaatgaatgcacccgtgtcccctgcacccagatggaaaatgccaccagcacccttaatagcccccacctggacccctgaattggagtgaattttgaaagaagagggaaagaaagtgacatgtcccaattagaacatatgggacaggcactttctatactgtccaccttgccccagattctttttctttttctttttcttttttttttttttttgagacggagtctcacactgtcgcctgggctggagtgcagtgtcatgatctcagctcacggcaacctccacctcccaggttcaagagattctcctacctcagcctcccgagtagctgggattacaggtgtccgccaccatgcctggctaattttttgtatttttagtagagacggggtttcactatgttggccaggctggtctggaactcctgacctcgtgatccactcgcctcagcctcccaaagtgttaggattacaggcgtgaaccactgcgcccggcccagattcttttttttttttttgagatagaatctggctctgtcacccaggctggagtgcggtggcacaatctcactgcaacgtccacctccctgggctcaagtaatgctctcacctcagcctcccaagtatcaaattctcattttaaaaattaagaatcagacccaaaaagaacaaatgacttgaccatgactgaggccacagagccgaaaatgtccccatcctggagtcttactgtggcacactctcatcttaaccacacactctagttttatcctctctgtgtctttcatagattatcaggaagcgaaataacctgttaatattttcaaaagttcttatgaaatgtgaagtgctgtataatgattaagatagaaaggagaaactaggaaacgagagcttttaatcctagcttacaggaaattctaactagtaggaaatctaattcaggcagcgctgggaaacatcacaggctatgagatgaaagtcagctaaattgggatctaattctataatctaaatatagatgtagatatattacaggttggccttttcagctggagagagtatcattcactccaaaagtgccttttgtatcacagagaagagcgcagccaggggtgatatcagctgaggaagggggcgggcagcttggcgtgaggggctttcattcattccttagtcatctctattttcttaaattttatagtaggaattatttgtgcgttgtatgtataataaacacatggaaaagacaagagcgaggaaggcatctcaggagtgtttttgggaaggaggctgtcatggcatgtgggcagagggaggtctgggaatgggatttgctgggtcagaaagatgtccatgttctttgccaatttggcatcagaaatggcccacaccagccaggtgtggtggctcatacctctaatcccagcactttgggaggccgaggtgggtggatcaactgaggtcaggggttcgagaccagcctggccaacatggcaaaacctcatcgtccccactaaaaatacaaaacttagccgggcgtgatgggaggtgcctgtaatctcagctgctcaggaggctgaggcaggagaatcccttgaacccgagagatggaggttgcagtgagtcgcgattgtgccactgtactccagcctgggcaacagagcaagactctgtctcaaaaggaaaaaaaaagagagagagagagagaaaagaaaaggctcacgcctgtaatctcagcactttgggaggctaaggcaggaggagcttgagaccagcctgggcaacatagtgagacctccttatctctacaaaaaatgaatttttttttttttaatcagctaggcatggtggcatgtgcttgtagtcccagctactcaggaagctgaggtgggaggatcacttgagcccaggagttcgaggctgcagtgagctatgattgtgtcatgtactccaacctgggtgacagaacgagaccccgtctctaaaagaaaaaagaaaatgcctgtttcagttgtcactcctcaccagtgaggcatgggagtgttctcttcctccaaacctcactaaccctggataatggcattgtgataaattttccactggtcaaaaaatatatattgccttaaactcaaaactcgtccatcaacagtgaggttggctgtctttccgtgtgtttgttagccagtggtatctcctgtgtaaattaccttttgacatcctttgtttattttggttggtcttttacctcgtcgtcatcttactcacttttaaagagcatgaattaaggccgggcacagctgctcacgcctgtaaccccagcactttgggaggccaaggtgggtggatcacctgaggtcaggagttccagaccagcctggccaacatggtgaaaccccgtctctactaaaattagccaggcgttgtgatggatgcctgtaatcccagctacttgggaggctgaggcagggagaatcacttgaacctgggaggtgaagattgcagtgagccgagatcacaccactgcactccaacctgggcacagagagagaccccatctctaaaacaaacaaaaaaccacagtatgaattaattatttctctcttacatgttgtagaaatttttcccaaatctaccattcattttgtaaacataaactatatttctgtactctcttatagtaattgtagatttctagtgtttcacttggtttttgaatcgacaacagttttgtgtgtagggtattgtagtgtaagggatctgttttttcccccaggcagatagctcattttcccaatgcaatattcctttaaatattctgaataaaagaaaattttaaaaatcatttttgagcgatgggaaatgtgaaccaaaaatatgcataaggaatttttgattgaaaaacccagacgggggcaggagtttgaaatgaacttcccctaaaagccaaaacttgtagaggtggcagcctgagggctttccagagagctgtaattgactgtttctcccatcagccactctcctctttctcataacttttttgggcagccattaaagatctgatgacgagtgtgaatgtggcagcattttggcattttggatggtggcataattgcacatattgaaaaactctaaatttacatcggtggatccagtgcgtctcattatactggaggtgtgaaaactccatgtgcctctttgaacaattgtcctgctctgtcacagttcaggggaaacaaaagtagctccaacttcccgagatttaaatttgactttattccatttagttgatattgtaactagaatttgaatagtcttttccctttctgattttttttttttttttttttttttttttggagatgtagtttcgttcttgttacccaggctggagtgtcgtggcatgatttcagcttgctgcaatctccacctcccaggttcaagcagttctcctgcctcagcctcccaagtagctgggattacaggtgtgtaccaccacacccggctaatttttgtatatttagtagagatggggcttcaccatgttggccaggctggtcttgaactcctgacctcaggtgatcctcccgcctcggcctcccaaagtgctaggattacaggcgtgagccactgcacccagcacccttcctgatttccatttccgcttttatctctccactcccgaagatgtatcaacccacaaggaacttccttccagcccttacttaaaacattgctctttttccagctccagatattccctacattggctgccactcctccttgtctctgttcagtcttggaaaattggtttggtccaagctgaagctattctttgaagaaataccattatttttaaataaaaggattccccagcctggacagtgtagcaagaccccatctctaccaaaaaatcaaaactttagccaggcatgatggtgcacacctgtagtcccagctatttgggagggtgatgcaagagaatggtttgagcccaagagatcgaggctgcaggttagctatgatcgtgccactgtactccagcctgggcaacagagtgaaaccgtggctcaaaataaataaataacataaaaagattctcctttgagagaatcgcttgaacccaggaggcagaggctgcagtgagtcgagattgcaccactgcactctagcctgggtgacagagtgagactctgctcaaaaaataataataataaataaataaaaaagattcctccttccaggagccaagaactaggaatttcaagctgcaatcttgctttttaagcatggttatatatggggggtcagcagaatgtgtgaaaattattgaaaagtaaagcatgagatgtgactgagctcttgagagcagaccactttccccttcttaaaacgttttttttttccctgacccctgtctgagatacaggctctcctggttcggcccaccttgcccatcactctgctgggtccccactcgcgccctgcacctgaggttagagggcacataagtctcggggacctgccctttgatatctacaagaccctgtcctcaggggatcccatcgactctcgtggcttaaaataccatccacagaaggatggcgtctatatttatattaacccaaatattcaactgaatattcaacatctctacttggaaagacatctccggcttcacatggcttcaaaagagaactgttgacccctcccacacacaccgcctgcaccaccaatcccagtccccctgtcacctcgggaaatggcgtcaccacccaggggctgctcaggctaaaacctaggtgtgccctggggctccccctcctctcccccgacatgcctggtccaccagcaagcccgtccttcctcctggatacacctgggctcccagctacacgctgtcaccttggcccaagccactgtcatggccaccccaccaccacttccgttcttggctgccttctgtccattctctttccccagcggcctcagttttatttctaacgaatgcagttcagatctttccgtctccctgctagaccctctgatgtctttccatccaaccttccacattctgtgaccccacgtcgccctcactggctgggccacggcccctctagccccggtcttcacccttgaacctgcctagcctctgtcctcctcctctgcgccccgtggcttcttccactttcttccacctggctcacccggaattccagctacttgtgctcttcctgtcacacattgcctggtgtgtcatttccatctctgtctacctttccctcctagaatgccattcccatgagagcactttcaggccacttcacggcgtacgtccagccccaggcacagagcccggggtatcataggtgcacagtaaacatctgttgatgggctggctggattctatgtgggaagcataatgaccagtggtcacaaattactggggccagaggggcgctgcctggtgttaaccgcctggtgcctgccctacctttaaagccaagagtgtccatttaatgagcaagaagcagaaatcctgggcaagcagtgcagatgtaggctctcgggaacatgttgaccactcagaaaaccttccaggaggtgagtaccaggagatggaggtgctctagactgtgatgctgggaaaggattgtgggctagaaaaagggctccctagggccggcatatgggccactgggtggaagaggggctctgagaccctcaccctggagcaggtcatcacccacaccgaaggaatgaagcgtgaattcggtcacgcttaaaatgttgaattgttggcaaaagcccaagttaatgaaatagcatggaaaatggatgtgatgagatttttgaattgtaattagattaacattgtcactagttatcagtctgatatatcttataaatcaaacgttgggttgatttatcttttatcacttctagggacttactcctaacagtaactcacaaaccagccccaaatcagagctggtaggatgggctcccagctatctttaggaggtttgttggtttggggaagacagctcccccttggcagggctcaggtgttttctttcttttttcttttttttttgagacggagtcttgctctgtcatccaggctggagtgtagtagcacaatgtcggttcactgcaacctccacctcctgagttcaagcaattctcatgcctcagcctcccgagtagctggcactacaggtgcccaccaccatgcccagctaatttttgtatttttaatagagatagggttttaccatgttaacaggccaggctggtcacgaactcctgaccttaggtgatccacccgccttggcctcccaaagtgctgggattacaggcgtgagccaccgtgtccggctgggtgttttatttcttcgtctgttattcaggaactttgtttccagcgctgtgagtatgagtacaggcccagggctgggtgacagagtgcggagagcggggccctacccttgagctgtttctggaagggctcccagccagcaccgggcttagggagcagtgccctgcagtgtcattctgggccagggaggttgtgatgaatattattctcaacagagggtccccagggcagtgatgccactactcaggatcttacagaagaagaaccttcaggctgggtgtgggggctcacacctggaatcccagcactttgggaggccaaagtgggaggattgcttgagcccaggagttcgagaccagcctgggcaacatagcaagaccctgtttctccaaaaaaaatgtttaaaaagtagctgagcatggtggcatgcacctgtggtcccagctactggggaagctgaggtgggaggattgctccacccgagaggtcgaggctgcagtcagctgtgattgtgtcactgcagtccagcctgggcgacagagggagaccctgtttccaattaaaacaataaaaatcttcattttgaagaatctgaccagttctctacctggcacttgagtgaaaaatgacacaatccaaagtaggtggcagattggttctcactcaggcagaccctggagacacctctcccgcttctgactcaggggagagtgcggtgacataaaccaccttcttctgctctaggccagcttgtaactgttcagccagccagccgtctcctaactctgtgacccccggcccaagaacagggctcctgaaggccccgagaaccagcccgccgtccgcacggatgtacctggaagccacagtgccccacaccccgtgggactttctcccgaacacagcacctgcgcttcctgactcctctctctgaatctggcctttgagttcaatgtcctgggaacttaactctagggatgctctttccccctttagctaccgagtcacatgctgcgtctttggaaatttcaggcaatatttagtttggtgcaaaagtcattgtggtttttgcaattaattgcaaaaataataaatggaaaaatgaatttgtggacatcaggcttgcctagggagatgacctagggagaggcctcttttggcatagctcctgaacagggagaggtcctgacatgaataccccccgttttgtgaatcctgagccagtactgtgtccccggccccctcctcccccaacctatacacacgcctcactttcccttgcaggacgttttctaccacagttcctctctcctgacatagtatgtgtttgtttcttacttgtcttgccgcatgaggatgtaagttgcctgaattcaaaaacatgtcttcttttttgtgaatgaaagagtggctggcatgtagcaggtactgaaattatttgtagagtgaatgataaatctcagttcagggcactcagtgtggcctgggctacgtggaatagccaattggtggccacagagagtggccagccattcccaggctggcaatgtgagtcttagccactctcttttacagataatgtgcttattaaaatgatatcccaggcattccccagtggtgtttgaatcgtgaatgcaaatgtcagaggctctgaagtttaaagtctttttttttttttgagacggagtctcgctctgtcgcccaggctggagtacagcagtgcgatctcggctctgcaacctccgcctccctggttcaggcgattctcctgcctccgtctcctgagtagctgggattacaggcaagcaccaccacgcccagctaatgtttgtatttttagaagaaacggggtttcaccatgttggccaggctggttttgaactcttgacctcaagtgatctgccgccttggcctcccaaagtgctgggattacaggcgtgagccaccgcacctggccaggtttcaagtcttgactctaataaaaccagggaggtttcgctcagccacataagtgggagggaaaattaactgttgctttctgtattcaccaagatggcctaaaataagcaagcagaaaagggaagaaagaaaaccaaacccatgaggttgtccaagtcgatcttggcaggtattttcttgcctgttgattgctagagtttccctctacctgcattgcaggctgaaatgtatgactcagccctgaccaataacatagcagtaaaaagtagtttcccctgagagctttctcttcctccatagctgtgactgctgacatcttccactgtaagtgagaaaagttgagtgtgccctgctgcctcgtttttctcaccaaggtgttatgagctggtagggaaggccaggagctagggcagcagctttagaattagtgcaagagacaggaggacaagtcactgggtctcctgaatttcctcacctgcaaaacagggacagtttttaaatttcttttttttttctttttttcttttttgtttgagatggagtcttgctctgtcgcccaggctggagtactgtgttgtgatcttggcttactgcaacctctgcctcccaggcttaggtgattctcatgcctcagcctcctgagtagctgggattacagatgcgggccaccatgcccggctaatttttgtatttttagcagagatgaggtttcaccatgttggttaggctggtcttgaactcctggcctgaaacgatctgcctgcctcggcctctcaaagtgctgggattacaggtgtgagccaacagggacttttttttttttattatactttaagttctaggatacatgtgcacaacgtgcaggtttgttacatatgtatatatgtaccatgttggtgtgctgcacccattaactcgtcatttacattaggtatatctcctaatgctatccctcccccctccccccaccccatgacaagccccggtgtgtgatgttctccttccccaacagggacagttttaatcaatcccctttctgggtggtgtcaggacacccacagaggtgtgggtctaagcgctttgtgagtgtccacgtcctgtgcctaaggaaagcactagtcattcattcattcacccaacagttcctgacggcccacctcaacaggaaggaatattatacagccactaaaatgtaaaatcaccagtgctgttcagaaggacggagatgtttatgtcattggctgtgtgaccaaaagaaaaagttctgctggggatgtgggatgggcatatacgtgttttgaatataagatctttctttaatgctgttatatttggtctccataaaataattattctttgggtgacaacctcttagaaaaagaaagacaaaagcagctatttgcataaacctcagcccaggtgtggtctccagccccaggaaacttctctaacacccctcccatcctcccaccagtggttcctccctcggtggcatgaggtggttcagtttttttcctctgtgcccaccctggggtgccctgggcccatggccactgactgcagtgaacaattatgtgtgagtctgttagttcatttgcattgctataaagaaatacccgaggctgagtaatttatgaagaaaagaggtttacttggcccatggttctgcaggttgtacaagaagcatgacgccagcatctgctgctggtgaggcctcaggaagcttccagtcatgatggaaggcaaagaggacttgacatatcacatggggagagagagagtgagaagggggaggtcccagactcttttaaacaaccagatctcacaagaactcagagcaagaattcactcattaccaggaggtgggcaccaagccattcatgagcaatctgccctcatggcccaaacacctcccaccaggccccacctccaacactggggatcacatttcaacatgaaatttggaggggacactagccgggtgtggtggcatgtacctgtaatctcagttactcaggaggctgaggcaggaaaatcgcttgaacccgggaggcagaggttacagtgagctgagattgtgccactgcactacagcctgggtgacagagctgagactgcaccactgcactccagcctgggtgacagagcaagactctgtccccccccaaaaaaaaaaaaatatatatatatatatatatatatatatatatatatatatacacacacacatatatatatgtgtgtgtgtgtgtgtgtgtgtgtgttaggggacagatgtccaaagtgtgtcagtgtccatcatggctattagactgtcaggcattgaatatgggcccatgttttatttctctttatttcctcattgttgaacacatgggtgtgcctcctatggatgggaccagtggctgactcacctttccaaacttgcatcctgatgatctgtaaagtgtacccaccctgtaagattgtcgtgggacaatgtagataaaaacctcgatatacagcctagtacacaaaggacggtgtaaatattctcttccgtgcttcgtagatttcatttttgaacgctcagattgttctccggcaaaaaaaaaaaaaaaaaaaagtgcttgcagtgagaacctgccctgcactctcaggcgagctgttgggtgcaagtcctgcaggactgagctctgaaggccacccacaccctgggttgtgcttggatgatggcatccctcctggcacaagcgcagatgggcagtcgggagggaacatcagcctgggaaaactagatgtcagtgaaaaatgctggaggtggctggcgttcgcaaaactcagtcgtaaaaaacagcacgttctcagtacaaaatgagcactgttaaaaataaaccgcgcaagaagaaatatatgaatacgagggcatggcaaacagttttgcaaggtattaagatcgcattaatcttaattttattatatattaaagtttctaacttttcaaataatgcagttttcgttgttttaaaacgtctgagaattatagagctatttggtgtggctctcaggcaaggactcctgccatttattggggccctggttttatttaatagccagatgaatggaatagttaataaaagaaatattgctttattccctgacatttatgtccttggtttccaataaagaattgaaattatgaatagttgatggtttaaattgatgttttatgttgaacgctagctataatttgccctctgaggattgtaataccgagaaacagatggtttctcacagtaacaaattgctatgtgtatacacgctatagtcttggctttcagatactttcacctttggttctgagctgctctgcagacgggagaggggggtcgtgcggggagatcagcctctggaggaaggggtttcctgccctgtgggggagacacagacaggccctgggggttcagggaaactggggaaatgtagctagcctggcatggtgtcagtacctggggccaagaggagcgttctgtccacgatcatggtggcagctgcaaggtagtgcctgcaggactgctgtgcatgtggctgtttgacaccatgccgtgctgcaaactccacatcttcctagaacaaccaggagaatgccgtggagacttgttgccagatttttgcagttgccctgcagtggagaggttaagagcttggactccggagccaggtggctgggccactttgggggaagtttcccaaattcccacatctcagtttcctcatctgtaaaatgtgcataagagcaaaagccaccaccctgttttgaggattcagtaaaaccatccctctaacacaacactgagcccagtgccgggtatggtgtcagtgtctgccaggtaatggtgtaacgaaaattacaaagcagattgatgtggtgtgattcttgacgttacaaaagcttccttgtttttcagagggagttcccacaggggttctttagacaggcagtgcattaaggttgcagaaatttactttccagaaggttttaaaggaacgcagcttcaatggcagcaaggtacctgaaacaggaacccttccagagtgtctctgttttgttggcctttgagacctgccgcttctgactgcggggacctgggctgccccagatctgtctgtcagaagcctggagttgttaagctggtgaaatttaacaccactgtaaagagcccctcacagacaattcaggaacgcttacagatagaaaccggtcctggttttaaggtgtaattttgcacaagtgttaacaacaagagatggaattggtaacgaggcactggggtcggatcttcatatttttgtcacatttcatcggtgagatcagtaggtctgtctcccctaagaggagtgtggaatttagtgtttttccttttttgggctgtgacccaagagcttgttttcaagatatgtatttatttagaatacaaggctcttttccataaggaaagaaaatgttacagaaatgagctctcagttaattgaataagaaacctgttcgtctcatgactcacttaagagagagctggcagcccttcctgaatgcctattacaggcggcactgtgtccttttacttaatcttcccaaggaggatgagggttgcaggctccccaggcccatcgctgtgttggtgagtgacagagcctctgtaaaggaatggggatgagctctgagcccttttcccgtgggctctgctgcctggaggcatgccctccctcggcttgtcttccagctctcgcacagaaccaagtgttaactggtggtggtttggagacgagaggaaatggaccgtaaggaccattgagttggcataaggagaccagggcccaactccggaccctaccagagcagagtctttctcctctgtaatgtgagactgtagagctctagaatgttccttctccaactcagagctgatgctgtcagggccctgctgcagggtccttcagtggctccctgtggcctgaaggacaagccagctcctgccctggaagccgtggggatgtggtcctagcctgtgctcctgcctcgctcacctccctggaacaccagggccacctctctgggctcctcctgtgccccagtctgctcctgccacccctgtcccaccgtgcttcctccctccctgtgcctcagctcaggccttgccacctggagctctgacctcgtccgtcttggaatgaggcacctgcatgggtagcccatgggtagagttgcagtcatctgtttgctttcgattcactcccgcatcccgacacagtgcccagcacatcatcgatgaatgagtgtggggcaaatgcttgcacagaagtccgtgcgtgagccacgacggtaaacagaggcgctcctcttgtcctaatgtggaactccccaagctacgggaaaggggtgcatatggaccgctgctcactcacggctcagatacttccacggtaatgggttggcgacagtgactcagcttctcataggttcaagcggaagaaatggtgagtcctggagcactgcttgctttgaagtctgtttcagactagggtcatgtttcaaagtttttgaatttcttttttattcaaaagacatttgatgagttgactattgggggaaccttgaccccggtgactccgtgggacaggggatacccccggggtcccttataagcctgctgactcaccgcctgttctccatcttctgtcttccacattagaagcaagggcggggacattgcctttcccggccgctgcggtgtcctggcgcagggcacgtgcctgagggcccttggtcatccgagggaggactgcaccagggacatcagagtgctgatcttacaggaaacggcaaatgaatggaattggtctgactccatattactccttacttagatgtaaaacaaatacacatgatttttcatcctagaagaaagtctaaacgaactcttgacaaaaacagccaagttcagagaaagctgactctgttggtgtaagaagcgttttttcaggctgggctgctggctcatgcctgtaatctcagcactttgggaggccgaggcaggtggatcacttgaggtcaggagttcgagaccagcctggccaacatggggaaacctcgtctctactaaaaatagaaaaattagctgggcgtggtggcgcatgcctgtaatcccagctacttgggagactgaggcaggagaatcacttgaacccgggaggcagaggttgcagtgagctgagatcacgcactgcactccagcctgggcaacagagcgagaatctgtttcaaaaaaaaaaagaagaagaagctgttctccgtgagtcagccccggtgtctgataagtgtctgcagctgacagctcagagctggtgtcaacccactttggaggctggggtgggaggcaagaaacccagacagaacccctcctggctgcaaaacctccaggcttaactgtggcgcccactccatggtgggtcttaactctcctgaaaacacttcatgggctgtgggcctctcgggtgcttctgcgccagctcttcctcttcacctcctgccacagatctgtgtccccaggctctcctgtgtgtctccctgctcctcctttccctccaggtccgattccacagccctgggctgcctttccacctctgccttctctggggtatgtcctcgcctctcctgtcaccattgtcctcagggatcttccagctttccaggcatttggaaagaggcctccataccttgatgtggcctcccaggttccttgcgacagagtcctgcgtcgggataccaggggctgggcgcggtggttcatacctgttatctcagcactttgggaggccaagacaggaggattgcttgaggccaggagtttgagccagcctcggcagcataatgagattccatctctacaaaaaaataaaatttagccaagtgtggtggcatgcacctgtggtcccagctactcggaaggccaaggcaggaggattgcttcagtcctggaggttgaggctgcagtaagctataatcgtgccattccagcctgggaaacagggtgagatcctgtctcaaaaaaaaaataataataataataataatatttgtaggggaaggacactcagatttcctactggaagcaaggcttcctcattccatcagattctgctcctcctccaaggctcggctcaggggcctgcccctccatgaaccttcccagccctcagcccccttccttcctattcccccagcaccgacgtcacctcatcctgcccgactctgtagcatgcaggcctccgtcctccacccagctgcagaaccggagacctcaggtggtatctggttccacgtgtccccaatggcacctcgcctggaacgatgtctgcgccgaccagtgataacaatcgaaatagcaggcgtggctgaccgtgtgccgaggctcggcgtgccgcactggccagccgtgatttcatctcagcctctagcatcctgctggggtaggttaataatccctggatttctcagatgggaaatgttaggaaagtctgtaagcccccatggaaggtcccggagcccaaattcaaacccgagtggagcgttctgttgcttcactgtgctctggtgtgaattttaatgtaaggccctggcatttaagagctcgaagacaccatggaggtggagagctcagccctgtcattggatggaagctgagactggtgagattctcaccggggcttttgcagggagtttgggggaattttgaaggtggtacaggtgttctgaccccaacaccatctcctccagctgggccacacacttatttcctgctcctacccccgtccttcccaccccttggattctgggtgtacagaagagtgggcacatgctaaggtcagccctgggttagcctcatggacaaggtgggcctggagcaggaacccgcctgatagaagacactcaaagtctgtccgtacacgctcggtgtgggcatcgcttgcacgcaggtgcagcttttgctgtgggaaaccactttaaatgaattgatagcctcaccacagtggagccatggcccgactgtggagagactccattgtagagaaatatttgagtgaaaggtttcatgtcagaatagcatctgcatgcaaataagaggcatgggcgggtgcagtggctcacacctgtaattccagctacttgagaggcagaggcaagatgatctcttgaacccgggattttgagaccagcctggacaacatggtaagaccccatctcttaaggaaaaaaaaaaggtttaaattagctgggcgtggtagtccccgtagatgaagttatttgggaagctgaggcaaaaggattgcttgagccctggagttcaaggcagtagtgagctatgattgtgccactgcattccagactgggcaacagagccagaccccatctcttttgtttgtttgtttgtttgtttgtttgttttgtttttttgagatggaatctcacccaggctggagtgcagtggtgagatcttggttcactgcaacctccgcctcctgggttcaagcgattctcctgcctcagcctcccaagtagctgggattacaagtgcccaccaccatgtctggctaatttctgtatttttagtagagatggggtttcaccatgttggccaggctgatcgtgaactcctgacttcaagtgacgctcccacctcggcctcccaaagtgctgggattacaggtgtgagtcaccgcgcctggcccagaccccatctctttaaaacaaaaaagtacatgggataaatggggaaaacactcttgagacaagaccaaaacatacagtggctgctaaatgtcagtgccatgagcccagggttctcctacatccccttccgtggtcagggaggactgctgggctctgtgtcttctgtgattctcccctggctctgagccctttgcacctgcaactcacagcgccgctcaggtccctgggggtaaagtgccataggataaaagccacaggagggttttgaaatgctcttttcctctcagatatgtatttccgcatctttacggagtctcatcaacgctttttaaacctcccctgggatttgaaccagcgcccatagatacaggtggcttgtcaggtcagctaggtgctgctactgaggcagcatctgtccctagccccgcacccacaggttcagaaggggaacgcttcccccgggtggcttatgagatccagtacttctagtttcacttctttaaaaataccgtaaaaaagaaaaaggctgtcaaaacacaagcagtgtttgaaacgaagctttgtaggtccccctacaccaccaccgtcgtgggcagcatagcggatgagttctgggacaccagctaaaatgtgggcaagagaagccagggcgcgtagcagatgtgtgtgtgtatctttatgggattcaagtcatgtctctgttttgttgaccaacttccgctagaattcatagccatctagcctatgtattggatttttatttctgtgatgtctgcttcttttaaaaatatcagttggggccgggtgtggtggctcatgcctgtaatcacagcactttgggtgaccgaggggggtggatcacttgaggtcaggagttccagacccacctggccaatatggccaaaccctgtctctactaaaaataccaaaattagctggacgtggtggtgtgcacctgtaatcccagctactcgggaggctgaggcaggagaatcacttgaacccgggaggcagaggttgcagtgagctgagatcgcgccactgcacttcagcctggggaacagagtgagacttcatctcaaaaaaaaaaaaaaaaaaatcagttagtagccaggcaccatgcacacacctatagtcccagccactcaggaggctggaggatcacttgagttcaggagttcaagaccagtctgggcaacatagcaagacctcatctctacaaaaaataaaaaattagcagggcatggtggcacatgcctggagtcccagctccttgggggaggcaggagcatctcttgagcccaggagtccgagaccaacttgggcaacatagtgagattccgtttcaaaaatatgtatcagtaggttaatctagactttgtttacatgggccaagtggccaaggtcacatcttagagttgtggactgtataatcaggtaagtgtggctacagtcacagaaagtcagggtagaaagaggcttggaggggggtgcacttcttctagccagagctttcctactgagctccttaaagcacaggggaaagtgggacggggttggggggcaacctaaaacccaccccctcccatcttcaaccagtgcgaccctgtttttacctgctcagcagtattgtgcatccctgtaaaattttatttgaaaatggccttctgcagttaaaactacaaaaaaaggttgaaagtggccaacttaaactccactctgtttcttttttgattggggagactggtgtgcatagaagggaggtgtcagctaacgagactgttacctcaccacagatgcccacccgtgggtgatggagctcccaagtcctgggccacaccctacgtgccccatgcccagcaagttgggtgggggaggggtcagtacatgtttgtaagataaagaaaaacatccttcccaatcagccgtattacccagagggtgatactgatttagatcttatttcagtttggttagagaagctcaggtaccagtgagcagaagtctggccattgtggtggcttctggaagatgatgtgccatactgttagcaggggtgcaatttggggtgtgaggccaccagagctttgatttccgcccccgccgcccccctccaacccccgccccgccggattatttggagtttttttattgttgttcatggtaattacctgctattagacaacaatctagttccatttgcaatagggaataatacgtctgtgacacagtctccagacttagggagcctctggccaccccgagggggccctggtcattctgctgctggtcatgcctagctctgggtggccgactaggtggcctgggcgggagggtccactctttgcctttataaaaagaagggcttgggccaggcgttgtggttcatgcctgtaatcccagcactttgagaggccaaagcaggaggatcaccttaggtcaggagttcaagaccagcctgaccaacatggcaaaaccccgtctctactaaaaaatacaaaagttagccgggtgtgtggtgggtaccagtaatcctagttactcgtgaggctgaggcaggagaatcgcttgaacccgggaggtagaggttgcagtgagccgaggttgcaccattgcactccagcctgggtgacagagtgtgactccgtctcaaaaataaataaataaataaataaataagataacaaggcgtgctggagatggccacaggcctccagcagccgcaccatcagagaaatggagtcagagagagctgcagctgctctgatggggggtgggagtatgcaggatcctctgggggtggctcaggcctcccaggggagcacttaccttttcatttcatagtatgtcggagctgctgatgcaggaataaagcaaagtgcctggcactctgcgcgactgctattttttcattcattcatatatttgtccttcctctacacatgtatggcagattaacaaaagcacctccacggcctagctatgtggcccccacgggtttcttagcctctctgagcaagttggacagggctgccttttcctctccctaactctgacttctgtcccagcctcttccatctaatgtcagccctcatccctgcctgcccctcccggtgcagactgggacattctcaggctgtttgagccaccccttcatcctctgtgcttttccctggcatcctggactcccttctccccttcatggtgctcctaggccattcccagcgctcctgttactctctctgtcctcccagccccaaacccgtccagctctgtatccatctgcctggctgccattcatgctgcagacgtagcactcccagagcccatctgtctccacacattgaggcttccagccccctaaccccggtagtggccacagtgcccagtgggccaccccagccaagcccaagagtggccacatgggagcccttcttccatctccctcccctcatccacacattaccaagtcttgccaatttcatctcctgaggacctcagcttctgtcattctctccccattatactgcagttgccaccgttatttctctcctagaccttggctggcattacttggacattcatttctttggaatctcttggccagctttgcacacctttaactagactaagaagatttgaggccaggggcagtagctcatgcctctaatccccagcagtttgggaggccgaggtgggcagatcacctgaggttaggagtttgagacctacctgggcaacatggtaccccgtctctattaaaaatacaaaaattagccaggtgtggtggcacacgcctgtaatcccagctactcgggaggctgaggcaggagaatcgcttaaacccaggaggtggaggccgcagtgagccaagattgtgccattgcactctagcctgggtgacagagcgagactccgtctcaaacaacagcaacaaaaaaggaaatatgagctcccttcccagatccgtgcctctggacctgggctgaaggcttctactccctccattgtcaccttcgggaatctgcttgttaccttcctcccaagaatgttccagaaggtcttggtttaatttctggagggcattcaagaactcagtcatctcacgtgtctagaagagaaacattaaggccaggcacggtggcttatgtcggtaatcccagcactttggaaggctgaagcaggaggaccacttgagcccaggagttcaagaccagcctgggcaacatagcaagatctcatctctacaaaaaaaaaaaaaaaaaaaaattagccgggcatggtggcacatgccattagtgtcagttatttagaaggccgagacggggggatcatttgatcccgggaagtgaaggtgctgtgagctgcgatcctgccattgcatccagcctgggcaacagaacaagaccctgtctcaaaattaaaagagagagagaaacaaacatggcagctcagaaacctggctgggggtgattgtggggaactgctgctgacgggctcttgggcacacccctcactccagccattctgcctggatgccttaggaacactcctcataccctcctaagagtcccatccaggccgccatggctcacttatccctgccacgtggactccagaaaacattctcagtagaaacccacagaaactgttcccagtcacaaagcacgccaggtgcatcctgttctttctgtcatttaaaaaaatgaatgtgtctctatccctccttcttataaaacagtaccctctcaccctgcatggcttaaattctggtctatcttacgcctttggattcaatgaccttcatcaaatgtctgcaaggcaagggccatttacagtaaacatggtgggaacttagcaatgtacttgggaaataaattctggtcaccaaatagagaagcaaatgcaacaaataatcccacagaccattataaaatgtcttttagacgatagttgtcaagaattagagttactcgtccaaaactgttgttggtgtttggaagcatccaaacatcggctggcccatgtcccataggggcgtctgcttagcaccctggtgagtggagagttgtgtgtatggggacttagcagagtgggaagcagcttgcaggaaggttgccaacgcttattaatatttaccaaaaagatgcaggaccggctgcggtggctcacgacagtcctcccagcacttagggaggccgaggtgggtggatcacctgaggtcaggggtccaagaccagcctgggtaaaatgtagaaactccatctctcctaaaaatacaaaaattagccgggcatggtggtgcacacctgtagcccagctactcgggaggctgaggcaggagaatcgcttgaacccaggaggcggagattgcatgagatgagatcgcgccactgcactccagcctgggcaacaaagagcaaaactccatccaaaaaaaaaaaagagagagagatgcaggaccatctgcctatgttccattttggtgatgatatctgaccttctgggagagagaacatcttaccccacagacccaggaaggcatgcacatgaggatggcaggagagtggctgtggacacttcctgtgtcaccatcctctgctctaggtgtgtactggtcacaggcacaggacagaaggctccccagagtccgatcccgtctcttgagctcagctggctatcctggaaccccccaacccgctgacctttggaagtggacagcagcccacgcctgcaggtggtccggccctgctgtgcagccctgttacagcacgttgtgtttttctggcttgtctctgccaagccccatgtgaccatggagggggccccgagcagacctgggggtggcggtactgaggcagaggcaggcgcacagtggtttccaagggagaaaatgaattcatgatctaaaatgcaaaaccttaattatgcctgactcctttcctccctccctccctcatttctctccctccctccctccctccctccatccatccttccctcgtttccttccctccgtctttttccttccctcccttacttccttcctctcttcctcctacccttcattgacctttcattttgtgactttgtcaaatacagccccaggctatcttctctttctcctctgctccaggttgttttctcttgctcctctgccgcatacatacccttccaccctgcgtctgcccatggaaatctcgtgtcccctccagtattcctgcccacagtggcctttgttaggaaattccggcacagtctcctcacagggcagcccttctgggaatcgctcccctgcgctcgtgtgcactcccctgcgctcgtgtgcactccggcccagccttcagagctgcttacctggctcttgtcttgtgtcctctgaccgcccatcagggcctgcccatggggctctgtctgcaggggagcagccccaaacacagtccttgtcagcacgccgatctggacctgaattgggcccttgcacacactagctgtggaccgaagacaaatcaggttctccccgtccccagagtggggaaagcggtagtgtgggcctccctggggtgcccatgatggtgtaatgagtgcgtgcacggagcctgctccacgtctctatggacatttccataacttttcttttggtttgtttttttgtttgtttgtttgtttgttttgttttctctgagacggagcctcactctgtcacccaggttggagcgcagtggtgcaatctgggctcactgcaacctccgcctcttgggttcaagagattctcctgccccagcctcccgaatagctgggattacaggtgcccaccaccacgcctggctactttttgtatttttagtacaaacggggtttcaccaggttggtcaggctggtctcaaacttctgaactcaaatgatcctcccgcctcagcctcccaaagtgctgggattataggcatgagccaccaggcccagctaacttttcaatttataaacactaatacctacttgtgtcccgtggcctcatctcagccatgtgaggccgatgttgtgcccattgtacagatggcagagcgcagctgtgtgtgcagtgcggattgcaggactgtgcctgagtctgggacagggtctttgccacagctcttgggatcctctcttctcatcaatgttatctcagagagctttcactgttggataagaggttgaccctggaccccaccccagtgctgctgggccctgtgggcactcacagagcagtccttgctggcctgactcatattcctgagtctcaggggttcctgtgccaccagagaacgaactccccaactgtcagtcactcagctcagtgcctgtatcttaaattgggcacctttagcaaaagtgcagtgtggaactgtgtatcctgctgccccagcccaggacctagcacagagccgggtactgtgccataataagccttggtaaaggctgctgtaggcttcacagtacagatggcagggctgtgcccgggctgcaggctcccatttaccagatgtgtgcagtgtggattgcagggctgtgcccggctgcaggaacacatttactggatgtgtgcagcacggattgtagggctgtgcgtgggctgcaggcacacatttactgggtgtgcacagtgcggattgcaggactgtgtctgagctgtaggtgcacatttaccgagtgtgcacagtgtggatttcaagacttagagatgagacagccagttcctgtcctgcccaagggtcgggcagggatacgcatcaaagaccctgggcatctttcccagcccgggcggtgcccccagccatcgcttctcagcaggacagccggcagggcatctgtcgtcttcgtccaccagcatcacgacctgtttgggggagaagtagtatttccacaccccactcagggcgatagcgtttgaggaagaagagaaagagagacttttggctttcctgatttcaatctttctgaaggtggacccatcactggtgaaaaaaattggtttttttggaaccaagaaagcagcctcggcctccagtgcctgaccaggctctggccagggtataggatcctggcgaggatgctgtgctgtgttgggcaggaagccacttcctccctctaaacgtcagtgtccagctctctcttcgtcgctttcttaagttgagggagctgctatgccaagggcaagcaagaaacaggcccctgagcccccaggttcacggctgggctttgaagcaggagtttcctcttcgccctcgggccacacctctgtagggtgcctctgcagcatttccctcctcgggcaggagcctagcttgcagaggacagacaggcaggaatgctggcctccatcgtgccaccagatcctgtccccaggcaagcaggaggggaggggaggcagtctcatcactgcagcaggaggggccacctctggagtccgcatggctgtggctgggctgtgcttctagaagcagcagctgtcgcctccactctctagggatttttatctttcctttacaaacttttttttacctttttttttttttttttttttttaagatggggtcttgcttgttgcccaggctggtctcaaattcctggactcatgtgatcctcctgcctcagcctcccaaagtgatgggattacaggcatgagccaccgcgcctggccgatttttatctttcctaccagccttttcatatgagctgagcctgcaggctgtgcctaagcatagccctttgaacttgattgaccatgagctttgaaaggctgctttgcagtctcagttctctggcaaatacaccagctcggttaagacgacttttctttgattgatgtcggctacatctagaaagcaggattgccaccactcctcgaagcaccccacgattagagtgtctgagcgctgcttctgctctgctgaggctggtgacaaattgcctggaaagacctcctgacagaggatgacgggctcgtctgcagcagggccgcttgcagcccaattgcttccaagattaaacctttccaaggcagtctgcactgccccatacacagttgggctgcttggtttaagattatggatgaatgtactgaattggatctcatttaaaaatatataggttttgaagtttgagggctcaggaagaaaatgaaatcctttgtcccaaaccagggcctggttttatcagtggcatgcgtgcgtgtgtgtgtgcgtgtgtgtgtgcatgtgtgttctaaagagaccctagtggcaaggcacagtggcttatgcctgtaatcccagcactctgggacgccaaggcaggaggatcacctgaggtcaggagctcaagaccagcctggccaacatggcgaaaccccgtctctataaaagtacaaaaattagctaggcgtggtagcaggcaactgtaatcccagttactcagaaggctgaggcaggagaatcccttgaatccgggcggcggaggttgtagtgagccaagatcgcaccattgcactccagcctgggtgacaagagcaaaactctatctcaaaaaaaaaaagagagagagagagagaccctagtttagctcttttggaaagcagctgccctgcattgagacacatgtgtcttaagcttgcttctggacgctagcactaaaatagcaatcggactctggatgcctctcacaggcaacttgtccacaaaaccacttccaaatgttttcccaagtgcatgcgtctgacccaggcttctttctcatccgcctcttgtggaaggaagatcgcatcttgagttctaaagatttttaaacaatctcatacctgcagagcaatgtatatttcaagaccattgacattggaaaacattcttgtttaatcaatgactctggtcctgctttagatttctccaaaaatagccagatcccgtgggcacgttgaagctgcagcccattgtgcagaattgcttaatgtgtacctcacctggttttggccttcacacaactgttgctcccttagcaaggggttcatttggttgggttttatgtgcaggaatgctggtgggttgggtgagtattagtatttaagggaaggttttgtttttgttttgttttgtttgtaagagctagggtctcactttgtcacccaggctggagtgcagtggtgcgatcatagctcactgcaacctcaaactcttgggctcaggtgatcctcccacctcaccctccctgagtagatgggactatagggtgtgcatcaccatgccaggctaatactgtttatttgtatttttgtagaggtggggtatcgctttgttgcccaggctggtcttgaactcatgggcctcaagtaatcatcccaccttggcctcccaaagcattgggattacaggcatgagtcaccatgcctggccataggggaagatatttttaaacaagatttgcttttgactagtgtcctgcatttgttaaagaccctagattgctccaggtgttctaaaaataaccaagcccacctgcctgccttctagatatgggctggagggcctgccaggagcattcttggggattgccagtagccccagttagcccaggctgacttacacttcctccctctcttaaccaaaataatgttgaatttttgtgttccttgtcttttaactgaaaagctcctgtttgtttgtttgtttattttctgagacagagtcttgctctcttgcccaggctggagtgcagtggtacgatctcagctcactgcatcctccgcctcccaagttcaagccattatcctgcctcagcctcccgagtagctgggactgcaggtgccctccatcacaccaagctaatttttgtatatttagtagagacagggtttcaccatgttggccaggctggtctcgaactcctgacctcaggtgatccaccgcctcagcctcccaaaagtgctgggattacaggcgtgagccaccgcgcccggccccgtttggtgtttttaatgctgtattgccattatttgcacttattcttttgcaaaatttcagcacctggtggtcaggatgttcctcctggccatgcacatgcaggacacacaacaggttcttgataagcgtgtgctgagcaaaactcactccttccttctggacacattcatcacaggtgtgctcgaagcagcaagagcttgcccctgctcagaagtgcttagttgctaattagatgtttccgcaaaggtactgaaattggaggcatcagtgttcatcctttagctatagcgttggaaaaatgtgattgatttacaactgtgactaaaaaggtgtttagagaactgttctatgtaaaacaagacagtaagctgggcacggtggctcgtgcctgtaatcccagcactttgagaggctgagatgggtgagttgcttgagctcaggagttctagaccagccggggcaacataacgagacccccatctctataaaaatatatattttttaaaaagctgagtatggtggtgcatgcctgcagtcccagctactccagaggctgaggcaggaggatctcttcagcccaggaggtggaggttgcagtgagctgtgcttgcaccactgcactccagcctgggcctcagagtgagaccctgtctcagaaagaaaaaataaatatatatagtgtgtgtgtgtggttgcaacttttgcacatcaccttgagttctgggcaaggggagaggaactgagattggtcactcccttcttgcgtggatggctgtgggatttgggtgagttttttgctccatagtgcttttcaccctgtattttctcataggttttgccccactggggctttgtatagagattggggctctcaggtcccatatggcacttactagcgagagttccgagtggccagtcccctccctgccctggcattggtacaagggggccttgctgttggaccacagtcttccaagagtccagctcccctgttctatcgagtctgaagcaaggtcccacttgggagttacagatcaggctcctttgatgtcagagcatcgcagcggaattctaggccacccggcagtgagtgctctctgcagatctgtgagtggtgctgggccgccctgccacctccatccctagcaccgtatctgtgtgaaaaagctgtgacctgccccttgggtggaagccttccagtccttggaaggggaatctttgctgctgctactgtctgcagagagactctttttatttttatttatttattttttttgatggagtcttgctctgtcacccaggctggagtgcaatggcacaatctcggctcactgcaacctccacctcctgggttcaagcaattctcctgcctctgcctcctgagtagctgggactacaggtgcttgccaccacacccagctaatttttgtatttttagtagagacagggtttcgtgttggccaggctcgtctcaaactcctgacctcaggtgatctgcccgcctcggcctcccaaagtgctgggattacaggcgtgagccaccaagctcggcccagagggactctctagagaggccccttgatcccacaaggggcgggggtctctggccaggcacagcccctccccactaagcccagcacctggtgccgaacacacacacacacacacacacacacacacacacacacacgcccgccccccgctccactgttctgttgtcagttgtgttcgttgttttcttgtaaataaacagtatgacaataaagggaagttacttcttagctgctcagaaggtgaccagagcagggctggagtgccagccttgcattcattgtttgctttattgcaaggctgcttggaattgaaggggatctccgttcgagtctgagctggaggaaggaaggggctcctgtaccatgtatagaacttgggctctccccggggtcaggggcctgggctctggtgcagccccaccacttcatcaggtcaccccaggtggtttcagcctctgatttctcatccctggaatggggtgtttgcagcctcgtaggttgctatggggattgaatgagatatgttcatgagccagtaaggcagccaagatgtcacttacatggaacttacattgcaaccccagttttagaataacataggatattaaatatcaccatctccttgaatactcatagtccgcagtttgcttcatgttataaggtgtttagttctaggctgagcctgtaatcccgccactttgggagactaaggtgggaggattgcttgaggccaggggtttagaaccagcctgggcaacatagtgagacccctgtctctacaaactatatgtatacacgtataaattttataaagatgtttagttgttctgaatttcctaaaaaatacagcttaacttttttgtcttcctttacctgcacctggatgcagtgggaaagattttcccagtagcacaaggtggaccaggtgagctatcctcacccaatggggctgaaagacagggctttgatatcctgccccagagcccggctgttaccacatggtttgatttgcgatgccaagcaggcttccttacgggtccacacacctctggtttttagcttgagattggggcagctgttcctcctctggcccagccaggtataatcaggtacaaaggaaagtgacctagaatgaagaggttgccctgacctggtggtggaattggagcctgggagcacgggtcggatggcttagttcatctgtttggcagtggatcaaatccccctcctcccacatacttgatttatgtggactgggaaagaatgttgggtttcaacataaagaaaacaaatttggctgataactcgtaaatcacaataaactttcattccaagagtgttctgggcttctaagaaatatattcctatctcacatctcagttgatattcacagccaccattgagctagagtcattcccaggtggagaaactgaggcttgggagttatgcctgccttggagagggatggggctaagacttgggctctggtgtcctgaccaccgagcctggttccttccacgtggtctgattcctgggatgtgaagcagccatcctcacagggccacacacctggacaggtacacagtgcagcaagtagagaggcaaagaaacaagggaattgatcaggggtccacacgctttctctaaaagagcctggtgctacatatgttagtcttgacggagaaagaggcaaaatcaggatatcatgtaggcacttatataaccactttaaatgcaaccatttaaaagtgtaaaaaccattcttagctcatgggccataaaaatcccagcagctggctggttttggccggcttgccgcagcttgctgacccctgggagagagcatctgctgctattgcaggcaggggactgcaggtcatccccctgtttgggtcccactcctgcccgtcattcaggctctgtcagcttctacccagaagtacctgggagtcgggggttttgctgtgtcacagagaacttggctctcgatagagtcggaaaggaattctgggaaaactctagagatgcattaaaaaatctccactgggccgggcgcggtggctcacgcctgtaatccctgaggcaggcacattacctgaggccaggagttcgagaccggcctggttttttgttttgttttgttttgttttgttgagacagggtcttgctccatcatccaggctggagtgcagtagcacgatcatagctccactgcagcctcgagctcctgggctcaagcgatgctcccacctcagcctcccaagtagctggaaccacaggtgtgcaccactgcacccgggttaatttttttatttttgcagagacgatagtctccctatctttcccaggctggtctcaaactcctgccctcaagtgatcctcctgcctcagcctcccacagggctggggttatagacgtgagccactgcacctggcctctttcttcttgaggctagttttcctgactgcgtgattcccaaagcttcaccccactgatgctgggttcccctcctctgtctactccacctgctgaggctggggctctcagggacacagtcagcagctcagcctctggaaagacctggaaagatcacatccttctgggaacctgcttctggaggcacaagtagtgtagctcctcttaggccctttcgatgaagtaagagcagctcattagcatcccaggctacaaagcctaaaaccctttgcttttaccaaaaccagagggtctaaagagaaaggtcacgaggagcgagcggccgcgtggatgaggttggccagagaaactggtttgttttggaagccgatggaagatgcgcttggaaggctaaggctgccgaggttgaagtccgtcattctcagtgcagaccctagggaggaagtagcaggaccccagtggggctgcaggcattcagaaagagagctgcctggggtttcccttcagaacctccctccttttaacccgggagtaaagagaaaaagacccgcggggtccactggctcggaagtcggtctctttcagtttggagcctccagttggaaacctgccttttaatggccaggctgatggtctagttactctttgaacagggaagcctcgtcaggctctctgctgaccacgcctcagtgctccctcgaaggacaactctggaatgccagtttttatctcatctcggtagaatggattttttttcttttcttttcttttctttctttgagacagagtctcgcgctatcacccacgctagagtgaaatggcacgatatcggctcactgcaacctccgcctcccgggttcaagcaattctcatgcctcagcctcccgagtaactgggattacaggagcgcgccaccacacctggctaatttttgtatttttagtagagatggagtttcactatgttggccaggctggtctcaggcgatccacccgcttcagcctcccaaagtgctgggattacaggcgtgagccaccgtgcccggccctagaatgaatttttcttttagggaaaataaggttattggtgaatgggtttgggctgtcatcttcagaaactgatttcatctagaacagtttgtgacgggcagatgtggaataaaaccactggatgcatcaggcgtcactgccaagggtgcaaggggctgctccatgctgggcgtgcgagaggagcaagaagccgtccccgcccaccacggtgcaggccgggatgcagcggaaagcccttgcttcttagatttcccacacaaaagtgtatttcttgtagatttcgccagcgcgggcctcctcctctgcttggcagtggctctgcacgagctgccttgggatggatctctcatctttgctgctggcctcatccaaggaacagaccccatgcacggagcctagatgccccgaggtcttcactgatggccctctgaatttttattttgtttgtatttcatttgttactgattgaatttttgagacagggtctcgctctgtagcgcaggctggagtgcaggggcgcgatcctggctcactgcagcctcggcctcctgtacctaagccatggccctctctgactttgaacccctcagttcattctcagatcagaccactcactcactgaggccctcggctcttccacaggtctcagccttttgccccttatagtttttagttgttgcagcctttctgttctcttcccctctcctgttaaggggacatttccaagcaccctggccacagaacctcctcacctcccaccctccgcccctgggtgccagggcctgggttctctgtggaagtcctgccagctccgggtatttcccacgtggatttctcatcatcttcaccaccagatcagttcctggcctgcacccctcctgtctggcttgtggcaggggctgccaccctcacctgggccctaaacttctacaaagccccactctctcctgttcccgtcagtctgcttgccaagtccagtttattttaattctggggaacgttgtcttcctcctcccccctccctcgccaccacccacctctggtgttttttttgttttgttttgttttgttttttttgagatagagtctcactcttgtcacccaggctggagtgcagtggtgcgatctcggctcactgcaacctccgcctcctgggttcaagcgattctactgtctcagcctcctgagtagctgggactacaggcacccgccaccacacccggctaatttttgtatttttagtagaggcaaggtttcaccatgttggtcaggctggtctcgaactcctgacctcaggtgatctacctgccttggcctcccaaagtgctgggattacaggcaccacttctggttctgttaccttcgtccaaacttgtatttcccagctggtatcttccatctccaggctttcccctctggcctgtcctttagcaggagtcaccttcctgaagcagaccctggtctggtctctgcgtactaccttttgcatggttggtggccgtccacccgcctctcaggccatgtctgggttcttctaggggcttcggtgatctgggagcctgtccccgctggccccctctcccatgtcttactccatcagcttcaccttgtttgtatctctggatctcctcttttttccttctgtttgtatcttgtctctttctagaaagcccccccacctctactcgcccctctgtggcaaatatcacccaattcaggtgcccccagcccagcaaagagggattttcattccttgggcccccgttgtaggctagctgcgcctgtctttcggcacatttcatttcctgcctggtatttcggtcgtgtgcgtgtctttattctcctcgtgtaatccctgaggtgcagagtgcgtgtctgtcctcctctgccctctctagagattgggatatgaccagtgttcagcccccaaccaaaagagcctaagaaccccaggtccccagcctgtcctgctctgctgggggcccacatgcctggggacaaggcacctttccttccctgaccttgactaggacaggacatggggtagggcctgaacattgagcaattgtcaaactgcctacttacgatgaacaaaatagcttttcaggaggcgagaccacagcacagtcatggtgaatcctgatgcgcaccccaggtcttttatcaggatttttgtttttcctggtgggcacagatgtaggtggagcagatcagaggcctctcaggttcttgatcactcatggcagttcaggcctgccagtagtgaggtcagagatccatacagcaggggagagaagggaggtacagggaaccctcggccccgcgtgctccagcaggtctgcatgattaacctgaattgcagtgttcagaggctcggcctgccagccacagcggttccagatgaaatgcagcttagaaggcagcatggtgtagtagctttggcgccagccgcacccagagtttggattgtagccagatggcctcaggtgcaatgtataacctctgggaattccagatttcctatttacacgacagggatgattccatacctgaagggctgtttggaagcatctagaagcaagcacagtggagtggctgtcatgacgctgaccgcacaaatgatggtgttaggatccctccacggatgtggccaggtgacacccctcacctaggccgcacagcaccctaatgtacacactgaagaaaggctgcgtggggctgcagagcggctcatttctaagaaggccaaagaaattgctcagtccagaccagggaacccagtttctcttttagaggtgggatcttgctatgttgctcaggctggtctcgaactcctgacctcaagtgatcctcccgccttggcctcccaaagtgttgagattccaggcatgaaccactgcacccaacctgtagcctctttctacaagtaaaataattcaggtgagttcaggcccacgccaggtcttaaaccctggccctctgcccatcttccagcctccaccccttctctctccttacagaatcttctgttcttctgcacaccagcgtggcagacaggttggccaagggccttggacttctttatctctagtacatgttcctgtaaatttaaacctcctcagttgggtaaaagctttggaattactaacattccttttgtgctgcctaacgttcttgccatttaaaagattagcaggcataatttcagtgagccttcgtgactggcgtgcctcacttagcttaatccctggttggtacatgttaaaacctataaagacagcctctccagcacacatggggagcttgaaaatgaaagaaaggttgctctgacctctcagaactgcggacttcttaaaaaagaaagagtgaggtgggcggcctcccttgctgccggtgctagattccatgatatgaaacagcaagggtgcagctgggtgcggtggctcatgcctgtaatcccagcacttcggaggcgggggtgggcagatcacctgaggtcaggagttcgagaccagcctggccaacatggtgaaaccccgtctctactaaataatacaaaaattagccaggcatggtggtgagtgcctgtagccccagctactcaggaggctgaagcaggagaatcacttgaacccagaggtggaggttgcagtgagctgagatcacgccactgtactccagcctgggcaacagaacaagaagactctgtctcaaaaaaaaaaaaaaaaaaaaactgacttggatatgtgcttacataagaaagggagattcaccaagtgaaccatgcatagcatctcttaaatctgtatcatggaattcgtgattgggcctctctttcatatcaggcaacatacatgtgatgtacatacctgtagcttccgggaaagggaaggaagtagagatgacattgtctgttactcgtttgtatgtgtgtgtgcgtatttaagtaaatatgtgtgtgcatagggacatgtcacatgcatgtgtggcacatttataggatgaagaggtgtctaaaagacattgaggaaactcagtgaaggagttctgccggcgggcgtgaggaccacgctaaaagatgccggttgtgctttgtgtctaagctgaaagcatggatatcattttataaaagtaaaattatattggccaggcgtggtggctcatgcctgtagtcccagcacattgggaggccgaggtgggcggatcacctgaggtcgagagtgtgagaccagcctgaccaacatggagaaacccccatctctactaaaaatacaaaaaattagccaggcatggtggcacatgcctgtaatcccagctactcaggaggctgaagcaggagaatcacttgaacctgggaggcggaggttgcagtgagccaagatcatgccattgcactccagcctgggcaacaagagcaaaactccatctcagaaaaataaaaaaaaaaagtaaaattatattgttattgacggtctctttgttcgagtaagccgtctctggatatatcattgtatggtgtattcatgccaaggatttggtgtgagtcttgaagcattcacaccaaattgtggccaagcccagcactgagagcgcagtgggcgttcggaggacacgtttggattttgtgatcctctgcctggcaggagctgctcagcccctacagccccttccccgagaccaccaatgcgtttctcttcagttttgctattctcatacgctggtgatgggattttggagacaaacatggtctcttctgcttgcttgcttgcttatttatttatttttcctcccaggttcaagtgattctcctgcctcagcctcccaagtagctgggattacaggtgtgcgccaccatgcccagctaattttgtgtttttagtagagacgggtttcaccgtgttggccaggctggtcttgaactcctgacctcaggtgacctgcccaccttggcctcccaaagtgctgagattacagacatgagccaccgcgcctggccttctgccttttttggtgaactccctgtgggtgggagaactacccggtggagtcggtacctaaccagggcaggacacggaggtacacccctctcattttcggcagcagggtgagaggatttttattatcttacttagacacttgaatttatttttttattttgagacggaatttcggtcttgtcacccaggctggagtgcaatggtgtgatcgctggtccctgggttcaagtgattctccaacctcagcctcccaagtagctaggattacaggcgcccatcaccacacctggctaatttttgtatttttagtagagacggggtttcaccatgttggccatgctggttgacgcttgaatttatttatttatttcagataattttggactacagaaaggactctttgaaagggtattctaaaataatttcacccaattaggttttaaacatagtctgccatattgttgatttcacaggatttgcttttttaaaaaaatgtattttatttatttagaatttttctttaagagatggggtctcactctgttgcccaggctggagtacagtggtgcgatctcggctcactgcaacctccgcctcccgggttgaagcaattctcatgtctcagcctcccaagtagctgggactataggtgcgtgccaccatgcctggctaatttttgtatttttagtagaaacggggtttcaccatgtaggccaggctggtctcgaactcatgacctcaagtcatgcacctggcttggcctcccaaagtgctaggattataagcgtgagccactgtgcctggccttcagtagcttttaaaggttgtagctgaagattttgtacttgtcacatgggggaatatgataatgaaagcagaagatagactagtcactctacttttcccagcgtcctctctgactggactctttgaaggtactgcccagggtcatgaagagatggccctggctgcttccagaaggtatacattcccgtgtccactctgtgtcctggagagtgggggcggggggagggggttgtccgtctttgtatctctgtctctcagtacaaatttaatgaaggaatgaatcaatgaatgaatgaagcaagcattcccccagagaattcttaaatcatcttagccggtcatggaatttcccagcaagtcagcttttagaatcctgaaaatattttcagtattcatctctttaaggaatatatcaaaagcagtcagcaccaaccacggtttttcagctgattcccaaatgtgtgataagaaacacctaattccttgggggagaaaacttgttcaggttaaattcttgcggtaatccttacggccctgtggtgttcgctaagatgtagcaagaatgtaaatagctaggtactttgatctacctcaaatacttactagtttaaacattctgccattctgccgtcataccaaaaaaaaaaaaaaagcaccatcccagggttatgaatgacgttactgtctttggacatgctgtcttgtgtggctgagacgtagatcaagagaaatttgtaagaaagacaataaggtacaaaaatcgccgaagctaatgtcaagatggagataaatagatctatatttgccatatatggtagtaaaagaaaagtctgtgcaaatttgctcgacatttatggacttctatgattcatctaccagggccagcagctccagccaagagatatagaatgtcttcaactgtatttctttcctaaattgtttcattacaaagaagccatgttgtgtattcagaagaaaattccaggaccgcatgaaagtcactatttgggaacaggcctgagaaagcttgcttagaggaattccaaaagtattcaaaaggcagttattgaccaaacacataataattctctaagcatcaacaattttccatagatccaagctcacatatacagcgtattttctgtggctagtcactccagaaatagagggttctctgctttcttgactgattgactcatatgcaaacgcttctcatttcattttgttatttttttgagaaagggcttgttctgtctcccaggctggagtgcagtggcacagtcacggctcactgcaccctcgacctctctgggctaagccatccttccacctcagcctcccgagtagctgggaccataggcacacaccaccatgcctcgctaatttttgtattttttgtagagacagggtctcgccatgttgcccaagctggtctcgaactcctgggctcaagcaatcctcccacctcagcctcccaaagtgctgggattataggcatgcatcaacatgcccagcctgttttttgttttaatctgttattgagtaaggtgcaatttgtggctccatatacagggacaggttgcaaaacaggtactgagccgtgtgtatccttcaggtccaagcagcttctaaactgtgtctatctctgttcaggtccctggaactctcctgggcagcaagctcacaagagaccgacctctgtggccttcgaagcgggttgctgttagacacaccttttagaagctacattcatagtatctcaaaagacagacataaggggtactcggtatggccaccactcactcccacaacacagccaccatttcccacccagaatttcctgtgaaatgtgctcattttaaaacagcacacatcctgagaattgcaaagttgggcatagagatcaatacaaattagacttctttttagatacgctctacgctctgcagagccctctggggtctccaagggctgggacctgctggataaaactggatgaaactaagttgctgcttctttggtgcccttgaatggactttcttggctgcagtgacgttaggtccgcttcctagccgcgtgctgctctgccatcggggatgctaaagtcggggagggccaggaagcctttctttgcttggaagtttttgtttctccttcgcctgctaggttgggataatccgttgggaagtctctgagcgtctttaaacataaaatctagtttcaaaggtttaaattcccaagttgccccctaagttacatgttgcttaggcttggttgctatctgtatggtataaataattccatttagaaattaagaaattatgggctgcatttttgatgccagtggctctgtagtatcccccaaccaccaaaaaaaaaaaaaaaagaaaaaaagcatctaaaaattgtgaggttaccgcttagctctgtctttctggctgcacatgggttaccaggtgccttgccaagaccctgcctccgtgtccaccatgctttgtgtctgcaagtagatttacccatcgttcattattaattattcctctgagcagctctgtgaagctagtaaatattaataaacaatatgtgctgattatgaacctaagacaaaaggatgtctttttcaagctgcttaattttaggtaaactagttgcacacaagcgatgaataaacgtgaagtcaggcatccaggcggtgaaacaaaatcaaactggaactgcaaaaggagagtgcctgagatctgattttattttatttttgggatggagtctcactctgtcacccaggctggagtgcagtggcgtgatctcggctcactgcaacctccgcctcccaggttcacgcaattctcctgcctcagcctcccaagtagcttggactacaggcacacaccaccatgcccagctaatttttgtattttaagtagagacggggtttcactgtgttggccaggctggtctcgaactcctgacctcaggtgatctacccacttcagcctcccaaattgctggggttacaggtgtgagccaccgcatccagccgaaaggatacagtttatttaaagacaaaggaaaaagaaaaaccataattgtgttcacttagaaacatctcccatttcatactgatgtctttcctggtggtggtgtccaaatgcttatatgtgtgtgagattcattgttaccatgttgggatcagactgtaaacaagctttataaaagttcgtggctcctttcactcatccacccgctatgcatcgtccagatctgagttcacgtgctccttccccaaaggagccttctctcctgtctagggtcaggtctgcctctttttttctttttctttttttggaagcagggtctcaccctgtcaccaggctggagtgtggtggcgcgatcacgactcactgcagccatgacctcctaggctcaagcagtcctcccacctcactcccaagtagctgggattacaggcacatgccactacacgtggctactttttaaaatttttttgtagagatgggatcttgctctgttgcccggggtggtctcgacctcctaggctcaagcgatcctcccttagcctcccaagtagctgggacgacaggctcatgccaccacacccagctaatttttttgatttttagtagagatggggtctggttatgttgcccaggctggtgttgagctccagagctaaagcagtcctctcgccttaacctcccaaagtgctgggattacaggcacatgcccctgtgcccggccaggcttgcctcttaaactcccttcgctccacatgcccttctgcagcaccggccacagataagtgtcatccatgctggtggtgatttgactcatgtctcacctgccacacaacagaggcccaggaggcacagcagcctgtggtctctgctcatgattgaaggagcccctaaaacagggccggaaggcccaaaatagccactcaacaaacatctgtcgcataaatggaagtcacgtgcctcattccaagtctttgctgttcttcaaaaaataatggtactccaaaaaataatgatactccagattacactgagccatgaccacacccctgcactccagcctggacgacagagcgagacctcgttccttacaaagaattatactgagtacctaatatgcaattgcattgctttagtagaattctctcataagtactcccctggtgtcggaatccacattgttcccagttgttctctgttctaaactcatgctgaacattcttgtgcataaatctctgcctacatctctgattattcttacggatagactcctgaaagtactaagaggaaggattaatctgcgttctgattttaaacagcccatttgtctaaatattagcagggcctaagatctggaataaatgacacagtggcaaaagtcggagtcacacgtcctggttggtttcagagagtcctggggtgaaatggtgcctttggggtccatccctgtctagcacaggagtcccctttgcagcagtgtccataaaacgttagcttgggctgggtgtggtggctcatgcctgtaatcccatcactttgggaggccgaggtgggtagatcacctgaggtcaggagtttgagaccagcctggccaacacggtgaaaccttgtctctactaaaaatgcaaaaattagcctgacgtggtagtgggcgcctatactcccagctactcaggagaattgcttgaacctgggaggcggaggttgcagtgagccaagatcgcaccactgcactccggcctgggggacacagagagactccatctcaaaaaaaaaaaaaaaagtgagcttggtgatgagtctgggaagagcatctcttcattcattcagtccacaagtattcactgtgtctgccccgaacctagcaccatcctttggcccaggaatagaacggaggaatgtacatctcctcaaatgtctcctagaaattgagacctcaccattctcgctaagctccctgagggcagggactgtgactgtctcattcactgctcgtagttaatgctcaaatggtttttgaataaattaaaatacaatatgtgggccagtgcggtggctcacgcctgtaacccagcgcttcggtaggccgagatgggtggatcacctgaggtcaggagtttcagatcagcctggccaacatggagaaaccccatctctactaaaaaatacaaaaattagccaggtatggtgacacacacctgtaatcccagctactcaggtggctgaggcatgagaatcgcttgagcctgggaggcggaggttgcagtaagccaagatcacaccactgcactccagcctgggcaacagagcgagactctgtctcagaaaaacatgtggttcctctctttgacaagttccaaatctattgatgtaattgatgtatagatacatcagtaaatcacagatgtattttcaaagttctgaaatgtaactagagatttgtttatttttgagatgaagtcttgctctgtcacccaggctggagtgcagtggcatgattatagctcactgtagcctcaacctcctgggctcaagtgatcctcccacctcacccttccgagtagctcgcactataggcacttgccaccatgcctgggtaatttttttagaaactttttgtagagcaggagtgtccctatcttgcctagactggtcttgaactcctggcctcaagcaatcctcctgtctgggcctcccaacgtgcagggattacaggtgtgagccactgtgcccagtcagaggtttcgacatgagcagttattcagaaagggacctggaagaatattttgaaatcagacctagagtcaaatcagacttatttaagagaattaaccaatggagcctgaatttggcttctcccatttcctaccactgatcccctggccatgaggacagtcctgcaggaaattcctgtgccaggtgggctagcccaggacacatggctttggagactaggcagggaagatccagcccagggtactggagctggcgcttgcatgcccctctcactggggtgtctgatccccagatgccaacgaggctctggctgtcctgtctgagctgcccctgaggccacacacaggatctcagagtggacaaacagcctttcccttgacaatgagcagttctcagctctgagaccagaagaagccttagtgcaaccatttctcaaagtttcagtctcttaaaattgaggactccggagagcttgagtgcgtgcgtgcgtgcgtgcgctgtatctctcagtattgactgtgttagacatgaaagctgaggagtctgcaaagcacaggaacacacaaacacacgagccgctggtgtcagagtgaggctatcatcacacatcgcaggcatctggaaaactccactgtacacttgcgggagaaggcgaggaaaaggcaagtaacaagaatagttttgaccttgtggatccatgaaaggatctggggagccgggagtccccagaccctgctttgaggatcgttggcttagtggcattggcatccaggctccaccataatcctgagccgtggccacgtgctgccagatcacggcctctgtgcagttcgaatctgcccttcttcttagtcctttgcaccatcctcagcctttatcctcctcggtccacattcaggcattgccacttagataaccgcccccgcgcccccctcccaccccacttttcaacatcagacaagtctttttttgtttgtttgttttttgagacatagtctcattctgttgcccaggctggagtgcagtggcacaatctcggctcactgcagcctctgcctcccgggttcaagcaattctgcctcggcctttggagtagctgggattaaaggcacatgccaccacgcctggctaatttttctatttttagtagagttggggtttcaccatgttggcgaggctggtcttgaactcctgccctcatgtgatccacctgccttggcctcccaaagtgctgggattacaggtatgagccaccatgcccggtctcatcatcagacaagtcttgcagatcccctcttgatcaggaactcaggggtccccacctgcagcttcagggtacccctcgctgcttaccagcaggcaccctatgttgaaatcctgcaccctcatctcagttcccaatcccaccagtcccccaaagccagcccttcccgtggtggagttgtaccacgtaccacgcaaaagccacagcatcagcattggagactctgccaggacacggaacgtgttttaaatggcacaaagacatttaaatgggaagaaattatagcaggagtgagtttatccctttcaagataatcttatttaataaccaaaaaactcacaaagatgtgcattttatccgactacaaaagcagcgtggcgggttatatattgtggtaattacatgtttggggtttcattcctcctttaaaccagatttcttttatttcagaaaatcagccattgtagaaaaagactattcatttatttcattgctgggtggcctatacactgtaaaaataggtcaagaacagtaatctaaattgactgctgataaataattaaagctaatggaatttttctcaaacctgtgaactaaaatctttgagaaattgccaggacatacttactgtctgctgttgtatagaaagatattttttatttaatacttgagtttcaatgccatttaaaattacccttttctatcacaaggactggaaggaatatgtgttcatctataaaagtaaccaaaggaacgatgccgtgttgatggttatatggttcatcttcagatgagatgggaagtgacggtttcagtatcctggaacaaaagaaacatcatttttcactgaactggattttaagttgaggtctacagtccacatatcatataatatatattgtcttgtttttaaagactccatacctggtctgagctcttgtatacattgataagggaaacttaacagctatctaacgtgacatccaggaaaataaatactaagaacattttttctttcattagtaattactgttctctcattgctgctaccaggaccttataaaaagacattggggtcaggcgtggtggctcacgcctgtaatcccaacactttaggaggccaaggcaggtggatcccttgaggtcaggagttcaagaccagcctggccaacatggtgaaaccccgtctctactaaaaatacaaaaattagctgggcatggtggcgggcgcctgtaatcccagctacttgggaagctgaggcaggagaattgcttgaacccaggaggcagaggttgcagtgagctgagatcgcgccactgcactccagcctgggtgacaagagcaaaactcggtttggaaaaaaaaaaaaaaaagaaattacaaagtgagctaagaccagaggagaggggagaggcaagagcggagaattaccccagatgagggagatctggaacagaaggtgacaacaggccaagccacagggccaggtccctaagggtccccacctctagcaccattggcaacaaccttgtgagagtcagaatcaagtctttcagaagtgacccagttcagcccctcactacccccaccctgccctagtgctcttggaaagactacattgtctccgaaggagaaagggtcccacccctgaactgtcactgtacaggatggggtaccaccaagagatgttgtacctcttaaatgcagtcagggttatttcccagaaaagtatccaagttactgtaggatgaaaaagacatccagaaaaacctggattatcagatttttttttcccccatttggagacagggtcttgctctgtcacccaggctggattacagtggcacagtcatagctcactgccatcccaaactcctaggctcaagccatcctccacctcagcctccaaaatagataggactacaagcctgcaccaccatactcactaatttttgtatttttttctagagacgggatttcaccacgttgcccaagctggtcccgaatgcctgggctcaagcaatcctcctgccttggcctcccaaagtgctgggattacagttgtgagctaccagatacttttttttctcttttttttttttttttttttttggatggagtttcctgggttgaagcgattctcctgcctcagccttctgagtagctgggattataggcatgcaccaccatgcccacctaatttcgtattttttgttagtagagatggggtttctccatgttggtcagactggtctccaactcctgacctcaggtgatctgcccgcttcagcctctcgaagtgctgggaatacaggtgtgagccaccacacccggcccagatattttaaaaacagaaatgacttgatgactttggagatgtgtttgtaattcacagcctccttctatgtgtgcattgtgtttgtgctgattccagtgagcctctcgctcctgcagacagaggtgaacctccatgcagcagctcagcgtgtcaccagctctgggtccctggcacgcgactctgggatatggggagtggaagagagctcatgggaattgggagcacgaggccctaagatggagcagagccttccagagagggctcgggagtgtgtgtgttacgactcccgctcgtacgttacaggtgcaattgaacactgcatgacgattttgtctctattttgcttttacatcagaatggtttcctccagcaattggcattacctagaaaattccttaatagcattttgctgttcagttctctgacctaaaaactgagttgtgaatcagcagtttcgagaataatggaaatacggccagacacagtagcacacgcctgtaatcccagcactctgggaggctgatgtgggtggatcacttgagcctaggagtttgaaatcagcctgggcaacatggcgaaaccccgtctctacaaaaaatgcaaaaatttgccggacatggtggcgcatgcctctagttccagctgctcggggtgctgagatgggaggattgctcgtgcccgggaggtcacgactgcagtgagctatgattgagccactgcactccagcctggaagagcgagacactgtctcaaaaaaaaaaaaaaagaaaagaaaaagaaaagaatggaaatccttccacatagaaacctctctgtgtaaacatcatttatttgctgtgtactcaaaggagaggaggttgacatgagctattttggcttttgccaaaaggcatatgattggaattatctcaagaacatcactttctgtgcattaagatgtttgttgctttttgcccaatagatgggatgggatggaaacaaggtgaaaacatcactgacaaacctgaattaagtatataactgaattaagtgtgtaacgtgtaacttgaagtaattaagttttaaaacatggccgggtgcagtggctcaagcctgtaatcccagcactttgggaggccgaggtgggcagattacttgaggtcaggagttcgagaccagcctggccaacatggtgaaaacttgtctctactaaaagtacaaaaattagcagggcggggtggctcgcacctatagtctcagctacttgggaggctgaagcaggagaatcgcttgaacctggggggtggaggttgcagtgagccgaggtcacgtcactgcactccagcctgggtgacagagcgagactccatccccctccccgcaaaaaagtttttaaacgtgttcactgcctccttatcatttgttccactgtggttttggccagcctgaaccccactttttccagtttatgaccacaaagaaggattgtgcgggtgtgcatgaggaccagtaagtggcagagtctgcattttctggtgctgtccagacagcaaagagtgctgtgttctagaaagacagtaaatcgtatcatgtccttgctaaccgacgatggagaattctgtgggtcagaattgagcatcttttttgagacagagtctctctctgttacccaggctggagtgtaatggcatgatcttggctcacttgcagcctcaaccacccgggttgaggtggggagcctcccaatgtgctgggactataggcgtgagccgccgtgcctggccagaattgaacatctttgtatctttcttcttagtttagtacaaaactgaataatatttgcaggcagcagaattggatcgggaatttctcaaactgccaaagatgaaattagaatgagtgatttttggctggcagcttgaagtacatatatatcagtttgtgtatgatacgtgtgagtatgtagtggtttttccctcttcaactgtctttaaatatgtgtgcgtgcgtgagtgtgtgtacaaacacacgtagctttaatatcaaaaaggttatttttgtaggtctgttaggagacatgaatatgctcaaaagggaaaaaaatacatggatagggtgagaggagtttgctttatttaaggacatgataaaaggcatagcccttctgcctttctggaatgctgtaacagaatatagaaataattgtatcatctcctgtacttctcagagctggtgtttgcgtgaggctggccctgtgccaggttggcagggttgggggtaacccaggagcatgcctgctaaggcacactgccattcagggcctggccttgcccctgcgccccagccccctgctctcctccatccagctctgccctcttccatttctctgctacagtctgaaatctctcagccacaccagctttctcattccatgacctcatctgacttgtctccttcccctctgaatctgagcccttgttaagcctttttttgttttttctttgagacagagtctcactctgtcacccaggctagagggcattggtgcagtctcagctcactgcagcctctgcctccgcggtttaagcgatcctcccacctcagcctcctgagtaacctggactacaggcatgcaccaccacgcccagcttatttttatattttgagtagagatggggtttcgtcatgctggccaggctggtctcaaactcctgacctcaggtgatccacttgcctcagcctcccaaagtgctgggattacaggtgtgagccagcgtgcccagccatagctattcttccattcattccctcatgcaccctttccatgtcttttgagtccccactgtgtgccaggccccatggtcgttttccctggaccctgctgggatcatagtaatcttcccccatcattctttacgccttccacactcttttcccttgttaccctttgtgttatatgttgtcctctacctttctgaaaagcacagtgggtgaaatgcggtgatgtgttagcttcctgttgctgctgtcgcaacctgccatgcgccgagtggcttaaaacaacagaaatttatcatgtgacagtgctcgagttcaggagtccaaagtgggatggattccccaggctggaatcaaggtgtcagccagagttgtgttcctattagaagctctgggggagaatcagtttcctggcagtttccagcctctcgcgctgccggcattcctatagcattccgacctctgcgtcggtcctcagatctcctctgactctgagcctcctgcctgtctcttactaggagcactgggattacactgggcccacctggataatccagggtcatctcctgactcatgatccctgacataatcccatctgcaaaagccccttttaccattgcaatctaacacattcacaggcgccagctatgaggacgtggttatctctggcggactattattggtgctgaccacagatagccttatttatataaaaagagattggtggccaggcatggtggctcacgcctgtaatccacagcacttcaggagaccaaggcaggcatatcgcttgaacctgggagttcaagaccagcctgggcaacatagtgaaatcctgtctctacgaaaaatacaaaaactagccgggtgtggtggcgcatgcctgtggtcccagctacatgggaagttgaggtgagaggatcccttgaacccgggaggtggaggttacagtgagccgagatcatgccactgtactccagcctgggtgacagagccagaccccgtcttaggtgggaaaaaaaaaagattggtaaagaatctgattattttttgtcctggagcctggtgtaaaaaaatagaaaatcatctagttgaggaagtaacaggattgacttctccaaggaaataatggtatcacgtttagaaatgcatcctttggaacagtatatagttaaaagggaaattataatgcttcttgaccaaatgtttctacaggatcacaatacaaaataacgtgggctgtgatgatatttgtcaaaaaacttgtggtacagtggccaggtgcagtggttcacacctgtaatcctagcactgtgggagatcaagacaggcagatcgcttgagtccaggaattcaagaccagcctgggcaacatagcaagacccttatctctacaaaaaaataagaaaattagcaaggcatgatggtgtgcgcctgtagtcccagctacttgggaggctgaggtgggaggatcgcttgaacccaggaagttgaggctgcagtgagctatgatcacaccactacactctaacctggatgacagagcaagaccctgtctcaaaaaaacaaaagcttgctgtacaggcctgtcctgtaggtccctctgcaatgatggaaaaattctgtgtctgcattgttggaagcagtagccaccagcaacgggtggctaccgaatccttgaactgtggctagggtaactaagaaactgaattttccaaatttatttaactttaagttatatttaaatataaataagcacatatggctgtatgtgttgaataagaagactttttcatctgggatcttgataggtcttacttaggaagcctctgataaaataatttgcagagttttatttctaatggcaaggtcagtagctttcctcagattctcagaaggcttcatcaactaaaatgtaggcctagcccggtggctcatgcctgtaatcccagcactttgggaggctgaggtgggcggatcacctacggtcaggagtttgagaacagcctagccaacatggtgaaaccccgtctctactaaaaatacaaaaattagccaggcatggtggtgggcacctgtagtcccagctactcaggaggttgaggcaggagaatcacttgaacctgggaggtgtaggttgcagtaagccgagatctcgccactgcactccagcctaggcaacagtgagactccgtctttaaaaaaaaaaaaaaaaaaaaaaaaaacatagtttcaatgcctaaactttcagtaaataagatattatcttagtcgagtcttttcaaagtttttgaagcactttctcagttacttcattttaaataaaatgctctgaacaagatcataagcatgcacctatgggatgtcctggtgtttcgaaatgggcactggtggcatgggataaaatttattgtgactctgtcagatgtggattcaaaacaggctgtatctccgacttaacagtgcattaaaatggcagctagggccggccatggtggctcatgcctgtaatcccagcactttgggagatgaaggtgggcggatcacctgagattaggagttccagaccaccttggccaacatggcaaaaacccatctctactacaaatacaaacattagccgggcgcctgtagtcccacttactcgggaggctgaggtgagagaatcactcaaacccagaaggcagaggttgcagtgagctgagatcttgccactgcactccagattaggcgacagagcgagactccatctcaaaaaaaaagaagaggcagctaaaatacagtgcagtggcccaggtccatttcagatagaaacagccaggcaaaccccccattctagtctattttattctaagcagattatctcacttagactgacatcagcaaaagctttagtctgtagcacattcaaaatgaggtatatgtgaccaggagttagtagaaataaaacatcgttgtaggccaggtgcggtggctcacacctgtaatcccagcactttgggatgctagggtgggcacatctcttaagcccaggagtttgaccctcgcctggacgacatgatgaaaccctgtctctacaaaaaaatacaaaaattaaccaggcatggtggcgtacgcctgtagtctcagctacttggtaggctgaggtgggaggatgactctagcccaggaggcagaggttgcagtgagccagggttgtgccactgtgctccagcctggtcaacagaatgagactctgtcttcaacaacaagaacaacaaagaaccacctcgttgtattcttaaataagtttaaatcctgaagcgccagttggcgttattgatgttttaggagtgcaggaatgggtgaggtcccaggcttgctttagatagtgataattagcactgactgccacgctgtttttaggaggccttaaccaatgtttcccttctttctccttctcaaatggctgcttcctgacctccgcctcctgctccaggatttgcgcaagcaggtagcgccgctgctgaagagtttccaaggagaggtaagcttttctattcattttctatcctgagccacccttcgtggctaattggtctttttattcacattaaagaaatgctccgggcaaaaggtgctgcccagatggtgccttcccggctgctccgacccagcgtcatgcagattttgcgctctgtgatgtaattttccattgggtccttggtgaaagccctcctggaaaaggaagctatgctcagaatacacagagctgtggtggattgccagcagaagtgccccgtgtgtggttgcaacaggcaggttgttggcgctacggccttcaggagcccatgcatcccctctaggaagtcgccttgtccccctgagctggtctggggctgccactgccatgagtgtgtgccataagtgtggtgctttgctgagaggctggcgggggcacagggaggccacttgatcacaggcttgaaacacagagcatctagcagaagccacgaggagcaagcctaggctcagtagaaggaagtggtttctaacggatccttccagagaaggacggagccatctggcagacggcacgtgggtggcaagtcacctgggacatccgccctggctacctgttagcgggaacagcagccatagaggggactgggctccacgtgagtgacactctttgccagccctttgtgtgaagattcagtgatgtttagaaaaccagaaattatattattcttgcggatttattgaatctcacctctttagcttctcccgacggaaaaacagaaagtggaatcatagcaggctgataaggaaaggaaacgagacatttccaaagcccctgaaagagcccatattggtacagtcttagggatttttttttttttttttttttggcgacagagtcttgccctgtcactcaggctacagtccagtggtgcaatctagtctcactgcaacctccgtctcccaggttcaagtgattctcctgtctcagcctccccagcaaatgagattgcaggtgtgcaccaccacacccagctaatttctctatttttagtagagatgcagtttcaccatgttggccaggctggtctcgatctcctgacctcaggtgatccacctgctttgacctcccaaagtgctgggattacagatgtgagccactgtgcctggcagggattttattttcttgcaactgctaagtcacagggaacacatgggggaagggacaggagagatatggccgtgagatacaggagagatatggccgtgagatacagtaggttcctcttgggacacaggtgatgtgggccttatatatggaaggctgggttcctggtcccagagctctagagcaagttgtcgggcttccatttgggaaattcatcaactgggagcgagagcagggagtgagtgaatgaaggaggccagggcgattgtagccaaagacagagaggcgatttcaggacatcaaaagggaccagcgtagaaagaagacacagcagttggtgatggctggaaattttcgagggcagaacagtacccctctcttcttatgatcttcttcctgcctcattcagcccccatgcacgtagcttggtccggccagcaggacacctgcatcccagggcttggatggacttgaacagtctttttctcagaacttcatctccaagcccgtagttgatgagtgaggctgttacctgacacctacccacatttgatcttacctgttctgttacctgtccagcggcttttgggagacccactggcttcctagttctctcgctcaaagagttcagtgtgctttctaggtgtttgcttgtttttctttcttattgaaaaatttcaaagctgtgtaaaaatggaaagattagtacagtgaatacctgtatgcttttttttttttttgagacagattttcactcttgttgcccaggctggagtgcaatggcacaatctcagctcgctgcaacctccgcctcctggatttaagcaattctcctgcctcagcctcccaagtagctgggattacaggcatgtgccaccacgctcagctgagttttgtatttttagtagagacggggtttcatcatactggtcaggctggtctctcattcctgacctcaggtgatccgcccgcttcgacctcccaaagtgctgggattacaggcgtgagccactgcgcccggcccacctatatgctctttacccagatccacagttgctaacatttcaccccatgtacctcccccctcccctccccgcccaccacttttgctgaacattcagaagtaagttgcagaagcaggcactgtgtccctcaaacacacgtggaaggctcccgaagttaaggaattattagcattctcctacattaccacaataaccacaaatatcacacctgggaaaattcacagtaattccaggtcatctcatatttgatccaaaatcaaatttttccaattatccccaagatgtcttttataacggccctcctcgcaactgaggtccagtcaggttcacacattacatttggaaatctgtctatctaattttctattttaaaaagtgttttttttttttgagacagggtctcgctcggtaacccaggctgcagtgcagtggtgccatcatggttcactgcagcctccacctcctgggctcagcaatcttcttgccttagcactcccctgcccccaccgccagatagctgggactatacatgtgcaccaccacatccggctaatttatttttatttttagtagagacgaggtttcaatacattgcccaggcttgtatcgacatcccgggctcaagccatcctcccaccttggcttcccagagtgccttgattacagacatgagccactgtacccggcccctgcattatctcttttaatgtaggacatcctctccatctccatcaccttcatttctttttatttttattttttctagacagggtcttgctctgtcccccaggctgggatgaagtggcacaatctcagctcaccacaacctccacctcccaggttcaagcaattcttctgcctcagcctcccaagtagctgggattacaggcatgcaccacctcgcccagctaatttttgtatttttagtagagatgggatttcaccatgttgatcaggctggtctcaaactcctgacctcaagtgatctgcctgcctcagcctcccagagtgagtgctgggattacaggcatgagccaccgcgcctggcctgatttttttgtttgtttgtttgtttgcttttttgaagagtcttagcaaattatcttgtagattagcccacattctcagtaggataatgggtttgattcctgataccttaaatttgaaatacccaagaaacatctaggctaagcttccatttgcctatttttttttaaaggccatatgaaagctaatcataaataaatacataaaattatcatagattttgaacccacaaaagaaaggtaattttttggcaccattaattaatatttatcaagcctccgctaatttataaataaattttattatgtatacttaaggtatacaacatgatgctatgggatacatacagacagtaaaatggttatacggggaagcaaattaacatatgcatcgtctcccttagttactctttttcatgtgtgtggcaggagcagctaagatctcatttagcagaaatccctcatattgcaattatatttactatagtccttgtttgcacattaaatctctagacactcccagcatcatccctcccaaaatgtgacatttatattaaataatttgtacttttttttttttttgagatggggtctggctctatcacccagggtggagagcagggtggcatgatctcggctcactgcaacctctgcctccctggctcaagcgatttgcccacctcagcctcccaagtagctaggaccacaggctcttgccaccatgcctgcctaaatttttgtattttttggtagaggtgggagtttcaccatgttggccaggctggtcttgaactcctgagctccagtgatccgcccgcctcagcctcccagagggctgggattacaggcatgggccaccacgcctggcctggaagtggtttttaaaatattttacttccatcctttcattatgatgtgttcctattaaaaaggtgatcatgtgtggaatcccagcagtttgggaggacaaggcaggaggatcgcttgagcccaggagatcgagaccagcctggtcaatatagtgagaccccgtctcagtctcatgcctataatcccagcactttgggaggctgaggcgggtggatcacctgaggtcaagagttcgagaccagcctggccaacatgatgaaaccccgtctaatagactaaacatacaaaaattaggcgggcatgatggcatgtgcctgtaatcacagctacctgggaggctgaggcatgagaatcagttgaactcgggaggcagaggttgcagtgagccaagcactctagagccactgtactctagcctgggtgacagagtgagactccgtctaaataaataaataaataaataaataaaagtttcagataatgaaatgattacttataattattataacaaaatcataaaatgtaactcacactgaaattagatatcgattgattgattatgatacctaattttgggtgtttcacaagcccagcaaattgatgggtggtgtgggggaggtgtacccttaatatgaagtccaatttaaagcttattctagcccaacaatttagacaatccctttagtaaagtaatgcacataccctctaggaaaatgctgtctttccactagtctggccaatccttgcttctctccctgagaaggggcgtgttatggaaggttgaggggatgaggggctggctcagagaacctcttggtagtgggggacaagtgtcctcagggaggaaaatcctcttaagaaataacttgagtgctcgtattagagaataaatgaaaaacaatctatgaactaagcatcggctttataaaattacagtaggctggtatgatggctcacgcctgtagtcccagcactttgggaggccaagccaggaggatcatctgaggccaggagtttgagaccagcctggcctaacctagcaagactccatctcaattaaataaataaacaaacaaataaatgtacaacagaataagttcaaatagaatgaaagaaatgacaaatataataataaacataagaatagaaatgaatgaaaaaaacaaagagccaggagagaaacattgcaaaagtcatttatttgaaaataccactgcaactgacaaaccactgtactcatcaagacaaaaaatgttaggaataaaattggggatgacattgcagctgctgcagagattaaaaagataaagggaatgttataagcaactttctgccaataaatactgaagtcgaaaaagttccaaaattctgtaactaccaaaattgattaaagaagaaacagacaacttgaatagctttgtaactattactgaaatatttccataaggtctagacagtttccaagagagttttatcaatcattcatgaaatagagagttctcatacttagcagactccttcagaaaatagaaagagcgagcacttcttaactccttttatgaggctaatataaccttgataccaaaacaagacaagaacagtacaagaaaggaaaattaaaagtcagtcttattggccacgcatggtggcttacgtctctaatctcagcactttgggaggctgaggcaggcagatcactcgaggttgggagatcgagaccagcctggccaacatggtgcaaccccatctctactaaaaatataaaaattagccgggagtggtggcaggcacctgtaatcccggctacttgggaggctgaggcaggagaatcgcttaaacccagcaggcggaggttgcggtgagctgagatcatgccactggactccagcccaggtgacagagcgagactccatctcaaaaaaaaaaaaaaaaaaaaaagtcagtcttattattgaataaatacacagaagtcttttcaaaggtattagtaaattaagtccatcaagcttggtatatcccaagaaggctgttttgtttaaaatgttcaaaacttattaacataaatccatgtcattagcagattaaaggaggaaacaatttcagtagttatatgaaaagattttgataaaatttaaatccattcatgattaaaaactaccaacaggctaggcatggtggtcaggagtttgagaccagcctggacaatgtggtggaaccctgtctctactaaaaatacaaaaacaggccgggcactgtggctcacacctgtaatcccagcactttgggaggccgaggtgggcggatcacaagttcaggagatcgagaccatcctggccaacatggtgaaaccccagctctactaaaaatacaaaaattagctggacgtggtggcatatgcccgtaatcctagctactcagaaggctgaggcaggagaatcacttgaaccagtgagtcagaggttgcagtgagccgggatcgtgccactgcactccagcctggtgacagagagagactccgtctcaaaaaaaaaaaaaaaaatacaaaaacaaaaaattagctgggtgtggtgggtgcaggcctgtacacctagctatgcaggaggctgaagcaggagaatcacttgaacccaggaggcagaggttacagtgagccgagatcgcgccaccgcactctagcctgggcaacagatcaagattccatctcaaaaacaaacaaacaaacaaaaaaccctactaacaaactaggaatagagggaaacatcttaggaatagagggaaacttctttaatgtggtaaaaggtatttatcagaaacatacattaatcatcagacccagtggtggtaaaaaaaaaaaaaaaaaaaattcccagaaaaccaggaacaagacaagaatacctactattgctactttaattaacactgtactgcaaatcttagctagcagagaagacaaaaagaaataaagtacagatagctcttgacttacgatggtgcaactttaggatgatgcaaagaaactgtactttgagtacccatacaaccatgccgtttgtcagtttcagtacagtattcaataaattacatgagctggtgaatacctgatgataaaataggctttgtcttggataattttccccaactataagctaatgtaagtcttctgaatatatttaaagtaggctaagctaagctatgatgtttgccaggttagtttattaaatacatttttgactataatattttcagcctacagtataagtattgcaacagaagaaatcaaactgtcatttttcaagtgagcctcaattatttaaccaggttactagatacaaaatcaatatacaaaagtaattatatacccctgtatcagcagcaaacttaaaaagtcatttttaaaaaggatactactggagatagccagccaaaaaaaaaaaaaaaaaactatagctagaaatgaatgtaacaatacaagggaaatctttctagagaaagatgtaacatttatattgaaggatattaaaggagagttaaatggagagagagaaagtatacaaggagagaaatttccactactattgaagcgatcacttttctccagattgatcacagaatcagtcattgtagttccagtaaaaatcccaacaaaattttttttgttttgagacagagtctcgctctgtcacccaggctggaatacagtggcaccatttcagctcactgcaacctccacctcccggattcaaggttatctcctatttgatctaaaatcaaatttttctggttatccctaagatttcttttgtaacggccctccctgcagctgaggtccaatcaggttcacatattacatttgtgtaatcccaagtagctgggattacaggcgcctgccaccacacccagctaatttttgtgtttttagtaaagacggtttcgccaggctggtctcaaactcctgacctcaggcgatcagactgcctctgcctcccaaagtgctgggattacagtcatgagccaccgagcccggccccagcaagaatcttaatgaaacttttgaaaagctgattccagaatttttatacatatgcaagaacaaatggtaaataatagtgaagataatactgaaccactccaagttagaggaattgccctaccagattattaaagctgcagtagttggcagagaatgagataaataaaccaaaggaacacaataaagaaatcagaatctggccgagcgcgttggctcttacccgtaatcccagcactttgggaggccaaggcaggaggatcacttgaggtcaggagttccatacaccagcctgaccaatatggtgaaacttcgtctctactaaaaatacaaaaatcagcctggtgtggtcacgtgctcctgtagtcccagctacttgaaaggctgaggcaggagaattgcttgaacccgggaagcagaggtagcagtgagccgagattgtgccactgcagtccagcctggcccacagagtgagactccatctcaaaaaaacaagcaaacaaacaaaaaaaaaaaaaaacaccggaatctggcctatgcatatatatagaagctgaataaattgcaaagatggtatggatcagtgaggaaaggggggacttttcatggtcctctgacgattggcaaatccttatagattaaacgaagttgagaccgagtgcactggctgctatctgtaatcccagcactttgggaggctgaagcaagcagttcccttgagccctcgtgttagagactaacctgggcaacatggtgaaaccctgtctgtacaaaaacttacaaaaattagctgggtgtgatggcacacgcctgtagtcccagccacttggaaggctgaggtgggatgattgcttgagcccacaagttggagacttcagtgagctgttgatcgcgtgccactgcactacagcctggctgacagagcaagatcctgtctcaaacagacaggcaaacaattaactagagttggagccctaccttacaccgtgtggaaacacaaattacaaggagagtcttagatcaaagctttaaactttatagaataaaatataaaagatgatgactttgggctgggtagaatttctttcttttcttttctttttttttttttttgagacggagttttgttcttgttgcccaggctggaatgcaatggcacgatcttggctcaccacaacctctgcctcccgggttcaagtgattctcctgcctcagcctccagagtagctgggattacaagcatgcgccaccacgcccagctaattttgtatttttagtagagacagggtttctctgtgttggtcaggctggtctcgaactcccaacctcatgtgatccacccacctcggcttcccaaaatgctgggattacaggtgtgagccaccacgcccggccctgggctgggtagaatttcttaaacagaaaaccataaaagagattgttgcagtaaactaccttaaaatttttaaataggagcttttttcatggaaagataccctaaagaaagtggaaacatggccgggtgtggtggctcatgcctgtaatctcagcactttgggaggctgaggcaggcggatcacttgatgtcaggagtttgagaccagtctgggcaacatggtgaaaccctatctctgctgaaaatacaaaacttagctgggcatggtggcacatgcctgtagtctcagctactcgggagactgaggcacgagagttgcttgaacctgggaggtggaggctgcagtgagctgaaagcattgcagtccagcctgggcgacagagtgagactctgtctcaaaaaaaaaaaaagcagaaagataaggccagtacactgctagctccatggtatgttcatgtgaactagaaaaaaggtttgccgttctcaatacttttcacatcacctgttggaaacttgccataataaagattcatacttacctcagtgtttaccgtgatagattcagacatccagaatgtgaagcatactgtctagggctgtgcatcccaccgttgtatgtggggtaaccttggccatgatttacaaatctggaagaggtagttgtcacacctgtaattaacaatgttcacaagatattcaaaatgctcgcatgtcaatggggggagaaacccagtaaggaaatgagtacaagtcatgagcataattgtcagaacattggaatggtcagtagctatatgaaaagatgtctaggttgcataataaccagggatatgcagattaaaataactcatctgcaagttattcctcctgaccaagttggctaaaattaaaaagtcaagttaggagcataagttgatttaaactttttgaaagccaatttggcatctggtgataaagactcacctgtaccttgacgcggcagtttcactcctaaatatatacgctaaagaaacaagcatggcgggtgcggtggctcatgcctgtcatcctagtactttggcaggcagaggtgggagtggcgcttgagcccagaagtttgagaccagctgagcaacatagtgagacctccatcttgacaaaaaaatttaaaaagttacccaagcatggtggcacatgcctgtagtcccagctactcaggaggctgaggcaggaggatcacttgagcctgggagttggaggctttgatagcaacactgcaccccagcctaggagacagagccagaccctattttaaaagaaaattaaatagataaataaacttatttgccctggaaaaccagttcagaaattttgaaaatagttaacatatgaaaacaacccagccggccatcaacaggaaaaagaatatgataaaactttgttgtaacaaaagattaataaagaaaagcatatggatttatttgctgaaagttacgagctctgtatacccagggcctctccttcacgagcactaaataagtgtttattggatgggtggatggaagcatcgtcctcatcttacagataaaaggactaaacccgagagaggattccaagtcacacaggtcataatggcaggactggcctcgatcctggggccgtctggcatcccagaagtgctaaggttggtgtgctctgatactgcttgagcggggaggaagcagtgccttcagcccctccctgatctcagccaacctttccagtctttgactgacactttgagaggccgagacaggcggctcacttgagcctgggagctccagaccagccttggcaacgtagtgaaactccatctctacaaaaaaatgcaaacgttagccaagtgcggtatcatacacctgtagtcccagctacttgggaggctgatttgggaggatcatttgagcccaggaggttgaggctgcagtaacctatgatcacactgttgcactccagtctgggcaacagagcgagaccctgtctctatttcaaaaaaaaaaaaaaaaaaagattgatgttcatcttgcatacagtgctctgcaaaccctgcctgaagcccccttcccttctaaccagcccctcctagacaaattctggagcttggtgcattgtctcgtgtacatccataactgtgtccatgcgctttgctacaaccacgatctgcatcgttggaaggagtggagcccaggttaactgtgaatttcatcacagtatcacctgctgacatggcctgagggagggaccaaggaatgatctgaaacttccctttgtgctgaatgtctcccttacatgcagcgcgctggccacgttcagagctgcatgcaggacgtgctctcggaggctgggttttactctctggtcttcattcaacgcaaccttttcgggagcctcctgcttccagctatgggccaaacagttgctaaagatgtctcattgaatacagtcaactaggatcctgctattctaatgaagggaaactgatgataaacacaaaaggcaatgttagatggcgccaggcactgcgagggagacacactgggtcttggggtagagcgggaagaggtggtagtgacttcttcagtcatccagggaggcctctccagggaggatgacggaacatcagaggaaagaagcaaggagaaccagccacactcagagctgggaaagagcagcaggaagatgggggcagtgagtgccagggctctgcagggatgggcttgcctggcagggagcaataccaaggaagttagtagggcccgggtcatgccagggccttgtaggcagaacccttaagtctctttgtagggaccctttggtctcccctttgaactaggccctttcaaagacgtacagtagaaagcaaattccccatgggcaccggcaggatgatttgacagattctaatcaaataattggggaaataaagttgggtgaactacagcagtctatgaatgagttaaaagtgactacgagtctgctgcccatcttgcagcccatatctgttgagctgtaacatatttaagcattcagatctaaaggccattgctaaataaagccagggcgtccatgtggttcgctccaaagagcatttcacagggagccagtccaggcgctgccgcccaccacctctgtgaccttgggtgagtctcggggcctctttctgcccgactttgctcatctgtaaaacgagtgggttacccagatcctcccccaaggagctccgtagctctgaaacctcatgagactcactggagcagtactttggttgactatcgctagcagaaccgaaaaggacattctccagcaatgtaaatctgttcaaaaatgggatgagctggctgggcacagtggctcatgcctgtaataccagcactttgggaggctgaggcgggtggatcacaaggtcaggagttcaagaccagcctggccaacatagtgaaaccctgtctctactaaaaatacaaaaaaaaaacaaaaataaaaaaattagccaggcatggtggtggcaccagctacttgggaggttgaaacaggagaattgcttggacgaccacctgccagggagattgtcacctcttatccattctttttttttttttttttttttttttttgaaatagagtctctctgtgtcacccaggctggagtgcagtggctcaccataatctctgcttcctgggttcaagcgattctcctgccttagcctcctgagtagctgggatttcaggtgtgcgccaccatgtccggctaattttgtattattagaagagatggggttttaccatgttgttcaggctggtcttgaactcctggcctcaagtgatcaacccgccttggcctcccgaaatgctgagattacaagcatgagccaccatgcccttgccttatccatccttctaaatgccagatcctccaagtcttcccaaaatacccagccagaaacagattcttcctcttctcatctctaatagggcttcatttatatctcccttttgattttttttttttttttttttgagatggagtcttgttctgtcacccaggctggagtgcagtggatgatctcggctcactgcaacctccacctcccgggttcaagcgattctcctgcctcagcctcccaagtagctgggactacaggtgcacaccactatgcctggctaattttttgtatttttagtagagacgggattttgccatgttggccaggctggtgtcaaactcctagctcaggtgatccgcctagtggttaggatttggcgctatctctcccttttggttttgagcctaaagacattctgcccttatagtttgcttaccaaggccttatgcttctaaaatgtagaagggaggatgtgtgtgtgagtgtgagtgagtgtgtgagtgtgtgtgtgtgtgtatgtgtctttgtacctgtttctgtccccatcttaccagtacttgcctaaatactgcattaagcatcatgggtgaaataggattagagaaggttggaccagatcagtggctcccaaagctgctgctgggttggaccagtgctgcactggccctatgagaattgctcacatgtttccagaaatacagctccccaggctcctaccctgacattccggtgtagaaggcctggggtggaaccttagaatctgtcatttttcaaagcccacctctgatgctcatgcactgctagttgtaggaaccactgggctcggttccctgaaagagctctttctcctggtaacaagttctgtgactctctctgcccactcagtcttcttagattggcatgttagaagctccatgacttgcctttgaaatatttttccagcttcaaagtcctggacttctactctggccgaactggcctgtgtattatgagtcacctgaacatactttttgatttcctgaaggctctgttattgttaagacccttttgctgttccctacctataaaactcatttccatcctttagggctgaaccgaaaagtctatctcctttgatcattttcctgaccatctcaacctatttctaactttttccctctttttttatcctcagctctattaaagtatcattaacaaagaaaagttgtatatatttatagtgtataatgtgatggtttggggtttttattttttgagacaggatctccctctgtcacccaggctggagtgcagtggcataatcagggctcactgcagccttgacctcccgggctcaagcaatcttcctgcttcagcctcccaagcagttaggactataggctcctggccaggctaattttatattttttcgattttagtaaagccgaagtctggctgcgttgcccaggctggtcttgaactccagcagcacagtctcagctcactgcaacctccacctcctgggttcaagcctcagcctcctgattagcagggactgtggacgtgtgccaccacgcctggctaatttttttattttttgtagagacgaggttttgccacgttggctaggctggtcttgaactcctgacctcaagcgatcctcccacctcattctcccaaagtggtgggattacaggcgtgatccaccacacccagcccaatgtgatgttttgatacatgcatacattacgaagtgatttccacaatctgacaacatacccattagctcactgtgtgtgtgtgtgtgtgtgtgtgtgtgtgtgtgtgtgtgtgtgtgttgagaacacttgagatctactgccttagcaaatgtcatatatatgattacaagattattaactatagtcaccatgctgtaccttggaaaagaaaacctacttttcttgcttaagtaaaacttttacccttttcaaggactgggggaccttgagtatgtgcagattttggtacacgcagggggtcctagcaccaatctcctgcgtgtaccaagggatgaccgtgtgtatagaaaatcacatgtttattacccatgtatttgttgttggatgcttagtctgtttccatatctttctattgtaaatagtgccgcagtatacatgagtgtgcagataactcttaacaatactgatttcaatccctttgtggtgttgctggatcgtattaattttggggggaacctccgtactgtttcccataatggctgtaccaatttacattcccaccaacagtgtacaaagatgcccatttctccatgtctcactagcactcgtgtgtctttttggtaatagcccttctaacaggtatcaggtgatacctcatcgtggttttgagtcaaattttccagatgattaaagatgttgagcagcttttcatatacctgtcagccgtttgcatgtctttttttagagagagacagggtctcactctgttgtgcagactggcgtgcggtggtgcgatcatggctcactgtagccttgaactcctggcctcaggtgatcctcctgtcttggcctcccaaagtttttgggattacgtgagccactgcgccaggccttatgtgttttcttttgagatccttagcccattttccgtttttttgttttttttggaaagagtcttgctctgtcgcccaggctggagaggctggagtgcagtggtgccatcttggctcactgcaacctccacctcctaggttccagcgattctcctgcctcagcctcccaagtagctggggttacaggtgtgtgccaccacacccagcaaatttttgtatttttagtagagatggggtttcactatgttgtccaggctggtctcgaactcctgacctcaggtgatctgcctgccttggcctcccaaagtgccgggattacaggtgtgagccactgcgcccggccaccttagcccattttctaaacagggtgcctgttttcttgttattgcattaacttttcccctctttccagcctgctcttaagattgtacatgctttgagggcccgtatcttgtcttagatgctttatctattctttgccttatggaagtggttacataaaacattcttagctgaatttccccctgcttctcgccttctccttgttaatgagtacttattgagtgtgatgtgcgagcatctactttggttcctagacgcccacaagcaaaataggtcagtgccctgctgggagtagggaggggttgtcagggtcttctttgggtttgtggccagacaggcgactgtggagcagaccaggcactctggggacaggatgatgcgttctggctggaagatacagggaggcttcccagggaccctaacacagcctgctgccctggacctttgctggggaactgacttctcagccagtatgtctgtccgcaggctcttgggccttctgcagtggtggaggtgacagtggtgttagccgtggtggtcactgtggtgatgtggctgctgtactgtcattatcttatggcaaaacccgcaagcctgacacacacagtgtctccctgtaagttcgcgccatgatggctcaattagggacccgtcggactgcggctcaacatccaggccagctgcataattgaaagcacattttctcctccaaagctgcagctggtttggttctgctcatgcagaaagggatctaaccttgcataacataggaaatgaacagttgagagagaagccaaattcaatttcagtcagatatgttgaggctaagtccatgatctatggaagccggggcaggagccgtgcgcctgtggaaaggggcgctctcagcagtctattaatcacggccgcccgcccggcgctgccgccactgccgggtgccactgcgcccgcgcgccccctccgatgtgggctggagcgcagccaagcactccagaagttaacctcttaaagacccggagctgctttctgttgaataaatgtaattttgtggtcagaaataaatgcttgtgatatagcaggagctttgaaaacaacggcaagctggagcgattacaaattgctccatgttgtacaagtcaacagcagacatcaaaattccacgtggagggcaaattgatttcggcccagagctctgcagctattcaataaaagtcctattaaaccattgtatgtaatgaacaatccagagcaaatctaatattttcagtggataattatttttaacatcctctcggtaactgctggtagatttcttggatgtttacagctcgaactcgggcagagtgggccttcccagctgtcatttggcatctccgccaggggacccgctccagggacccagctgcgtacatggctcctgaacatggggctctggccttggggttcaggttgccaaggaagggtgcatggggtttctgaatctcccagtgcctgggatgtagtaggtgcctgggaaatgtttgttgaattgagctgaactgagttgaaatgcacaagaggaagctctaagaaccccagaatgacttaggaaaatgatattgtggcaaagttgactcaaaacctgaggctgaagagaccagtgggttgcaggtaaggaaattgaggtcccttgtgatagaccaatgtcagcccctatgggagtcgggacagagctggcaccccgggaaaccccaggacttacccaattcacttcccgtttttggagatggactcttgctttgtcacccaggctggagtgtagggatgcgattgcagctcactgccacctccgcctcccaggttcaagtgattctcctgcctcagcctctgaagtagctgggattacaggcacgcaccaccacacctggctaatttttatatgtttagtagagacagggtttcgtcacgttagccaggctggtctcgaactcctcacttcaagtgatccacctgcctcagtctccctaactgctgggattacaggcgtaagccactgtgcccagcccccatttcactcctgttctgttttggtttggtttggatttttttttttttttttttttttttttgagacagtctcactctgtcacccaggctggagtgcagttgcacgatcacagctcactgcagcctggacctcctgggctcaagcagccctccagcctcagcctcctgagtggctgggactacaggtacacaccactacacccagctaatttttgcattttttttttgaagagatgagggcttgctacgttgcccaagacggtcttgaactcctggcctcaagcagtcctcccacaaaggcctcccaaagtgttgggattacaggcatgagccaccacacccagctcacttctgttcttgacagcttgcgaagtgcattctttgtcagggaggccacactgggagagtcgccaaagcgatcttgttgctcatctagtgttcccacccccaggatgctcccctaccttgctcatgacagggctgtaaccctgtccccttccagaccaagagcttctcagggaaggtctgttcattcattgattcattaaatatttgtggagcatgtatgccaggctagaccagaactagaccctggttagtggtggtaggtgaatgaatgtagccgttgccttcatgaagcttaacagtttagcaagatctgtatccccatgtggcacagtgcttggcgctctgttaagtgatggtggatgggtggatggattggtggatgaatgggtggatggtgggtgtgtgggtggatggatgatttgttagataaatgggaatggatagatggttgattgcatggagggagggtgaataggggatagatggatggatgattggatagaaggatggatggatagatgattggatagagggatggatggctggatgattggataaagggatagatggatgggtgataggatagagctatggatggatgaagggagagatggagggagggagggaaggagggagggagagatggatggatggataactggatagagggatggatggatgattagtctagaggtagggagggagggagggatggatggatggatggatgattagaaagcagtatgtgtctgtaagaatagattgactcttactcattttcgtctcctggagtaaaatcatccaacttgtaatgctcagtcatacagtatttatttgactatcgtggaatttaaatttctagggtattttattttctgcagatctcccttcccttggaaaaactcaatatggatgttaattaggttttactaaagttccatcaatttaatgcagtcgttctttaaatgaaactgacaccaaggaccacatggccaaaggaagcccacgttcctgtgtgtggttctgaggagggagcataggatgcagtttgataacagctgagagccctgaggagtttgttgctggatgtggagtattccatgtctcgtccctcccccagtctttttccagttgtgtcacaactccctttgctaataatattttgcacagcattttacgtctacaaagcaccatttccatgatgtcgctcacccttcgacaccaccctgtgctgggggcatcatcatcattctgagttaccaacaggaggggtagcagacagtccaaggggcaaggcagggactcccagctccaggctccagcctctcctcccctccaccctctcctggtcctgtcctgaaatctttggctcccttgaaacttgttatgcccgggcaaatgccaccctcgtgccactgtattcccaccacctccaatgagtgtcccccacctgatggggtcacacacttgtccagccacctgcacagaaaagcctcatggacacagccctgtgaggtcagaaatagaccgaacagggtcactcggttggaaggcgtggtagtgttagaacccaggtgtttgaactcggtctaatattcattccactctttcacacacacgtaagggcacatgaccactattaatcaaattttcaaaaaaaaatcagctgggcacaatggctcatgcctgtaatcccagcaatttgggaggccaaggcgggtggattacctgaggtcaggagtttgagaccagcctggccagcatggtgaaaccccgtctctactaaaaatacaaaaattagctatgcatggtggcacacgcctgtcatcccagctactcgagaggctgaggcaggggaatcacttgaacctgggaggcagaggttgccatgaactgagattgcgccactgcactccagcctgggcaacagagcgagactccatctcaaaaataaataaataaagggaatttgacataaaatcgttaatgttgactgtttcagcctgggtgacagagcgagactctatctcaaaaaaacaaacaaacaaacatgagctccatgtctgtttcatctgttcccctctaagtataaacttcctgagccttctaagtccagccaggtgggccagcggtcaccgagatccttcctcgctgggggatggaataggcctcccctgctttgctgctgttctttggccttgtcccctgcctcttttcttggaccacctacaaggacctagggggacacagtactgggggcaggagctgggaaaggcctgccatggttcactgatagtaagaaatagagactcactcggagaaatttcctctgaaatacagcagactcagcgcagccctttgggcagatgaaggaggctgagaagagcatcccttcagcaacagctgcgtgccagaagcttcgttccgttctgccatttcatctgcacagcagctcagcccggaggggagaggagtaaatgggcccagagagatcaagtaacttccttggagcttgtcagccttgagctgaaacttggactctgatgtcgaactccgaagcccatgcttattctgtaaagcctgaagagtgtcttataattgatttagaagtaggagaagagggggaacctgtgagattacactgtcttccagcataacaagaaaagagaaaccagttggatgcggtggctcacacctgtaatcccaggtgtgatggagaggccgaggcaggaggatcacttgagcccaggagtttgagtccagctggggcaacatagtgagatcccatctctaccaaaaaaaacaaaaacaaaaaaagaaaaacggaaacccatgaaatgatccatgggtacataggaagggagagaaactggttcctagggctgtgggaggaatgaccgcaggcctgccctgggaaaaagctttgcttttcagggagccccttgatgtttggggacttaggagagcaagtctggccctgagatgtgggaccaggcatccccacagagcacacatcagcagataagggctgccgctctaggaacagtcttgtcccagcgcaggcacgaggagggctcaggaatctggctgggagcattcctgccgtccctactgaggagctgccactgtggaccagaacacccccctgataggagcagactcccggggtgtagacactgcttcccttttcacaccgtctcctgaattttctcctgggttcctgcttaaaggagcggagaaaaccaaactgacaaatcactgatcttggagtcagatctggatttgaatcctgacatcatcatttgccagcgtgaccttgaatatctcatgtccgcttctctgtcccatccatataacaggaaatctctctcgcagagcagcgacgttatatgcacatgtttaaagatgatggcataaaagcagtgctggatgggagctggtagctagttattgattataggatcctctaggtcctttaacttcttcaatagccgtagtccccaggatttaaccttctggggctttccctgtatctctgtcccatccacactccagagtaacctcatctgggccgtttggggctggtggttccaaatttttgcctctggcctgggcccgtcatccaacgccaggcctccctggggctcccactgtgggtacctcgctaactaataatcttcatttcccatgtaaacacaggcacctgcgtatgccccatttcgggagaggtaaccagcccctagttgccctggccagaactctgggagaagctatgttcagtattagaccctgtgaattctttttattattattattattattattattatttactgttgtgttgggctctcgctctgctgcccaggctggagtgcatttgtgtgatcatagctcactgcagcctcaaattcccgggctcaagtgatcctcccgcctcaacctctcgagtagctgggactatgggcacatgccaccactccctgctaagaccctgtgaattctatttccctaacctcgctggaatcagctccctccttcccagcagttggctttctccctctctttcctggtctggtctgtctaccaccagttgccatcctgtcctgagtgatcgcttcatttcccaccctgattgacatcctcagggattccccttcagcataagctgcccccaccccgggcgtggtcccttgcacctccctccacaggctggcccctgcctgcctcctcacctcacgtatccccagtcacctcctctgctccaaggcacggcaggtccctgcccttctctgagcaggccactttgtttgaacacgtctctgtgtctttgaatagccctcctctccccactgaagccttctgcctcccaccacgaataaagatgatctttgtcttctttaaaacttgccctaagtttgcaaaacacaggatgtagagcagcatctaatagactatcatttgtgtttgaaaaaaaaaaaaatagggccgggcgcagtggctcatgcctgtaatcccaacactttgagagactgacgcgggcgtatcacctgagctcaggagtttgagaccagcctggccaacatgttgaaagcccgtctttaccaaaatacagaaaattagccaggcatgatggtgcgcaactgtagtcccagctacttagggtaggaaaatcagaggcagcagaatcgtttgaacctgggaggcagaggttgcagtgagccaagatcgtgcctctgcactccagcctgggtgacagagcgagactctgtctcaaaaaaaaaaaaaaaggaacacagtgcatgtctataggtgcttgtaaatgcataaatacctctgggaggatgcccaagactatctttacctccagaccaggcagctggatgacaggtggatgtggatgggaggaagacctacttttcactgtcaactttgttttcgctttgcttttctttttacaattaaatgacttttagtgtattcaccaagtcatgcagccatcaccctaattccagaacattttcgtcagctcaaaaagaaacctcatactggccgggcgcggtggctcacatctgtaatcccagcactttgggaggccaagtcaggcaggtcacttgaggtcaggagtttgagaacagcctggccaacatggcgaaaccccgtctctactaaaaaaacgaagtacaaaaaaattagccaagcgtggtggtgggcgcctgtaatcccagctactcaggagactgaggcaggagaatcacttgaacctgggaggcagaggttgcagtaagccgagattgcaccactgcactccagcctgggtaacagagtgagactccatctaaaaagaaagaaagaaacgtaatacccattagtggtcactcctcatttatcccaaccccaacccttggcaaccatgaatcccccttctgtagatttggccattccccccatgtctctgtagatttggccattcttaacatttcatatcaatgagatcaaataatatattagttttttgttcccggcttcttttacttaaccatggtttcgatattcatctatgctgtagcatataccagtacttgctttcattctttttatggctgaataatattccattgtatggatgtcccatgttttatttatccaattatcagctgatggccatttggagttttgtttccccactttttggctattatgaataatgcttctatgaacatccatatacataagtttttgtgcaggtaaacacttttgtctttcttgcctacctaggagtagaattgctgagtaatagggtaactctatttttaacattttgaggaatggccaaactgttttccaaggtggctgtgtaattttacatttctgtcagcaatgtaggagggttccagttcagtttctcgacatcctttctaacacttagtatcatcttttttttgggagacagggtctcgctctcttgcccaggctggaatgcggtagtgtgatctcggctcagtgcaacctctgcctcgcaggttcaagcgattctcctgcctcggcctcctgagtagctgggattacaggcacgtgccaccatgcccagctaatttttttgtatttttagtggagacagggtttcaccatgttggccaggctggtctcgaactcctgacctcaggtgatctgcccgcctcggcctcctaaagtgctgggattataggcgtgagccaccgcagccggccccattatatgtctttttgatgctagtcatcccagtggatgttgtggtatctcattgtggttttgatttgcatttccctaatgagtattggcattgagcatcttttcatgtgcctattggccatttgtatctttggagaaacatctattcatatcctttgcccatattctaattcagttacttttattaaatatttttaatttttgtggggatgtatatatatatttatggggtggagcacatgagatgttttgatacaggcatgctacgtgtaataatctcatatggaaatggagtatccatcacctgaagcatttatcctttgtgttacaaataatccgattatacttctttaattgcttttaaatgtacaattaagttattgactgtaatcaccctgtcgtgctatcaaataataggtcttaattcattcctcctggcttttttggtacccattaaccataccacctttccagccccactacccctcccagcctctggtaaccatccttctactttctatgtccaagagttaaaaattgtttttatgtttatatcccacaaatatgtcagaatatgagatgtttgtctttctatgcctggctaattgtttttttatttaatgagttgtaagagggcttatatattctggagtatcttttcaaaacttccattctgtgggttgtcttctcacttttttttttttttttttttttgagacagagtctcaccctgttgcccagggtggctgcagtgtcacgatctcggctcactgcaacctgtgcctcccaggtttgagccattctcctgcctcagactcctgagtagctgggatcacagttgtgtgtgccaccatgcccagctaatttttgtatttttagtagaaacagagtttcgccatgttggccaggctggtcccgaactcctgacctcaggtgatccacctgcctcagcctcccaaagtgctgggattacaggtgtaagccactgcacccagcctctcttttcagtttcttggtagcgtctttagaagcgcagaagttttatatttgatgaaatccaatttgtcgatttttcttctggtatttgtgcttttggcatcatacctaagaaaccattgcctaatccaaggtcataaaggtttacacctgtgttttcttttaagaggttttatagttttagctcatatattttggtctttgatttattttgagttaatttttgcatatggtgtgaggtagggatcaaactttgctcttttgcatgtggatatctggtcgtcccagcaacatttgttgaaacactgttcttttacccttgaattgtcatgtcactcttgtcaaaaatcagttgatcataatatgagggttcctttctgggctgtattgatctgtgtgtttatccttatgcccctaccagttcaggtcaatgtagttttgtatttagtattgaaattgggaagtgtgactcctccaaccttgtttcctttttcaaaattattttggttatttggggtcattgcattttcatatgaatcttagaatcaacttgtcaatttctgcaaagaagccagctgggtctaggcacaggggctcttgtctgtgattctaacactttgggaggccaagacgggaggatcacttgaacctaataattcaagaccagcctggacaatataatgagatctcatctctacaagaaaaaagttaaagattagccaagcatggtggcgcgttcctgtagtctcagttactccggaggctgtggcaggaggatcacttcagcctgggaattggaggttgcagtgagctgaggttgtgacagtgcactccaaccagagtgacagagtgagaccctgtctccaaaaaaaaaaaagccagctggaattttgataggcattaccttgaatgtgtaaatcaacttcgtgactattgccatcttaaaaatattaagtcttccaatccataagcattggccatctttccatttagtttagtgtctttcagcagtgttttgtggtttttagagcacaagttttgtatttcttttgccaaatttattcgtaagtattttatactttttgtgatgctattataaatggattttttttttttactttcactttcagatcatttattgcaaacatgtagaaagacaaatgtttttttacagggatactttgttgcattgagctccacttttttatgctttgaagatagtgtgtttcttcaaaaatggaagtctgtagcaaccctgagtcaaacaagtgtgtcagcattatttttccaactgcaggtgctcacttcctttctctttgtcacactttggtaattcccacaatatttccaattattcactattattatatctgatatggtgatctgcagtcagggagctttgatattactatcataattgtttggggacaccacaaactgtgccccatataagatggcagacttaattgataaatattgtgtgtgttctgactactccaccaaccagctgtttcccatctcttcctgtctttgggtttccctatttcttgagacacaacaatattgaaattaggcaaattaataatcctgcaatggcctattaagtgaaaggaacagtcacatgtctttcactttaagtcaaaagctagaaatgattaagctcagtgagaaaggcgtgttgaaagctgaggtaggttaaaagctggacttcttgcaccagttagcccagtcattagtgcaaaggaaaagttcatcaaggatatgaaaagtgctgctccagtgaacacatgaatgataagaaagccttatttctgatagggagaaaattttggtgatctgcatagacgatcaaaccagccacaacattctcttaagccaaagtctaattctcttaattgggtcttaattgtctcaagccaaagccctgactcttcaattctatgaaggctgacagaggtggggaagctaccgaataaaagttggaagctagcggaggttgattcatgatgtttaaggaaagaatttatctccataatacaaaagtgcaaagtaaagcagcaaatgctttggtggaagctgcagcaagttatccaggagatctagctaagataatcaacgaagatgatggcgctacacaacagattttcaatgtaggtaaaataaccttctcttggaagaagatataatctaggacttgcataggtaaagagaagtcagtgtcttgtctttaaagcttccaaatgcaggccgactctcgttaggggataatgcagctggtgacttgaagttgaagccattgctcatttaccattcggaaaaatcctagggccttcagaattaagctacacctactctgcctgtgcactagaaatggaatcataaagcctagatcacagcatctgtttatagcatgttttactgaatattttaagcacactgttgagacctactgcccagaataaaaaaaggttcttttcttttctgagacagtcttgctcttgtcacccaggctgaagtgcaatggcatgacttcagcacactgcaacctctgcttcccaaattcaagtgattcttctgccttagcctcctgagtagctgggattacaggctcccaccaccatgctcggctactttttgtatttttagaagagatggggtttcactatgttggccaggccagtcttgaactcctgacctcgtgatccgcctgcctcagcctcccaaagtactgggattacaggcatgagccaccacactcggctgataaaaagattttttgttttttgttttttgttttctggttttttttttttgagacagagtctcgctctgtcacccaggctggagtctagtggtgcgatctcggctcactgcaacctctgcctcctgggttcaagtgattctcctgcctcagcctcccgagtagctgggattacaggtgtgtgctaccacgcctggctaattttttgtatttttattagagatggagtttcactgtgttagccaggatggtctcgatctcctgacctcgtgatccgcccgccgcagcctcccaaagtgctgggattacaggcatgagccaccgcgcctagccgaaaggttcttttcaaaatatgactgctcattgacagtgcacctggtcaacaagagctctggtggagatgtacaagatgaatgttgtttccatgcctgctaacacaacctgcattctacagcacatggatcagggagtaattctgacactcaagtcttattttttaagaaatacattttgtaaggctatagctgccatagatggtgattcctctgatagatctaggcaaattaaatagaaatcctttccttctggaaaggagtcaccattttagattccatgaagaacatttgtgattcatgggagggggttgaaatagcaacatgaacaggagtttggaagaaatggattccaaccctcatggatgactttgaggggttcaaggcttcagtggaggaaggaactgcagatgcgggggaaatagcaagagaactagaattagaaatggagcctgaagatgtgactgaattgctgcaacctcatgatcaaacttgaatggatgaggggttgcttcttatgatgagcaaagaaagtggtttcttgagatggaaactactcttggtgaagatgctgtgaatattgttgaaatgacaacaaaggatttagaatattccataaactgagttgataaagcagtgactgggtttgagaggattgactcctattttttaagaagttctactgtgggtaaaaatctatcaaacagcaatgcatgatacacagaaatcttgtgttaacgaaagagtcaatcaagctagccaatttcattgttgccttaacaaattgccacagtcaccccaagcttcagtaaccacaaccctgatcagtctagcagccatccaacaccaaggcaagactctccaccagcaaaaagattacaactccctgaaagctcagataatcgttagcatattttggcaataaagcattttttaattaagatatgtacatttttgagacatagagctattacatacttaatagactatgatacaaacataacttttatattcactggaaaatcaaaaaatttatgtgacttgcttcattgcaatatttgctctttttgtcatatttgccttttttgttctatttttgagacagtctccgtcactcaggctggagtacagtggcacaatctcggctcactgcaacctccacctccagggttcaagcgattctcatgcctcagcctcccgagtagctggaattagcaggcatgtgccactacacctggctaatttttttttttttgtatttttagtagagacagggtttcacgatggtggccaggctggtctcaaactcctgacctcaggtgatctgcctttctcagcctcccaaagtgctaggattacaagtgtgagccaccgtacctggtctgtttttactttcttatggtggtctggaaccaaacctgcattatctttgaggtatacccgtatattgatcttgcattgtgaaagtcttgctgaatgtgtatgtttttatacatctacaatttttttattgtacacatatattatctactcacaacaatggtgatgtgaaaatctcaggtaggcatttatcccctaggaagcctgccccactcccccaccgggatttacccgagggaggtaggagaggggagcattaccccatcttaaactttttgggagcagcagtaggaatctgtgtctcccataggctggaatagaacatagcctagcacatcttagcctccttaaatgactttattgacagaatgaaggaagaagtgaagcgggggtgagcaagcagccagcacctccttcctctgaagagcctgctgcaggcaggtttccctgttgtctaagctgtgatctgctgtcctggagcatttacctgctcatgctggttttgcactgtggggagagagaagacagctaatctttcttccccaagacagcctttcagatagatgttgacagccagaatggcagatgtacttggaagggctttgtaaactcaaggagaatagagatgcttgttgctgtttttatcatcttggcttttaatcttgtgctgtcccctgccacaaatctcctctatggatcccacaccctttctccaagccagcggcttcttcggggcctctctagttttcctcttagaaactttactaagtgggaccgggtacagtggctcacacctgtaatcccagcactttgggaggccaaggcgggtggatcacttgaggtcaggagttcgagaccagcctggccaacgtggtgaaaccccatctactaaaaatacaaaaattagctgggcgtggtggcaggtgcctgtagtcccagctactcgggaggctaaggcaggagaatcacttgaacccgggaggtggaggttgcagtgagctgagatcgtgccacctcactccagcctgagtgacagagtgagacttcatctcaaaaaaaaaaaaaaaaaaaaatttaaaaccctcaagatttggcctgcgtacgtgtctgttttggacagcatccgactcagtcttagctgacttctagtgtttaatgtggcccttcaaaccatgctttgctcttgaaaacattctacagccagacttcgagtgagacaaaactaccctatcatatccctgcagttttgttgatttttattgtcctatagtccgacagagctcatcgatttgaaaattcttttaatggcctgtgtttatttctaaatcattagcttgtaaactcccagggcatagaggctagtggattgttcttgaatatgccgtcttcactgtggtcttaaatgttgcttaggggccaggcgcagtggctcacgcctgtaatcccagcactttgggaggccgaggtgggcggatcatgaggtcaggggatcgagaccatcctggctaacatggtgaaaccctgtctttactaaaaaaatacaaaaaaagtagctgggcgtggtagtgggcgcctgtagtcctagctacttgggaggctcaggcgggagaatggtgtgaacctgggaggcggagcttgcagtgagccgagatcacaccactgcactccagcctgggagacagagcgagactctgtctcaaaaaaaaaaaatgttgcttagggtcctggtcctccaggactttccacatcttggcttcctgcttgatttgatcacgacggggaataacctatggtgtggtggaaagaaaggtgctgactttggatttattagcgaaggttagtgctgttgacccggtttctatccagatggtgtcagatacttaatgtaggaggttcccacatttataatcacaacagctcaacaaggagggagttactaccctcacttaatggacgaagagatcaaggcttcagtatatatatacacacacacatatatacatatatatatatacacacacacaaataaacacacacacacacacacacacacacacacacacactttgctgcccagtcctggagtgcagtggcatggtcttgggtcactgcaacctccaccttctgggttcaagcaattctcctgcctcagcctcccaaatagctgggattacaggtgcctgccaccacacctggctgattttttgtatttttagtagagatggggtttcaccatgttggccaggctggtcttgaattcctgaccttgtgatctgcccacctcagcctccaaaagcactgcgattacaggtgtgaaccaccgcgcctggccttttttttttttttttttttttggagacagactctcactgtgtctcactctagcccaggctagagtgcagtggcatgatctcagctcactgcaacctccgcctccagggttccagtgattctcctgccccagcctccccagtagctgggattacaggtgtccaccaccatgcctggctaatttttgtattttcaatagagacaggtttcaccatgttggccaggctggtctcgaactcctgacctcaggtgatccatctgctttggcctcccaaagtgctgggatttacaggcgtgagtcactgtgcccagccaaagacttcagcatttaagtaacctgcctcccggtcacccagccagtgtgtgctggaactaggattcaaacccaagtctgtcttttgatcaaaccacacactctttccattgaccatgtggcccccagccccagtgcgcaatgctggatgttatcatatccctaggaggggccaggagccagggtccaagtaacttggtgggtttctgcgtctgagaaatgaagctggtgagacggcggttccttcactgttttccaagggctgccacggctttgatcttgacagcaaccaagatgtatctccccactttgcagatgaaaaaactgaggcccagagaggttaattcaatggttcaggcagagcacctgttttatgttggagctggaaatcaaaccctcatgtgccaacagcatgcccaggcccttggctgtgtgtggcgtggacttgcctaccacatgggcatggccaggcccctgtggtgcagtggagagatgagccttttttatttcaaaatacacagcacttcttggccggtcacagtggctcatgcctgtaatcccagcacttcggaaggctgaggcgggtagatcacttgagctcaggagtgagccactgtgcccggcactgtatgttactctcttagagatatggccaactcgtgagatctgtaaccatcagcttttactagattatgctgcagtaacaaacaaactgctacaaatctcagtggcctgtggcaaccaaagatcatttcttgttcatgtgtcatgttgactagggctggctgtgactgtgccccagccccgtgggtggtcctcattctaggatctcagtggaggaagtaggtcctataaggtccttgcagcagagggagggagcacactggctcttaaatcttaatgctcagataagacaccatcacttacataccattggccaaagcatttcgtgtggctatgcctgacatcactgaggagggaaagcacccagggggaagttgctgttacaccacaagtcacgtggcagtgggcagcgatgtgtgacgcctcctccagggagcctagatggtagttgggagcggcagcagcatattccatgtgactccgggaacccacagcacagccgtgctggcactcacatggttgggcactttctcaccccttccatatctcagagatctggtggatttctatgaaacttgttttctaaacctagactgagtttttatactatcataagcggatactgattgagagctagattaaaataccttcctatagacatttgtctttctcttattttatttgagacagggtctcactgtcacccaggctggagtgcagtggtgcaatcatagctcattggagccttgacctcctgagctcaagggatcctcccaaagaggtgggaccacaggcatacaccaccacacccacccagccaattttttattttttgtagagacaggatcttgctacactgcccaggttgatctcgaactcctgcactcaaacgatcctcccaccttggcctcccaaagtgctgggattataggcgtgagccactgcactacacatttgtctttaaatgtaacacttagccgggtgcggtggctcatgcctgtaatcccagcactttgggaggccgaggcgggcggatcacctgaggtcgggagttcaagaccagcctggccaacatggagaaaccccgtctctattaaaaatacgaaaattagctgggcatggtggcaggcacctgtaatcccagctactcgggaagctgatacagaagaatctcttgaacctgggcggggaggttgcagtgagccaagatcgcaccattgcactccagcctgggtgacagagcgagattccgtctctaaataaataaataaatgtaacactacattaaaaaaaaaaaaactcagccttatgaaagtgatgttgctgaaaacataaccgtggaatccagtagcggccattagtgcagatgtgcgggtcactgcaggaagacagctggagagcgctgttgggtgtgtacagtggagaaagacacctcccaggagctactgccagccaagtggctgtcatcatctcacagcacacaaaacagatgcttactacacagagaactctttacatattaagtatttccttttctttttttttttttttttttttttgagacggagtctcactctgtcgcccaggctgaagtgcaatggcacgatcttggctcactgcaagcgcggcctcccgagttcacgccattctcctgcctcagcctcccaagtagctggaattacaggcgcctgccaccacacccagctaatttttatagttttagtcaagagagacgaggtttcaccatgttggccaggctggtctcgaactcctgacctcaagtgatccacccaccttggcctcccaaagtgctgggattacaggcgtgagccaccgtgccttgtcaagaaccctttacatattgagcattttcataaatatttaaacctggattcctgaacccttgggtcacatctgcagaccatgcagttggccattgcggaagatattaaaagcatattaaacacccactgcgtgcccgtggtcgggaggaaaaacagttgatgctacagcttagttttccaggaattcagtatccctgagtcaggcagccttatctgtcatcctagaactccaggacagccccaggtggtggtgggaggggccgcggctgggagatggagctgctctgagcctgcagatcagggtagcattcctgggaggcgccttccaggcggaggggaaattgctcatgtgttctgggaactgggagtgactgggtgtggcaggagtgtgaggcatggcaggaggtgagcctgaaaaagaggctgatccctcagagcaggacaggttttacccaaggctgcaggccagtgtctaaccgtctctagatccgtcctggtttagcttcttccaaatagttttgtgtctgtgtgagagtgtgtgtgaaacggagttttgctgtgttgcccaggttggtcttgaactcctgggctcaagcgactctcccaccttggcctcccaaagtgctgggattacaggcatgagcaacggtgccggctctaaatggttttaagggcacggtacctacctcaagctaacgtgcaggcaggcacgaggtagctggaattctagcctaggattctctcttcagcaattcttgccttaagacctcaccttagacgtttgctcattcacagatccctccccttctcagagggagctgtgttaccaagccttggcttgtacctccaaggcatgcagtggatgggctgagctccctgcagggagtcaggcgggtgtgtggggggcatgaaggtgagcaggacactgtcccttcctccctccctcccacggatgctcttcctggctggtagccatgtggacacctggggggaagctgttctgtgtggcagagtcactgtgttgtgtctggtactggggcccttgccagggtaggtcagtgactcgtccaggccctggaggctgctgctgtcccctcctcgtgcagaggaggtggggctggcagtcaaagcccaggctccctccctccctctagactcagaacagcccaggaacccagctcgaggtctggaggaagtgatgtgtgcattgggtcttgcagcatagataggttttgagtggacggagaggttagcgaagggtgttccaagtaagcaaagcacggaactaggaagtcactggctgcagcagggaagtcacacaaagggacaacctaccacagactgggtgagctgcagagggaggatggactaaactccaacttcagggtcattctggttgtttttttttaagacagggtctcacttggtcatccaggctggagtgcagtggctcaatcatagctcactccagccttgaacccctgggcccaagcgatcctcccacctcagcctccgaggagctgggactacaggcgtgtaccaccgtgcctgtctaatttgtatttttttgtagagatagggtctcactatgctgcccaagctggtcttgaattcctaggctcaagccctcctcccacctcagtttcccaaagtgctgggattacaggtgcatgccaccatgcccagctaatttttatttttggtagagatagggtctcactctgctgcccaggctggtcttgaactcctgcctccatttcctaaattgttgggattacaggcctgagccactgcgcccagccttgaggcccattcttgtctgcggagcggaggggactttatcatttagaaaaggatcttttaagtcatctcttttaagaaacctcatggtccatttgcatactgaattcattaaactcatcggcctgaccgtgttcctcaggactgggctggaatttccctgtgttagtggaagagggcacggggagaggactgagagtcttggtccctgtgatacagctctgatgagtggaggaacactggggtttttggtttttatgccggtttagataaaatgacatggatacacgtggagtggttttttttttgttttgttctgagatggagtctcgctctgtcgccaggctggagtgcagtggcgtgatctcggctcactgcaacctccgcctcctgggttcaagcaattctcctgtctcagcctcctgagtagctggcattacaggcgcctgccaccatgcccagctaatttttgtatttttagtagagacagggtttcaccatgttgaccaggctggtctgcatctcctgaccttgtgatccacctgccttggcctcccaaagtgctgggattacatgtgtcagccaccacgcccggctcagtggagtggttttaaaaccccgatgtccacggggctggttccttctgctggctgtaggggagaatctactgtgtccctgtcccagcttctggtggtttcctggtcatcttcttctttgtagatcatcagcccagtctctccttcatcgctctgtgacatcctacctgtctacatgtctgtttctgtgtccaggtttctcctccttattggatccaactggacgagggcccaggctaatgaccttgccttaccttgatcacctgcagagaccctagctccaaataaggtcaccttcacaggtattgggggtcaggacttcatcatctttcaagagacacaattcaacccattatagccccgaagtgtgccgtgcaaattaccaaaccccacatcctggggaataacccaaacaggagacaggaggacagagttcaggatccttccagatcccagcccttgcctccaggagacgcagccacccggtaccctgagtcggaatacctcggaagtgaggggccctccctaggcagatcctaagccagaaagagaagcctctgtgtggccatcaagcggtacggacagcagccagggcgtctgcccagcttcctggacagactctgctacccacctgcctctcttagaagagccccaggttgcgttccaattcatctggagaagcaactccaaatccgttgcttactctagacatctataatatgtgggcttaggtacagttgaaacagtgccatttagacagttcccaaaatttgtaatagatactgagaaagatacatgatacgacagggaaagaaaacacaacacactatcttacgtataggctgatttcaagtacgtacatacacacacgcgttttaagcagcttgattgagatataattcacataccatataattcacccatttaaagtctggagttcattgacttttaggatattcacaaagttgcacagctgtcaccacagacaattgtaaaatgttttcatcaccccaaaaggaaatcccacacccttcagttggcatccaccagcccctccttcccacccacccccagtctgagaccactcttaatgtataatacatctgtctcttgtttgcctgtgtgtctgcatttcatgtaacttttttttttttttttttttttgagacggagtcttgctctgttgccaggctggagtacagtggtgtgatctcagctcactgcatcctccacctccggagtacaaatgaagcaattctcctgcctcagcctcctgagtagctgagattacaggtgcacgccaccatgcccggctaatttttatatttttagtagagatggggtttcatcatcttgaccaggctggtcttaaactcttgacctcatgatctgcccacctcggcctcccaaagtgctgggattacaggtgtgagccaccgcacctgaccacaactctattttttttttatataattaggaaaaaaaaatagaaataaagacctgatagtctgactcctgccggtgagtggaggatttcaattatacttttaaattttttttctatatttttgatatttttctgatcacacaatgagcatgagttgctaataatgggggagggggttattttaaaaacaaggcatggtcttgtcatattaatagtccttgtaggcaaggcatggtggctcatgcctgtaatctcgcctgacccctgaggtcaggagttcaagaccagcctggccaacatgacgaaaccccgtctccactaaaaatacaaaaaaaaattagctgggcatggtagcacactcctgtagtctcagctacttgggaagctgaggcaggagaattgtttgaacccgggaggtggaggctgcagtgagctgagactgcgccactgcactccagcctgggcaacagagcgagcctccatctcaaaaaaaagtccttgcatattgttctgagattctactcaacaccaaattcacaaccttgttttttgttgttgttgttgttgtttaatttgagacatggtctcgctgtgttgcccaggctggagtgcagttgtacgaacacagctcactgcagcctcgaactgctaggctcaggcagtcctcccacctcagcctcccaagtagctggtattacaggtgcattgccaccccgcccagctaatttttttgttttttgtaaaatttttatttttaaattttaatttgtagatagctcattattttgcccaggctggtcttgaactcccgggctcaagccatcctcctgtctctggctcccaaagtgctatgattacaggcgtgagccaccacacctggcccagaatcacagccttatcttatcgggttgagggggtggaaatgtgtctgagttccaaacaattgacttcaaattggaatcttggtgcacagcttgttagaagttggaaatgcttgcattgcgctaggctgctatgtgttcgattttctaggcccagctcccactagccatcgtcccccagttctgagcgccccacatccttaatcaggagacctctctcagcccttaacaaactgcccggtggctcaggtgagaggccctgtaattaaaccgcatcctttgcctctgtaataacatcggagacagcatagttctaggaggggacagacggaatatataatttcctgtcctttgcctgagccagtatgacattggtacatgtgcagtcttgcgtgtttcggctgtaaagtgcgatctgttgtctcagcaagtgtgtaggtaagctaaatattctaacaagtcagtccaaccatggcaggctctttgcatatgcgtccagcatagttgatgaacagacgtctacactagaggaaactggctcagttagtcagttcacaaaaccaatcctggccaccatcgcaaaaccttgccagttgcctaatctggaatccccgggaccgtcctcaattcacctggttcttctgggcctcacgtcaactgtgtgtgtcgctgatctctccagccgccctctcctcctcctcgacacccacaaccactgcccagcgcatctcactcggatgaaagcagtgacgtccgagggttctcttcctccctgccccctcctgtgctctttccaccctgaccgctgctcaggtgatgagggtctccctgcaccatgcacccttgtgcccctcaaaatctcaccccacttgattgtccagctgcgtcacccacagctcctgcatatgtatccgcgttcccacctggcagactctcgtgggtcccctatgccccatggtgtgttgtagccgtgttggtggactcttaatctggactccaggaatagagcacaagctgacatgcaaatgagtgtcttaaaacagaacacataggccagacgcagtggctcacgcctgtaatccccgcactttgggaggctgaggcgggcagatcacctgaggtcaggagtttgagaccagcctggccaacatgataaaacctcgtctctactaaaaatacaaaaattagtctggcatggtggtaggcacctgtaattccagctacttgggaggctgagggcaagaatcgcttgaacctgggaggcagaggttgcagtgagctgagatcgtgctactgcactccagtctgggcgacagagcaagactctgtctcaaaaaaaggagaattttatgaaattctttgctcctgggatttgaatgtgttcgtccgtttacatgcagcatcttacccgtccacctgggtgaaatgctttttaagactctgctctaaggtcacaactttactgcctgaagttcccttctgcatgtccccagggatttaattacttgttaattacatacctgtttccctcctagaccctgagcttctgggggtaggaactgtctcttcccacccacctctgatccccagcagtgtctagcacatggccagctcttaagtcagcatttggagaagacaaaagaccaggaagggcacgccagaccattctctatggaagacccacccagtgttccctgctgtatagtgaatggctccatactcccaaatctctgctcctcccttgtttaccttcatgaacagggtccttttgtgtttgcaggcatttcctctaagaggctgaagcccagttgtcaagcatctcccttgctacgggaattcactagatgtgtaatgctttgtaaattacctcttgacaaatgttgagctctttgtttttcttttctttctttccttccctttcagattgatgcactgagtaaaagaagcaaggaagctgaagcagctttcttgaatgtctacaaaagattgattgacgtcccaggtaagccccggcagtaatggcccaccagtggggggcgttgtgtctggtgagtcggtgggtttttggctcattcttcttggctttcctaaggaaaataaatacaccatcagtggcaacttccccccaagaaaccagggagtgcaggacacatgaattcttcacaacccagactttgggtacggagggaaattggatgcacttgttgaagtactcacgtaatctctaggggatgacttcgtaaaagcagagatccaaatctctggggctacagcataaaaccctgcacgtactgcagagaagatgcagacctgatgtgtgtatgctgtgtggaagtccctcatattgcccaaagccacctttaagactttaggaatggccctactaagacacctggagtgtcccgctcccctgccaggtcatccaagatcagtggcccctggacaagcccttcacttaagggttatgggcagagggtaactgataatccttgcagctacaaccaagtatatcagttgtttcttttattttttttttctaattttatttatttatttttgagacagggtctcgctctgtcgcccaggctggagtgcagtggcacaatctccgctcactgcaacctgcacctcccgggctcaagcgatcctcccacctcaacctcccaagtggctgggaggtacgtgccaccacattcagctaatttttgtattttttgtacaatgagtgcgatgaggtctcactttattgcccaggctggtctcgaactcctgggctcaagctatcctcccacctcagcctcctaaagtgctgtgaggttacatgcaggagccaccacgcctggccctgtttcttcttttagagggattgaagaattaaaatttaaatatgtttgtgaggcattctaagaggtgatggcttccgattctttattctggaaaagtgagaaggcaggtagagtgccttgaactctctggtcctgtttgtgggtcctcgattgccttagaatctggagtaaggtgatggacataactatgtggggcccagctcagccctggagagatgctgatcagaaaattaggaaagtcacttgatgcctttttctgccaagcaaagaattggaattaccaccaccctcccctccccacccattacagttgtgcccttgcccttgttagcaattctctgaatatcattgacatcattagagctacattaacagagcgaggcagactcaggtctcctttgtacctgtacttgtgttctgattcaggtctaccacgggctttgctgtcccctcttggagctgggattaatagaggtcacaccaaacacgggatggcagaaagcacttcggacagggaatgaggagacccagattctccttccctggatgacattccttttcctctctggacttcagtgttctcatctgtaaaatggaacagggtcagggaacagcctaatcgtagagaatggtttgctttgttctaaacttttgctgtcttaggagcttatctagttattggttccaaattctagccttttggttttctgtgagagtttgtatctgactaggagttccctgaagaacctgactgagcttcacgaggaggctccttcacagtaaaatggatcagagtgttaccactggagggtgtccaggttcttggcgttttgagcaatgaattggacaaaatgcacaaagcaaggaaagaatgaagcaacaaaagcagatatttactgaaaatgaaagtacactccacagggtgagagtgggctgagcagccgctcaagggcccagatacagattcttctcgggtctaaatatccccttgaggtttcccattggcaattggtgttcaccccatgtaaatgaagtggtggccctcattcagtctgatcagttgcagaaagcaaccaaccagaggctgaagtgaagttataaaggtcacactcctatgcaaacatcttgattggttgcggaaagtaaccaatcagaggctaaattgaagttacaaagttgtacttctatgcgaacgaagacttggccctgcaatcagtctggttggttgcaaccaatcagaggctgaagttacaaagttacgcttctctgcaaacatctgattggttgcagaaagcaactaatcaaaggtactttcaatttcccatctgcagggcagaaaaggtggaggtttgcaaaggaagtagacgctggtccttttgttacttaggcgtggcaagtgggggtttttccttcgatttagttctaggaagtcagggtgaatcagcctttggttccctgcctgcagaccctattttcctgcctcaagagcactgtccctcgggcatcagcagcctggcgggcatcactggcattttcttgtgcataaggtagtgactgagaattttctctctggactatgtcatgtccatactgacgcagggataaagaatttacagaaaaagcatgacctgggctttgagaaattttattttgtgtttcgaaagagttcattctttgactttttgttggttcctcaggctcaggaaggttctgctccattctattccaagaagttcttgctaccacttctgggagcaggatcccagaaggggagtgttttccagctgagaactttgtccagttggtgatttagtcggaagaagactggcttacttcatctttgccagagacccaaagactgtttagctgctgttttctaaataatatgtaatctcttttctttcttttttttttttttttttttttttctgagacagagtcgcactctgtcaaagaggctggagtgcagtgacgtgatcttggctcactgcaaccttcgcctcccaggttcaagcaattctcctgcctcagcctcccacatagctgtgattacaggcacccatcacgacacccagctaatttttgtactttagtagagacggggtttcgccatgttggccaggctggtctcaaactcctgacctcaggtgatccgcctgcctcagcctcccaaagcgctaggattacaggcgtgagccaccatgcccagcctagctgctgttttctaaataacctataatctcttttcaaaaagtcaaatttgtacctcaatttttccctagtgaaattttccaactgggcagtcactttaaaacattgctaggtttctttctctgcagttacgttctgtgttaatttcccatagaaaaaagaccgtttttctcatcaacgtttcctctttacctgagccaaccttgtccatgtacatgtacaaattttatagaattttgatcatagcatgggtatatattcatattctgcctttctcacttaatattatgattcttattattaccataagcattttcctatattggtaatattcttcacaatttttatttctggccagagaattgaagtttgcagtttaaattgatggatggtgggagcaaagaatgtttgatgttttctgtaatactaaaagtcaatcagaatacatctacattccacatagatccctttcacccaccgcttcccaggtatttcttacaaatgctgtgatctgccacatctaacaagttacttgcaaagcaggaatggtgctcggagcactctccctgtgttttgaagtctgattattgctcagatgcaatcattctgtggctgaggcttacaggaagggcccggtcaatagtgatgatgcatttactgacagtcactcagtcgaggggagtcggggtgccttaactgtctgcatacttcaggccttaatccagtggaatccagaaacattagtagggtgcagtaagttctgctagttgcaagagacagcaactcacactgtcacaggaaaagggaggaagcccttgggaataatgcaacaggcattccagctatatgccacacagccctgctcctggatcacagggagagccgccaagctggccccaggaacagcggagccagagtctcacccagcccaggagtgacaggcacctgaccgcaccagctcccacctgcttccccttcctgaagttttatttatttgtgcatttccttgttgcttatctctgggtctcattagagtgacagctccatgaggatagggctttgcattgtggctctctgcccagtgcctggcacacaacaggtgggacatagtgaatgactgaaggagtcaatggacccaaattcccgccactcccactgagtcctcagcagcggagttcaccaagggttgcactggtgactctcagagctttgtccctggtccaggtctcactcctgagtgccagcttgcatatctgactgccgcctggactttcccactgggatggctggtgggcacccacctgatgtgtccggcagaagccgtcttcttactgcctgccttcttttggcgggtagcatcacctcccaccttactgctcatgttctgagctttttgtttttcttgagatggggtcttgctctatcacctgggctcaagtgcaatggtgtgatctccgcacactgcaacctctgccttctgggttcaagcgattctcgtgcctcagcctcccaagtagctgggattacaggcgtgcgccaccacacctggctaatttttgtatttttagtagagatgagttttcaccatgttggccgggctggtctcgaactcctgacctcagatgatccgcccccctcagcctccaaaagtgctgggattacaggcgtgagcaccatgcctggcctgtgttctgagcattttgtcaccaactctggccatccaacctctaggatgtctcaattccagccacttgccttcacccaaactcctgccctacagtctgcagttcacggtggcatgagtctaagtgcttacagggcggccagactcttcctggctaatcgccaccgacccctctggattaacctgttgagacgccacttcctgacagagaggtcttcctggcctccccagctggtttaggggacccttcccatgcacacacacaccctggccggggaccctgccattcacttcatcataattccttggtaactgtttggccgagagactggttcagtgcggttttgtccctatttcctttatatccaccccagtgcctgccatgtggcagaaactccataaatattgctaaatgaatgcagaaattaatgaatcaaattatttcttcaaaatgctgagtgtttttttggtctcaggctcctactgttcccactgaaccaccctcccgaggttgaagcttcccagtgagggcgagcactgcagagcactaagacaagtcaattgcaggagaacagaatgtatcttttattgagttgtagcagtttaatagctgtctgaactctcattttactttgttgtcattctataaagatttacatgcctgcatggacatttatacagcacttagcattcggagttgcccaaaccagcacatgtgcatctgaggacttcggctctggggccggcccttggtgtctgggatctgtgtttggtttaccagacgtcccgccggcgccccaagcccagcacacagggtaggatctccctccaccccagcttatcccccaccatccccacccgccccacttctcccttggtgttctggctcctccctcttcttcatcttccaccttctataatttccttcacattaaagacacaaaggccaggcatggtggttcacgcctgtaaccccagcactttgggaggccgaagcaggcagatcacctgagatcacgactttgcaactagcctggccacatggtgaaacctcgtctctactaaaaaaatacaagacattaggtgggcgtggtggtgggcacctgtaatcccagctacttgggaggctgtggcaggacagtcggttgaacccaagaggtggaggttgcagtgagccgagattgtactactgcactccagcctgggtgacagagcaagactgtctaaaaaataaataaaattaaaaaaaaaagacaccaaataagcatttagcaatacagtagcattgaaccctcatggtcctcatgtacctctgagtaggtttggtagttcataccttggtgtttgttcttttcatttgccaccagatcgcttcttatttcttagtcagtttcgcgagtactatcagacttgtcttcctgggtattactcgggtcaatgcctgagaccccagcacccctcatgccccacaccacacccccagggcatcaagaaccaggctgagccccagggatacaacagccagctcagttcctgccctcagactatagaggctggtgggaatatgggcattaaaaagtaattgcgaccgggtgcagtggctcacacctgtaatcccagcactttgggaggctgaggtagctgaattacctgaattacttgagcccaggggttgaagaccagcctgggcaacacggtaaaaccccgtctctacaaaagatacaaaagttagctgggcatggtggcgttcgcctgtagtcccagctgctcaggaggctgcggtgggtggatcacctgagcccaggagatcaaggctgcagtgagccaagatcacgccactgcacttcagcctgggtgacagagtgggaccctgtcaaattaaaaaaaaaaaaaaattagaaaaaagaagaagaaaaagtaattgcacaaataactgaattttaggtgcgataagcaaagcccactgggcaatgagagtatagaataaggtgaatcaagcaggacagaggcagctgccctcaggtggcaccaactggggccaggagaagaagccacaggaagcagttttctgaccagagaaagcagcagcagggaggagctgggacaggaaggagaccagcaggtggggagaatgtcgggtcaatggggcttagtgagcagaagaggaaaaggacccagcagcagccaagccctgcagcagccagacggagacactgaagtagtcagaggggctgtgaataatgactctggggatcgggcgcagtggcttactcctataatcactgtactttgggaggctgaggcaggagaggtatttgaggccaggagttcgagaccagcctgggcaacatagcaaaaccccccatctctttaaaaaaaaaaaaaaaaaaaaagatgaacaagtaaaatatgcagcctctgtctctagttcaagaccagcctggcaacatagcaagaccctcccatctctttaagaaaaaaataaacaagtaaaataggcagcttctgtcccttactgtaatgaaatgagaaatgtctctgctcttaaaatgtaatgtgaccctctcaggtagctgggaatattctggaatgaccgcttctaacaggctcttgcatagctggaattttactgagttctaagcaaaattatgacagtatgcataattcgtcagtaattaaccttgtgtgggtgacttgctcttgcttcttgatacttttcatttttttttttttttacaatgagtatgtatttatttctacaatggtggagaacataaattagtaaaatattcaacttgcaatcttagtttctgaataggccttattaatgtattgcagataagaacttagtcaactagttgtagggtaaaacacaagtgtgacttctctgttccagaaacatcttagtaatgtttttgggggtttttgtttgttttttattttttagcagcggggtctctgttgcccaacctggagtgcactggtaccatcatagctcatttaaccgcctcctggctcaagtgatccccctgcctcagcctcctgagtagcaggaactacaggcacacgccaccacacctggctaatttttaaattttttgtagagatggggtcttgccatgttgccaaggctggtctcaaactcctaggctcaagcaatcctcccgcctcggcctcccaaagtgctgagattacaggcgtgagccaccacacccagcctagtaatggtgtattttaaagagttcctaggtagaagaaaaagactaggcactccagaacttctgtgctttggttgcaaagttcactggaagcatctctttgcaagttgtccttgcctctgtctgtgacctgctatcagaaccgtattttactgcttgctgagatgcagtttagttcctacagacacaaacccttcaaatataaaggcagtgcctggaagggtttattttaagatttaaatcttaggaagcacattaccagtgatataaaatattcattgactcatgaaacactgctagaagtcgctgtttcgtgactgactcgtctccctttatttccataggttaactggtctgcctttgtgaaaagtagatgtaggtttttcggaagtcctaaaagagagctggctggaaagagtgcatttgtaggccattccattttcagagcctgctcccaaatgcctgtgctctgaggtcctccccctgggagaggtttcattttggatgtaggaaaaccatctctcctggtgactatccttgtcggcctagcatctgagaatctagaaataaaatggaatgtcatcatttttgagaactgctttttaatgctcctccaggagaataaaatagcagtctggttcttggtgcctgctactttcaagtgaggacacattacaggttaaaattagaaaacactgttcttttatacttctttctccactgcctgcccctcactcaaagatcccacattaagactcctggaaaaaaagttgaagaaatcagcctggcgtggtgactcacgcctataatgccagcactttgggaggccgaggcaggcggatcacctgaggtcaggagttcaagaccagtgtgacaaacatggtgaaaccccgtctctactaaaaatagaaaaattggccgagcatggtggcgtgcacctataatctcagctactcgggatgctgagtcacgagaatcgcttgaacctgggaggcggaggtggcagtgagcctagatcatgccactgcactttagcctgggcaacagagtgagactctgtctcaaaaaaaaaaaaatgacaaaatcttatgatttcgttagaaatagcccctggttttcatgccaagaagttcatcaatgtgccacttggtagccttctcgaaggtgatagaaatgtggccattgcagcctgattctgtacggtgactccagtccacgtattccaggtctccaggtgttggcaaacaagacctgggacccagggcccctccggagagctccctgtaacttcagtagcaggagacatgcgggatccctttacaaatcctcagtttgccttcataaaacattttcattcatgtgattaagaagtaatcacaggccccaaacaaaacaggacagaaagaggaactgggtctggaagaataaagccctgtgggtggcggataatgtgctgactcctgtccaggatacaggtccctggccctaagctggtcctgaaacagcctcgggggacgaggctgtatgctctgtcccagttacactcaggctccggcattagggaaattggaaaccaggcatggaagcagcgtccctaccttcctcggccaggttcataaacctggggctcaatccgcctctccatgtaggacactgtatgtttgcaggctgaggaattggccaccactgttctaaagacaagcaggcatgacaagatgggcgttaggcctgttgccgccaggttttgccggctgccgtccttcccaaggctttcccttctccatccatcctcccccggtccctcgacacagcactagagtgagaacaccctggatgtgacttggggactcctcctcggtgtgcttgcgtggagagtggagaggtgcgtcgtttgtgccccgctttgccatgaccggggtggtcctggcacgccgggtatctagacagcttttcatcagtcgctcatcagcatgctaattgccgtatgactaattatgccctgaattccagttgattttcttaatgagacagctgggttaattatgtaatcgtatgattacattagcctagagtgccctggcgaaaagtagcgtctgccgcattgtgatgtcatcgcggggacggtgctcacaagggggacattcatcctcaggctggtggcaggggacagcccccatcgcccgcagagcgcactgtgcaaacatgagcctcatgtctattaagattggctttttcagccctcacaacctacaagaaaagcagttcaccaccagcagtctcctcgccaccctgcgccctctccacgcccccagccgaatccaaaagccgcctgcaggcctctgcagctcttctgagatccagccatgtgtcctttcttctcacaggacctctctgcaccgaggctgttgggctttatcagggcacaccagcacttccttcagagtgatccgaagaactcaaagcaaaatgtttgcattaaagtcccagagcgacttagttgacgataacatataaacaagccctagactggccccgaccttagatcccactgcgcacgccagatatgctgtttcattccttctttctgcccaatctctaacacacatcatatttactaggaaaatacatgaccgataccttctggtttctggccacttcgctactccccatcacagcagaactcccctgggaggtgactgcctgctgaatcacttcttcacctatttacactcttcctccttagacttttgtggccttctcctcttcctctgccagggctctaaatgttggagtatgccaggacgttattcttagccttttccttttcatttgcattccctccctatctaaaactccacatgaccaaaagagaatgatcatttccccccacgtgctcccaagatagtcagtgacatcaccattcacgcaggtgctttggccactgatatggtttggctctgtgtccccacccaaatctcacctcaaattgtaatctccacatgtcgagggaggtgattggatcatgggggcagtttccccgtggctgttttcatgatagtgagtgagttctcacgagatccgatggttttataagtgtttggcagttccaccttcgctcatctctctcctgccactttgtgaagaaggtgcttgcttctccttcaccttccgccacaactgtttcctgaggcctccccagccatgtggaactgtgattccattaaacccctttgctttataaattacgcagtctcaggtatttcttttttgttttttttgagatggagtctcaccatcgcccaagctggagtgcagtggcataatcttggctcgctgcaacctcctcctcctgggttcaagcgattctcctccctcagcctccctgggattacaggcgcctgccaccatgcccaattaatttttgtatttctagtagagacagagtttcaccgtgttggccaagctgatctcgatctcctgacctcgggtgatgcgtccgcctccgcctcccaaagtgttgggattagaggcatgagccaccatgcctggcccaggtatttctttatagcagtgtgaaaatggactcatacagccataatgcacaactcagcctgggttcccttctttctttcacacccaatagccaggctgtcagtaagtcctagtgagccagcagcctccagaatgtatcccagattcgcccacttacccttcagccactgtcacctagtccaagccaccagtctctgtcacctcactgcactcacacctccacctaacgtcctttgcacagcaggcagacgggtctacgtcagtggtctccaaactacttttgcttatgcaccccaagagtaaaaaagtttgaattgggccaggcacggtggctcacgcctgtaatcccaccactttgggaggctgagggcaggcggatcacctgaggtcaggagttcgagaccagcctggccaacatggtgaaaccccgtctctactaaaaatacaaaaattagctggtgtaatggcaggcgcctgtaatcccagctactcaggaggctgacgcaggagaattacttgaacccaggaggtacagtgagccaagatcgcgccactgcactccagcctgggcaacagagcgagactgtctaaaaataaatacatacataaacacatacaatgaaatgcgctcatttcaagtgtgcagtgtgatagcgtggccaccttcacagtcaagatgtagaacatttctatcacctcaaaagttcccttctgatcccagtacccagcaactgctgttctgctctttgtcacttctggagttgtatagaagtggaatcatttggtctgtggtcctacatctggcctctttcactcagcgcggtgttttgggattcatctaagttactggtgtcattagtcctttcctttttattgatgaatgatattccactgtgtggatatataccaatttgtttatccaacagttatgttgacagacatttggttggttgtgggtattatgaatcagtctataaacattcatggagaagttgttacataggtatatgtttttatttcccttaggcaaatacttaggatgagggtcagggaacctgtacattttacctgataagaaatgccaagctgcttttcaatgtagatgtatctttttttattaatttttttcattttcttttcctcaggatagcaaagttacagttgtattattttatcccctcataagaaattgagaggagttccagttgctccatgtcttctgtttcatcggttattttctaattttagacattcctagtgaatgcgtaatgtatttcacaacgattttagtttgcattttcctgatgattaatgatgcagaatattttttcatgtgcatttttgctttcatagatttttatttataaaggtttcaatcccttgcacatttgaattttggagacagggtcttgctctgttgcccaggctggagtgtagtgatatagtcatagctcactacagcctcagtcttccaggctcaagcgatcctcccacctcagtctctcgagtagctgggactacaggcatgtgccaccacacccgattaattttttgttttttctagacatgaggtctagctgtgttgcccagactggtctcaaactcctgggctcaagcagtcctcccaccttggcctcacgaagtgctgggattatgggcatgagccaccgtgcctggcttctgtatacgttttagattcagcttgtcagtttttacaaaggagttttctgtgattttgattaggattccactgtatttgtagatcaatttgaggaaaattgacaacactatttattcttccataatatatttatttagttcatctttaatttctctgagcagtattttacagttttgatgtataaacctggcacagattatgttcagtttatttctaagtttaagtcatgtttttgaatgttatattaaaggatattttcttttttaaaaaatctacaatgtttattttattattattatttttaatctcgcttcatcaccaaggctggagtaaagtgacgcgatctcagctcagtgcaaccaccgcctcccagattcaagcaattctcctgtctcagcctcccaaatagctgggactacaggtgcctgccaccacacccagctaatttttgtatttttagtagagacagagtttcaccatgttggccaggctggtcccaaactcctgacttcaagtgatctgcccacctcagcctcccaaagtgctaggattacaggtgcgagattaaagtttattttcttttgaaatttgttttccaattgtttgttgcttttatacagaaatataatgaatttcatatattatataatttttacattttaacaaataataaaatatataaatatatattttatattatgtaatgtttatataataataatataggtgacctcttaatgctcacctattagctctagaaatttttttgaagttttcttgaattgtccatatgcccttgaagacaatatatacttttttcttttttttttttttgagacagagtctcgctctgtcaccctggctggagtgcagtggcacaatcttggctcagtgcaacctccgccttctgggtttaagcaattccctgcctcagcctcccaagtagctgggattacaggtgcccgccaccacgcctggctaatttttttggatttttagtggagacggggtttcagcatcttggccaggctggtcttgaactcctgacctcgtgatctacccgccttggcctcccaaagtactgggattacaggtgtgagccaacgcacccggccacaatatatactttattgatgttggatggaatgttctgtaaacatcagttaggtcaagttggttgatagtgttgttcatgtttcctgtatccatcctgatttctgatctataatgctgtatatttattttccttgcttttttttttttttttttttttttggcacttgctacctgtataaaatgttgactagaagtagagaaagcagacatccttgccttggacccaacattagggaaaagcattcagactttgataattaagtataatatcaactgtagatttttttgtagttgccgtttataagatggaaattctctcctattcctagcttgcggagaatttttgtcataaatggtattgaattttctcatattgttttcggcatctttcgagatgatcatatgattttcctcctttattctcttaacatggtaaaataatttgattctcaaatgttaaacaaatcttgcattcctaggataaatcttacttagccatgcattttatgcataatatgcattttataatatattttgtgcattttaaaatttgctggattcaatttgctactgttttactgaggacttttgccgttaaatttatgaggaacgatatggtttggctgtgttcccatgctatctcatcttgaattgtagttcccataaaacccacatgtcgtgggagggaccagtgggaggtaattgaatcatgggggtggttatccccatgctgttcttgggatagtgagtgagttctcacaagatctgatggttttataaggagcttttcccgctttgcttgtcactccttcctgctgccatgtgaggaaggacatgtttgcttccccttctgccatgactgtaagtttcctgaggtctcctcagccacgctcaactgtgagtcaagtaaacctctttcctttacaaattacccagtctagggtatgtctttattagcagtatgagagcagactaatacagaaatatacaactatagttttctggtttttttcctttgaatatccatatagggttttcactttaaggttgcactggtcttgtaaaataagttagaaagtgctccccctttcctctatttgctgaaagagtttgtataagattgcagttattttttcgtaaaattcaattcatcagtgttgccatccaggcctggaattttctttatggcaagtttttaaattacaaattaacttctttaacagatgcaaggctattaagttttttaaatttcttcttgagtcagttttggtaatttggaatttttaaaggaatgatccatttcatctaaattatcaaatttgttggcataatattgtacataatattttattaacttttaaatatctgtaggatgtgtagtgatgtcctttcttatacttcctgacattagaatttgtgaatcctccccccgggcttttttccttgattagtctggctagaggcttatcaattttaaagttatttaaaaatagaaccagcttttgtttgcattgatttttctcttttttttttttttccttgttttcagttttgttgctttctgttcttattagctactttctacttactttgggtttaatttgctcttctttatgagttttactaagtgggcattgttttatttcattgtggtcagagtacatgtttgtatgatttctgttcttttgaatttatcaaaagttgttttctcatcctgtacatcgatgaatgttccatgtgtacttaaagagaatgtgtattctgtagttgtttgaatggcatgttctagaaaagtgagctctgtttagttagtggtgttcttcaagtctcttatatccatattgactatataaaaatcataatattaattaatgtgaatggcttttttcgttgtttttttttttgagacagagtctcgctctgtcgcccagagttgagtgcagtgacacgactttggctcactgcaacctctgcctcccgggtttatgcaattctcctgaatgtggatggcgttttgaaatctaattattattttggatttttcttttttctttcagttctgtcagtttttgatttgcatagtttaaagctttgttttggggcaaatatacctttaagattattatatcgtctctcaattgtttgattcttttaagtttatacaatgaccttcattattcctggaaatattccatatcgtaaagtattctttttctgattttaatataagcactctggctttcttttgatgagagtttttatgttatatatttttctatacttttactattaacctgtctgtatctttatgtttaagttatgtaaatacctacatcttgcttttttatccatcctatctgcctcttaactggaatgttagatcatttacatttaatgcaattatggataaagttggattgaagtctaccatcttactttttctatttgtcttgcctgttttttcttgtatttttcctgcttttgattaactgatttttttaatgtttttatctccccaattatcttattagctataactcttattttcttaagggttactttaaagtgaaaagtaagccagccatgatggctcacacctgtaatcccagcactttgggaggccaaggcaggcagatcacctgaggtcagcagttttagaccagcctgaccaacatggagaaaccctatctctactaaaaatacaaaattagctgggcgtggtggcacatgcctgtaatcctagctactcaggaggctgaggcaggaaaatctctcgaacccgggagacaaaggttgcggcgagctgagttcgtgccgttgcattccagcctgggcaacaagagcaaaactccatctcaaaaaaaaagtgaaaagtaaccatctttaacttatcattttataccttcaaataatacaccatttcacatacaatataagaatcttataatacattgtcactttctcactcttgttcttttgtgcatttttactgattttacttctacctatactacaacgctataatacatggttactattttttctttaaaccattaacttttaaagaaattaaaaatgaaattataatattttatttttactcatctatttaccatttccagtgttgtttattcccttgcgtggattcaagtatgcacgtgaaatcattttcttttggtctatagatctccttttaacatttattatgatataggcacactggcaatgaattctgttagctttcattcatctggggaaaaaataccttaatctcacccttttttttttttttaagacagagtcttgctctgtcacccaggctggagtgcagtggtgcaatcttggctcactgcaacctccatctcccaggttcaagtgattctgctgactcagcctccccagtaactgggattacaggtgtgtgccaccatgcctggctaatttttgtatttttagtagagacggggtttctccatgttggccaggctggtttcaaactcctgacctcaggtgatctgcctgccttggcttcccaaagtgctgggattacaagcgtgagccaccgcgtccagccaccttcatttttaaagagtattttttgtcagatataaaatagtttcttgggtctgccagtcatggtggcttatgcctgtaatcccaacactttgggaggctgaggcgggcagatcgcttgaggtctggagctggagaccagcctggccaatatggttaaagccctgtctctactagaaaaacaagaattagctgggtgtgatggtgcacacctgtaatcccagctactcgggaggctgaggcaggagattctcttgaatccagtaagcagaggttgcagtgagctgagatcgtgccgctgcactccagcctgggtgacagagcaagactctatctcaaaagagaaataaaataaataaaatgaaatagtttgttggtggtttgggttctggttttttctctctctggactgactgtttctgagacaggcgatctccagtaattcatatatatttttttaacctatatacaattaatctttttctcttcaccatttaagattttccttttctaattttgatttcagaaactctcttacgcttactggtgttctttgggtttatcctgcatggagtttgtagagtttcttgaatttttaggtttatagcttttatgaagtttggaacattttgccactgtttcttcaaatacaccctttccctctttctgggaaatgtatgtttggttgcttaattttgtttcataggttgccgagggtttactaactttttttttcaatctttctgtgtatttctgtttggtttgtttctgtgactatatctttaaattcactgatctttttctttcactgtgtctaatctattgttcagccaatcaagtgaattttttccatttcacatactttaagcttcagaattcgatttgattctttatgttttctgttcctctctgtattgtattcatatttttctttaaatccttggacatgctgataatagatgttctagtctgcttcttccattatctcttgtcatttctggttctgtttttatgaagtgatttttcccctgatcatcctgctgctttgcatgtctagtaatttcctattgaattttagacatcatgagctttaactggattttgttgtcttatttaagtttgggcaggcagttaagttacttgcaggtcagtttgatcatcctgagacttgtttgtagctttttggagtggatatgggcaagccttgaagatgagtttagccctccactcaggtgggacacttccagtgtctttactcttcaacaagtccttgctcttcaacaagtgtgtcctctctggctggttgcagttggaaagtcctccagccctcaaactgtgggaggttttcagctcagactttcctttctattcttgcctggccttaggagtttcaccctgtgcataggcactttagctcttggcaaaagatcgcctctctgcagatttctgtagctcttgtccctccttttcacactctgccttgcaaattccaattgctgcagccacccaatcttgtgatgtgtgtccttcaatggacagggagaccatcacactccgcttgggtttttttcttcattgtgatgcaatccagagagttcttcctgccaggaagggtaacatagagctcatctcatttgcttcccttccttcagggaagtcttgttccaccagttgtccagcgtctgtaaatagttgtttcattgactttgcctagttttctagttgtttatgaccagagcacaagttgagtatcagtagatctgtcatggccagaagcagagactccaagttctgttaattttgatttttggttttcatggaaatggctggaaaaaataacttacaaagataaatagattcaaaccaaagaaacacattattggctatctttacaaaaataggattcatatttatgaaatctaggtataggttgagtgtcttttatccaaaatgcttggaatcagagtgttttggatttgggatttttgaattagggatattcagcttgtactaattatgagaaggtatttgttgaaactcagctagtcaattttcattttccatgataccgtttttttttttgtttttttgttttgttttgttttttttgagatggagtctcgctctgtcacccaggctggagtgcagtggcgcaatctcagctcactgcaagctccacctcccaggttcatgccattctcctgcctcagcctcccgagtagctgggactacaggagcccgccaccacgcccagctaatatttctgtattttcagtagaaacaaggtttcactgtgttagccaggacggtctcgatctcctgacctcatgatccaccacctcagcctcccaaagtgctgggattacaggcgtgagccaccgcaccccgcctctttttttttttttttcctagcttttcagaagatcctgcatttcttatattaattaacaaacgatttgaaacttcttttggcaaatgtttactcagatttgagttggtaaataatagtagataacatttattgagtgttaactctgtgtatggcaattttcttaagttaatcctcacggcagcaccatgacatatgcacagttagtatgcccaatttatgcatgaagaaactaaggcacagaggggttaagtaacttgtccaagattgcacaaccaataaatgagagagctgagacttgaacacatgcagcctggctcatactgcagaccattacactacactccctcttgtgtgatataaggcattgaaccatttttgtaaaaggtgctgtctttgcccatcagtatatagatgatggaaacatttccaaatattcacttttagaatgctgtcactgtagcataaaatagttattttcctcaacaagcattaaagcaccacatttattgcaacaacttagagtatgtgtttattttttcaaaagtatctgtcaagcggcatgttactgatatgatagccatttaccatcacaaaacagggcaggtaatttggatcccttagcttgctttttttttcttttctttttttctctctgttttgaggacagggtctcgctctgttgctgaggctggagtacagtggcatgatcatagttcactgcagcctctaactcctggcctcaagcaatcctcccacctcagcctccctagtaactgggactacaggtgtgttcccaccatgcccagctaattttttatcttttatttgctgagacgaggtcttgctatgctgccccagctggtcttgaactgctggcctcaagtgatcctcccacctcagcctcccaaagcactgggattacaggcacgcaccaccccacccggccaggatcacttagcttttctaaagaaaattatatagctcatctttaagcttaaaactcttacatgcttttgccaagagaaaaccaacaaaccattgtgtgggttgaagtactacagttttggtttggtttggtttggtttgaaatggagtcttgctctatcacccaggctggagtgtagtggtgtgacctcggctcactgcaacctccacctcccaggctcaagcaattctcctgcctcagcctcccaaatagctgggactacaggtacgtgccactacacccagctaatttttgtatttttcctggggacagagtttcaccgtattggccaggctggtctcaaactcctgacctcaggtgatccacctgccttggcctcccaaagtgctgggattacaggcgtgcgccatgccgtccatctctggccacttcttgacaggaaaagaattgcatccaaaatctgaccattggctcatttcagacattgtactttcagctctagcatttagtttgcttctttttatatcttctttttctctcctccttgcactcctatttttcttaaaatccttgtgcacaggctccctctcccagatctcttttcccttcctgttctgcctctccttccctgggaccacactggcttctcactatgccttgaccatgccctgttcacagctaccacgggacctttcactgggcgctgcctctgactggggtgaatccttgcgctgcctggcattaccatccagatcttcatccccactcacttcttcagaggccttccctgtccccttgtctctaggacccatttccctcactccctgtgcctctcctctccatgctcagcagcgcaaacgctcctcactcacagtggggctgtgccccagtcaacccatcacaagtggaaaatatcataagtcaaaaatatattcaatacccctaacctaccaaacatcataagttgaaaatatcatgagtcaaaaatgcatttaggccgggtgtggtggctcatgcctgtaatcccagcgcttggggaggccaaggtgagcagattgcttgaggccgggggttgaagaccagcctgggcaatggggtgtgaatccctatctatactaaaaatacaaaattatcctggcatggtcgtgtgcgcctgcaatctcagatacttgggaggctgaggcaggagaattgcttgaacacgggaggcagaggatgtagtgagccaagatagcgccactgcactcccgtctgggtgacacagtgagactccgtctcaaaaaaaaaaaaaaaaaaaagaaagaaagaaaagaaaaaaagagctccttttcccggtttctccaggagcgctcttccactcatctggtctcctgccttgcgtttgtcatttacatgcatggcttatctctgctatgaggctgagcctttcccagagcagctagttggttccgttgcttaggaaatatttgttaaattagtactgaaagagattttctttggctgctggttaagaaaacagaagcttttttttttttttttctgagacagggtctcactctgtccctcaggctggagtgagaccctatctctttaaaaaaaaaaaaaaaaaaagaaagtcatagctctctgcaacctccacctcccaggctcaagcaatcctcctaccttagcctcccaaggagctgggactacaggcatgcaccaccatgcccggctaatttttgtattttttccagagacagggtctcacttatgttgtccaggctggcctcaaactcctgggctcaaacaatgttccctcctcggcctcccaaagtgctgagattacaggtgtgagccactgtgcctggccagtaagcagaaatcatactgagaatttttcaaagtcgtttgcctggcgggcttctttcctttttctttccctccctgggtgagatgcatccaccccatacattgcagagcgggctccgccagcctctgactgtaatggctggaattaacgagataatattgcgtgcacttaggaaaaggtgctgaatatgtacagtattgttgtttgtaataattatgttccttgagccctgtgttgcataacaagctatataatacctccaagattgctttaggaattaagtatcagatgattgtaaaacactttacaagattgtcgcattgggtgggcggagctggcaggaaagcgtgttgaatcggaggaggaggaggctgggaagacaggggttaccggattttgtgtgttcctgttttatatatgggtgtgtcctcttcgcctcctccagacaattccctaattgagctgctaagatcggaggcatctgacgttcgcataagacctgacaatccttgtgtggggtttaaatggcattggaaatcattaacaagacaaaaagctattatttccgtagattaacacacaggttgggttttggcacgccaaaattcattgttttggtctttagcccaaacatgctagagtcattatattgtcatgcagtaattagctgttcctttaatacaagtaataaaaattaagcctaagaagttctttagcaatgcctcttacatatcccaaaacaatattcaaatgctgtaggcatttagccattcaactgtgctgtagtaaagtttggagtttaatgcacagagatgtttgaacatttagctcatcctttagtctgtgaccagctttgctacataggcattaacctttaatagtgtcagactaaatatacatgccatgatgaatgattatgagattgcctgaattttcatttacagtataaggctctgaaaattggtgtaaaggtctggttcctcctcacttgataatgtgcgtgtcattttcatatgtcaccggattccttgcttaaccgcatgggagaagctattttttaattcgaagcagatacagtggggtcctggccttttgaaaagaatgaactggaaatgttgacagaacttttagggagggcaggcagtatactaggtgtgttctttaaagatataatttgctggcacttgtgctagaaagcctacgtgagcaactcttaatagaattttatacgtgatcaaaggttcctctctttacctcctcttccctgacctctatgtcaagtttaaatcgtggttctgtacaaaggaggctgtgaacgggctgttcactttcttgaaaccatttgcccagcacaaggtcgtgaaggtggggaagaggggcaggctgagaaggtgaaggtatccagagaagttatggaaattttttttacaaacagcacctggaatcttttcaggaattctgtttttttgtgttatcacgactcctgcttacaaagaaccatctccccaagatagcatttttttttttttccaagacaggatttcgctctgttgccccggctggagtgcagtggctcaatcacagctcaatgcaacctcgacctcaagggctcaaggacttctcatgccttaagccccccagtagctgggactacaggggtatgccaccatgcctggctagttttttggtttgtgtttttgttttgtagagacaggctttcaccatgttgcccaggctggtctcgaactcctgagctcaagcaatccggccaccctcggcctcccaaagtgctgggattacaggcatgagccactgcagccggcctccaaaatagcttttggagtcaaatttaacataaatattttgatgctgattaaaataataatgaaaagccatgcaccagaaagagatgcaattataggctgtgtatacgtgcagagtaagtgcccagcagccagggattctgcatgatggactgtgttgctgtgaaaccccagcacccgggatctgctgacgttgagcccaacatatcccagcgcctgccttttgtaaactctgcaaagacgctggcatcctaaagagtccctggctcctgctggatacgttaaccgaggcatggtagacctggccctcgattccaggaacctagggtggtctgaaaaattaatgactctggcatttgaaaattaagtgagctcttgaatatatactcttgttgatccgctgggcatggtgtttggcattcttcgactggagactaaatctctgcagccatctcacaagtgacactggcgcccataccagaaatatattcaataatctttctaagccctgtggacttgggtattcttccactctgacggagcctgagaattccaaaggaagtatgccccaggtacccagcaggcggaatataattgcctcttaggcagcagaaagaaaactaaagatcacattgatgcggaagaacatttaaggtctctctatcctgtgttgaattcacagtaaaggcgagagccgtgagtttgtactgtaaattccaggtctgtgacttctgactttggattaaaatccagttttctggaagtgaatctgatggcagatatgaccttgaattggctgcaagaccccagcgctggcctggctgccgtgcagcgcgcgctgctctgcacttagttatcatcaggagtgtggtggcctcctggccagctggtctacgacagggccatgccgggtcaccagctgtgcctctgcaggggtctccagccttgggacctgcggccgctaacccctgactcttctgaacacccttcattagtgaaggaggatcgtaatggaaagtggtcatgtcatgaaatggggtggctttataaagcctaagtgtttctttcctctgcttcacctctgcttcattctttaccttgttgtaaagaatggtcactcagggctgggtggggtggctcacgcctgtaatcctttgggaggctgaggcggtcagatcccttgagtccagtttgagactggcctaggcaacataggaagaccctatctttaccaaaaaatacaaaaattagcccagcgtgcttgtgcatgcctgtagtcccagctacttgggaggctgaggtgggaggattgcttgagcccaggaggtggaggctgcagtgagccatgatcatgccactgcactccagcctgggcgacagagtgagaccctgtcttaaacaaacaaacaaacaaaaaagcatgatcacttggagttaacagacttaggtgtgcattctccatgccaaccaactagctgggtgacctcaggtgagtcattctgcttccctgggctttagtttctgaggcctctttctcgagattgttgtaaggctcaaaagacacaatctccataaagtgtcccgtgaactgtgtggcgttctcaggcatcaggtgtcacttccagcctcataatcactggacccttaaacatcccggcacctgtccacggacttgtccgtcctccacgtgcagctccggggatgtgattgacctcctggggctgctacctggtgtatttctctacttatctgatcaaagaatgaaaatcatgaaagtgtcacaccaggcaggagtaatcggcaaataccagtgaatctcatggctattgccaccccattttcacacctcgaggaccccgggctgggtccatcctttgtaaagcactggagaattctcccacccagcaagggggctggctgcaggggcatgactgtggcctctggggagcccccggagctgatgtcccaggagccccactctgagcctgtgtaccgccgtggagggggcctgtttgctggccgagtggggtgatggctgttttcctgttgtgcagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaaggttggtggaaaatgcgttctttgctttttcttttcttcttttttttctcttctttttattttaattggcttttcccatacttttgagaccagctctccttgtaatatacacgtcataaagtcagggtggggcaggaatctgagtcgttaaagagagatgataatcatgctgagctatttcgaagtaaaacttttcctctgcacaacaacgacgtaagattttattgccctctgatgagaccgatcaggattctttgaaaattcttcccgtatcattacgtgattgggtctgcctcttgaaaggcccatgcattgcctccaggcgacacctgtcagagagccagctcatgatcaaagggtcacacacagtaagtcatttaataattgctgtggatacattaaggcttcagacacatcttaaaggctgcatgcttaagccccgctgttgccttgtcagtatcgcctattcattaggaatttaatgaaagaaaacaacctcttggtgtgtttgcccagccgtcaacaagacagagagggcaaaggttgcctggcttttcccgtcagggaagaacaaaggaatctctcctttacctaaaatccagaggcactcaggatccaggagcctgttggcttccttggcttgaaggaaaatcacagctcccgtctgacagcagcagcagcaggcttttcagccagctccaaagaataattcggccagtttgttttggtttgggaatgtgagtacggaattaaattgaaaggggaggctgcccattcctagtggccttccattgaccatttgtagagacttcaataaagagttaattggggccacgtgcggtggttcacacctgtaatcccagcgctttgagaggccaaggtgggaggactgcttgaggccagaagttcgagaccagcctcggaaacgtagcaatactctgtctctacagaacatcagaaattagctgggcatggtggtgcacacccgtggtcccagccactcaagaggctgaggcgggaggatcgcttgaacccaggaggtcaagcctgcagtgagccatgattgtgacactgcactcagtctgagtgacagagcaagatccagtctttaacaacaacagaaaaagttaattggcaaagacttcttttttttttttttgagatggagtctcgctctgtcgcccaggctggagtgcagtgcacgatctcggctcactgcaagctctgcctcccgggttcacgccattctcctgcctcagcctcccgaatagctgggactacaggagcccgccaccacgcccaactaattttttttttttttttttttttttttttttttaagtagagacgggatttcaccgtgttagccaggatggtctcgatctcctgacctcatgatccacccccctcagcctcccaaagtgctgggattacaggcgtgagccaccgcacccagccaattggcaaagactttctaaaagtgtcctttggctttaaaaacactgcagatagaccagggaagaagaattgtccatgggaatgatccagaaagcatctgtgatgatgtgtgaagagccagaggtagaggcatgggctgtgagggcggcggtgcctaagacctccgagcacacctccctgtagtgtgggcatgggggtactcaagccctcaggccagcatagcttccttgctgaaatttgggggcacgaggtgacaggcagctggggaagccagaccccgcttctttctggctttgcagagagtggtgagcctttaggactagaagggacaactctgtcctgctagagagcgaggcattgggcttactagggctggaactgctgtgagggaaggtattaccttcccttgtaggaagcatttcttgccagaatcacgccagtattgcagtaaaaggtaacctgcaaatctgcacattgagttttcatagatacgctaccctaaaggggagtatcctggttttttttttttttccccttcattgtcctctggtatctaattttgatagatccactctctggtttgtttggtgagtgttttttatttatttatttattttagattcagggtctcgccctgtcacccaggctggagtgcagttgcatgatcatagctcactgcaacaaccttgacctcctggactcaagtagtcctcccgcctcagcctcctgagtagctgggactacaggcatgtgtaccaccgtgcccagcctctttctggcttattttatttttttgagtttgcttttgttttgttggagggtggtgcaggtggggcctggtgggctgtgcaggattgtccttcccttctccttctatcactggtgcctaaattaccagcttcccagtggccagggctttgcacaggggctgaccaggagccaagctgggtgtggatgttctctccccaaagatctcatccacactcaggagtggcttttcacaatgagttatagagcccaagatttaagaacagctccaggccaggtgcagcgactcacgcctataatcccagcacttaaggaggccaaggtgggcagatcacttgaggtcatgagttcgagaccagcctggccaacatgacgaaaccccatctgtactaaaaatacaaaaattacaggcatggttgggcacgcctgtaatcccagctactcagaagactgaggtggaagaatgacttgaacctgggaggtggaggttgcagtgagctaagatcacaccactgtactccagtctgggcaacagagcgagactccatctctaaaaaagaatggctctggaggcagacagacagacctggtttgagtccttttattgctaccacctagctatgtgaccttgggcaaattatctcactttgctaaaagcctctttctcttgggaggcaattctgatacttaccaggtagggttggtgtgagcttaaatatgcatatacacacagcatttggcactcaatagtacctgctacttattcagcagtgtggtttttgaaagaaatttaccctcctttatttggataacaagttttcccaagctccagaaaaatgtcatttcctctcccccacttccaagaataaaagtgattataatttgggaaggtgggcggtgcacatcacttcttgtaattatcacaccagtagtgtaaatgattaaaaagttagagcaggggccagcacaatggctcatgcctataatcctagcactttgggagaccaagtcgggaggatctcttgaggccaggagttcgagaccagcctggacaacataacaagacctatctcttaaaaaaagaaaaaaaaaaagatggtgtgagtccattgtgtgttgctgtaaagaaataccttagtctgggtaattgatgaagaaaagaggtttatttgcctcatggttctgcaggctgtatgagcacgatgccagcctctgcccagcttctgagggtcctcaggaagcttttactcatggcagaaggtgaaagaggatcaggcatgccacaggacaagagaggagggggcatcccagacgtcttaaccaaatctcagtgactcatcaccagagagaggccaccaagccattcatgagggattcgcccccatgacccagacacctcccacttggccccacttccaacactggagatcagatttcaacctgagatttggaggagacaaacatctaaactatatcaggtacataataaaagttagagcaaagagggaacttctgcctcatgggccacagccccacccatcccgcaatgatgagtaaatggaggccccaggtaatgccaagccctttagattcctctctgttatgctggccccgtcctcccctacacatgcctgggaggcctgctgagacacccagcatctgcccgggatacagcctgggccagaaggccagaggcgctaggataaagtggcctctggctgaggttgggctggtccgtgagcactcacccgggtccagggggtggcaaagagacctcatcaggcacagcacactgtcgaggtcacacactgtgatgtgtcactgaggagccccactggagcaagcgttagcgtccaagtgctgtacagccacttccagccggtccttaaaggcaaaaatgaggccaggcatggtggctcatgcctgtaatcccagcactttaggaggccgaggtgagcagatcatttgaggtcaggagttcgagaccagcctcgccaacatggtgaaaccccgtctctacttaaaaaatacaagaattagccaggtgtgatggcacacgcctgtaatcccagctcttcgggagactgaggcacgagaattgtgtgaacctgggaggcagaggttgcagtgggccgagattgcgccactgcactccagcctgggtgacagagcgagtatctgtctcaataaaaaaaaaaaaaaagacaaaaatgctgtatgtttacacgagagtgtagaccattgacgtagcagagcagttcaggctttttcagagctgacctgtctggagtccattctggaagtgtccagctcttgcctcactttggcctcgtccgtatggcttgagagagacgtatcaccaaccactgtgtgcacagagcatttcttccaggacctgaacagccaaaccaaaaggcggaaagttgcccagtcccctctgctgtgccctgatgggatcgttggtggaattccacctctctacggaaagcactctgggacacacctcatgaaaaaggccaacctcttaacaaaagagcctttcacacaaaaattagccaggtgtggtgcgcgcctgtaatctcagctactcgggaggctgaggcaggagaattgcttgaacccaggaagcagaggttacagtgagccaagactgcaccactgcatgtcagtctgggccactgagcgagactccgcctcaaaaaaaaaaaaaaaaaaaaaaagcctttagcttgtatgcactaagccgcgtgggtgttaatcgcccaggtgttttgctcctgctctggccagcgcatgtccgtgcagctcagggagcaggaatggatgtgagttacacacctggcaggtgcccttgctgcaccagagggagctccattgccacaagccctgtctgggcttcccccagctctgcccggcctcggctccttcagtcattcatgccacagtgctttcctgagcacacgtctgtttgccagcactgggaacacaaagaaaatgagcctcgcctgctaagaggtagatctgtagcagcgggcgacaattcctaagagctcccctctcttgggggctggggccacagtgcttttccacaaagcatccagcatgcggagtggcataggcgtatctggaggagggcgcacgtggagttgtcctgccccagagccacccacacacaaagcatccagcatgcggagtggcataggcgtatctggaggagggcgcaggtgtagttgtcctgccccagagccacccacaggtctgttccattcatcaaatccgctttgatattccccatttgggcagttgaggtgatgtctgtgaacctgcagttggtggtaccagagccgtctggacctgcgctttcccaagacagccctgcctcccaaggggcccctcgctgccccacatccttggtgctcacacctcactctaggactcctccaggccacatgccagtcaccggagcatcttcccccaggctacggcaccctctgctctgcacacagcccatgaccaccagagtggtgggcactccagggtgggtcccttccagcccactccctccatgctttatccacctagcaccacatgtttcttgtcacttgtgaaccagcagagctgcagggccaggcctgcttgcttgcttccttccttccttttctgtctccctctctttcttttgctctccgtttctctctctctctctctcactcactcactcactcactcactcacactctgtcacccaggttggagtacagtggcgcaatcatagctcactgcagcttcaaactcctgggttcaagacatccttccacctcagcctcccaagtccctaagctgggactgcaggtgtgtgctaccacgtccagctaattcttgccctttttgtagaggcggggctcgctgtgtttctggggttggtgtcaaactgctgggctcaagggatcctctcacgttggcctcctaaagttctgggattacagatgtgagccactgtgcttggcctgtagactttcatctttttttttttttaatttatttgtaatttgtgtgggtacatagtaggtgtctatatttataggctacatgagacgttttgatacaggcatgcaatgtgaaacatcacatcatagagaatggggtaccgtagactttcttgactccacttcgattgcttcttccaaaatgcacacactattatgaactattttttttctgagaaagtacttaaacccacctaaaactttattaatcatccctcagttacaggactaatttaagactcatcaataagatgatatgatattttaccattgatttccatctccccccacccttttttttctttaactggtactacagaaaccaaagctcttcttttcagcaaaatccattgatcctcctcagcctaaacgtttaaagttcaatttaacatttagggagtaaaaggtctctgaagggactcataaccattgattttgtgtcagagttgaagagctaaggtttaaaacacaccgatcctaccaggttatgagagccttgtacctacagccatatggaattgtatgcttctcttactgtaggtttttttttttcttttctgcagaggttacgataaaagcacttaaagagaaaatccgagaatatgaacagacactgaagaaccaagccgaaaccatagctcttgagaaggaacagaagttacagaatgactttgcagaaaaggagaggtgagcatgacttccaggcacacacagactgacatagcatttgcccctgaacttcacatcatcagacatgttgataaatggatctgcaaaataagcccaggttgtaaccccaaatctataaggggtaaaatgtttcaaaaatgatattctggctgggtgtggtggctcacgcctgtaatctcagcactttgggaggccgaggtgggtggatcatgaggtcaggagttcgagaccagcatgaccaacatggtgaaaccccgtctctactaaaaaatacaaaaaaaaattagccaggcatggtggcgcacgtctgtaatcccagctacttaggctgaggcaggagactcacttgaacccgggaggcagaggttgcagtgagccgagatcgcgccactgcactccagcctgggcaacagagtgagactccatctccaaaaaaagatattctacatttgtgaggtttccttgagcgaaatgcatctgtctttcccaatcggtggatggtgtcaggcagccagtgggcccaagactatccaagccgtgcaggtgcagaggtgaagctcaaggcatgagtcgttagcaaggcggcacctggcagctggacctgggctgagaccagagaggaaagcccatttcccagtgtgtgtcctctggggacaagccctgggctagtgctaaactctttctgccttctcaagcaaattgatatttaatattacacacacacacacacacacacacacacacacacacacagactctctgatgtatttaatattacacacacgcgcacacacacaatctcagtgggttttttggtattgcctctttcattacctcacatatcagggagttagtatcagtaaaatatgttaatgccctatgtaactgatgtgagttttagatttctaatgacttacattaccaaaaacgtttcccacaaataatgagttggttttcccctagtgtgatgagttaatgaaagttagattccttgtaacaacaataaggactattgagcttacggatcccaaccatatagatctttttttttttttttttttttttttaagacagagtttcactctcattgcccaggctggagtgcaatggcgcaatctcggctcactgcaacctccgcctcctgggttcaagtgattctcctgcctcagcctcccaagaagctgggattacaggcatgcgccaccacgcctggctgacttttgtatttttagtagagttggggtttcaccatgttggccaggctggtcttgaactcctgacctcaggtgatccacccacctcagcctttcaaagtgctgagattacaggtgtgagccaccacggctggcctagattggatttttttaaactcatgggttaaattaaggtattaagttttatacccgctcccatcaagtaaaagaaaagcaaaaaagggaaaaaaaagatactgaattttaactctagtatgaagaaatgtatgtatccatcaacaggaagcactaaatttatgactacaggtaaggggccaagtgggactgtggctggtgtgggattttgttgttttattttcagttgacttcctatgctgaatacttggtgaacttttcttttttcttttttttttttttttttttttttttgagatggagtctcactctgtcacccaggcttgagtgcagtgtcgcaatcttggctcactgcaacctccgcctcccaggttcaagtgattctcctgcctcagcctcctgagaagctgggactacaggtgtgcacgccaccacgcccagctaatttttgcatttttagtagagacggggtttcactatgtcggccaggatggtctcgatctcttgaccttgtgatctgcccgcctcggcctcccaaagtgctgggattacaggcgtgagccaccgcacccggctcttggtgaatttttctaaggtgggctctgtaacaatatcattgggttaggaggtggggcttagacactggaccaaattgaagactagctaaaacagggcctggagagaagcagctttctataaaacatgcccaccagtgtgccacatcagtttaccattgccttggcaacacccaggagttaccacccctttccacagcaatgatctcacagcccaaaaggtactacccattccctagaaatttctgtataaactgcctcttaatctgagtacagattatgagtacaaaatatgagtacaaaactgtcctcagctgctactggcagcacacggcctatggggcagtcctacctcacgagaccagtcacagagctgtaacgctgccacctccataaagctgccttcttcagccctaccaccagctcgcctttgaattccctcctggctgaagcccagagcccttgccagctaagccctcctttggggctcgcctgccctgcagcatcatgaaggcctctgaggaatgccattaagctgacttcattcaaaaagaaaactggctgggcacagtggctcacatctgtaatcccagcactttgagaggctgaggcaggaggatcccttgaactcaggagttcgagaccagcctgggcaatatagagatatgccatctctatggcatgaatgaatgtatgaatgcgccatgcatgtcagcatgtgcctatagtctcagctacttgggaggctgaggcaggaggattacttgaggtcaggagttccaggctgcagtgagctatgatcaggccactgcaatccaacatgggtaacagagcaagaccttgtctcaaaaaagaaaagaaaagaaaagaggctgggcgcagtggctcacacctgtaatcccagcactttgggagggtgaggtgggtggatcacttgaggtcaggagttcaagaccagcctgaccaagatggtgaaaccccatctctactgaaaaaatacaaaataagccaggcgtggtggcacatgcctgtaatcccagctactcgggaggctgaggcaggagaattgcttgaacccaggaagcaaaggtttgcagtaagccgagatcacaccattgcattctagcctgggcaacaagagcaaaactctgtctccaaataaaaaataaataaaagaaaagagaactgccagctcccgcccacccggggccctccctgcatcagaacttggccgtaggctttcagtacattctctcactaattgcccagaatggatctgcaatgtagaccatctcttttcatagagggagaaagcaggtcgtgggtgaggtacctcctacagcttttgcggctaatcagggccagaggtgggactttgcaactccagactggcacctgcccatctctgcagcccttgcctccccgtctgctccattgtggccacctggagccctggttgccggaccaaggccagtcccttggggccacgcccaactctgcaggtggaggccgcatccatcgtccctgggggagcgcggcagggcacagactccaggaaaggagtgcgcatcacagagtcaaggctcggacagatgggcagacccttgaccccgttgatacggatttggtcctaagtaaatgccttttaggaaagcactcctcaccagtgagtgatcaagggggaaaacgcgagcaatctcagtgccctgccatggagaaatgggttagtaaaaagaacggaccatccctaactgggatgttatgtcaccgttaaaatattaataatagttatggagaattcatagtaacatgagaaacgtacctaatataatatgaagtcaaaacatgcaccgtacaaaattatttacagtgcagtatgattgtacatcttcctacagcaaactcatgcattaccacaatgtggaaataaacacatatgggaattaaatattattaagttgacttttcttgttttttgagacagagtcttgctctgtcacccaggctggaatgcagtctcacaatctcagctcactgcaaccctccgctccaggttgaagtgattctcctgcttcagcctcctgagtagctgggattacaggtgtgtgccaccaagcctggctaatttttcagtagagataggttttctccatgttgctcaggctggtttcaaactcctgacttcaggttatctgcccgcctcacctcctgatgtgctaggattacagacataagtcactgtgcccagctcttgacttttcaaattaggtaaagggattagctatattaaaatatacaataactgattcttagagggaagggctgaagctagaatttacttcattcattttgtgtgtgtgtgtgtgtgtgtgtgtgtgtgtgtgttttgagacaaagtctctctgtcacctaggctgcagtgcagtgacacgatctcagctcactgcaacctccacctcctgggttcaagcaattctcctgcttcagcctcccaaatagctggggttacaggtgcccaacatcacacccagctaatttttatatttttagtagaacaggatttcaccatgttggccatgctggtcttgaactcctgaccacaagtgacctgcccaccttagcttcccaaactgctgggattacaggcgtcattctttataacaaaaaattgttgatggatctaggatttaaatattataattttttgtcacaaacatactggaagaaaactggggtgcatatttgtttttattaatatgactatataaaacttaaaacagattctcaaaaacaaataataacattttaaaaacatcaacaaactgaagaaatatttgtaccatgtaagacaaaaggctaattttctttatatacaaagaggacttctaaattaataagaacaaaatccgctctacaaaaataggcaaaggagataagtaggcatgtcatacaaagagaaataacatagctttactcagcagtaaaaatttaaatttgattttatcttgtgttggcagagtatacgaaaacacacttacatattgttggtgggagtttaaattggtgaaagttttttgttgggaagtttttcactatctatcaaaacaagaaaagtggccaggcgaggtggctcatgcctgcaatttcagcactttgggaggctaaggcaggcggatcacttgaggccaggagttcgagaccagcctggccaacatggtgaaaccccatctctactaaaaatacaaaaaacagccagacttggtggtgcacacctgtaattccagcttcttgggaggctaaggtatgagaattgctcgaaccctggagcagatgttgcagtcagccgagatcatgccattgctctccagcctgggtgacagaacaagaccctgtctccaaaaaaaaaaaaagaaaaaagaaaaaattgcagatactctttggccattgtaattcctctgttagcatttcatctccaacagattcactctcaaaattatacagcagtatctccacaatgatcgttgagggactgttcagtagaaagaaacctagaaacaatctgagtgtccacagaggcttaagttaattatttaataagaatgagggagaactatgtttgctggaatagaacatttccaaaatacagagaaaagtgaataagggaccccagaatgtggtgcacgttgtgatcacctttgtattaaaagaacagggcagggagattatattatactatactatattaaacacttctatttcagtagcctatttcatattcatattacactatagtatattacattacttcattattacactatagtatcctgcatattagttcgtactatgctatagtatatttcattcatattttgctatactatgtgacatattaatttatattgtgctatagtgtgttacatattcacattatgttatagcatgttacatattagttcatattaagccgtagtatattacattagttcacattccactataatgttacatattaattcatattatgctatagcatgttacatattagtttgtattacactatagcttgttacgtgttagttcatgttacgctctagtgtgttacgcattcgttcatattacgctgtagtgtgttatgtattagttcatattaccctataacgtgttacatagtagtttatgttacactatagtgtgttacgtattagttcatattatgctatagcttattacatattagttcatagtacactatcatttgttatgcattaatttctattatgctatagtgtgttatgtgtttgcttatattacactataggctgttacatatcatatgttacatattcatattttgctatagtatgttacatatttgtttatattacactttagactgttacatatgatgtcgtatttctgtacatgcagaaacattttagaaaaatacaaatgaactccatctgaggagcggaaatgagccaaggaatagtaagactctttcacttcccatgctcttgtcatatttgattacatccctgagtgtccataattgaaatacatgaaaatattaacagtgcttttctagaggtgatgagaattgggttgactttgtaaactgtgtcatttctacttttctgtatcccagtttattattatgagagcatatgttaaattcatatgatataaaaataatcaacttatttttggaggggtttttttttttcccccagattaagaggaaggaatgctatttattgaccagggaattcacttagagatcctgggaaatctgaatctgtggaatgcagttgcgagcattcacaatgtccccattaggtattgcagttgcgtttgcattccattataacagagacggaacagctgccacatctatttagtgcatcctttattccaacaaactccttcattgtgtcagcagaatgtaaatggatcattcttcttgcgctaacttcagaaaacaatgagtgcatgatgatgatttttttttttctttttaaaatctggcatttcaagaacaaattacatttaggataaccttctacgccagttaccacccatcaagccccacgggttgcacacttgccgtgatgtgacacgcagttacaaagttggggtgtggaagctgcgggagcggggcccacggcacacgtgtcgttgcgggcgataccccgtggtgcgcctgccgccagctgagcgcagggagggagctgagctcagccgaaaggcacacgtgcatttcagttggtaaaggagatgaccaatttggcttcgtcctcttcctttgcagaaagctgcaggagacacagatgtccaccacctcaaagctggaggaagctgagcataaggttcagagcctacaaacaggtttgatactctccttcctagtaccatggatgtggggaggacccagggggagagttgggtcagcccctgaccgccccggtccccgcggatacctgttgctcttcggggccgtgggagctgccgggagcccacgctgaagaattccgcagcacgcccgccagctgctgcgcctcattcctcactgactttgagttgttaatgtagaggtgggaggatctcgattccattttcatcccttccacacgccatccttgcttcctgctctttttccaacaaacacttctaaatcaccaaactgtcaaggactgacatttcatttggaacaataatagaaaaaaaaaaaaaaactcacttctaccctaagtgaagttaaggagaacagtaatttcagacctttaaaatttaaaagccaccaaaaaaggttatgctcaagtttttacagtatctttaaacttctttctctctctctttttttttttttttttgagacggagtctcgctctgtcacccaggctggagtgcagtggcacgatcttgactcactgcaagctccgcctcctgggttaatgccattctcctgcctcagcctcccgagtagctggggctacaggcgcccaccaccatgcctggctgattttttgtatttttagtagagacgaggtttcatcatgttagccaggatggtctcgatctcttgacctcatgatccgcccacctcaggctcccaaagtgctgggattacaggcgtgagccaccgcgcccagccctctctctatttctttttttgttttgttttgtttttgttttttttttgagacagggtcttgctctgtcacccaggctggggtgcagtggtgtgatctcaggtcactgaaacctttacctctgtgggctcaagcaatcctcccacctcagcctccccagtaggtcggattacagatgcccgccataatacccgcctaatttttgtgtttttagtagagatgaggtttcaccacattggccagtccggtctgtatctcctgagctcaagtgagccaccacacccagcctctcttttttatttctgaaagagaagcatcaccatgtatttcatttaaatgtatttttaaatttttattattttttttgatgacccagaactgagcagattatttaaatgtagacagacatcagaagtcataattcaacttaaaacacaaatgacgagagtgggagaaaataatcaccacaaatttgacaaacggataattaaaaaatgtaaaggctgtaaatcaatccattaaaggagagaaacagtgcagtcgaacaataagcaagggatatgaacagtcagttcacagaagaaatgcaaatggaaactacacatatgaaaaaatgcaaagttttttttacagtcagggagatgcagattcaattagtgaaagactgttttgcctgtcagactgacagcattttttaattatttatttatttatttttgagacggagtcttgctctgttgcccaggctggagtgaagtggcacaatctcggctcactgcaacctctgctccccgggttcaagtgattcttctgccccaggttcaagtgattttcctgcctcagcctcccgagtagctggcgttacaggcgcatgccaccatgcccggttaatttttgtatttttacgaggtttcgccatgttggccaagctggtctcgaactcctgacctcaagtgatccacctgcctcagcctccgaaagtgctaggattacaggcatgagccactgcacccagcctaattttttatttcattttagagacatggtctctctctgtcgctcaggttggagagcagtgatacaatcatagctcattgcagcctcaaactcctgggctgaagtgatcctcctgcctcagcctcccaagtagctgggactgcaggcaaacaccaccacacatggctactttttttttcattatttcttttatggacatggagtctcactgtgttgcccaggctggtcttgaagttctggcctccagtgatcctcccacctcagtgtcccaaaatgctgggggattacaggtgtgggctaccgcacctggcctttaaaaaaaatatagcaattctggcctgacaaagacttgtcaaaaattattgaaacatccagtgttggtgacggtgaagtggcacttatggaatggatgggcatggaaggagcctcttgggaggccagctgggtggcatttatgtaaagctccagtgcccaagctgttcagccagcagcttcacttccaggtatcctgatgagagaactgaaggttattgccactgcctgggtccacatgtggaaggactcccataccatactgcccagggaaaaaggctagtctcaagaaatattcataccgtcccatttatgggggtagaaaataaaaaaagatatatacacacacatatatacatgcaattatgtatggaaaattttttcttaacgtaaaatacactttcttttattttgttacacttttttgaaatgagtctcgctctgtcacccaggcctggagtgcagtggcatgatctcggctcactgcaacctgcatctccagggttcaagtgattctcctgccttatcctcccaagtagccgggattacaggctatgcgccaccatgcttggctaatttttgtatttttagtagagacagagtttcgccattttggccaggctggtctcaaactcctgacctcaggtgatctgcccgtgtcagcctcccaaagtgtgagccacctcgcccaaccagaaataataaaatacaccttaaaacatgaaatcatccaggtacagtggcccacacctgtaatcccagccctttgggaggccaaggtgggaggatgacttcaggccaggagttccagaccagcctgggcgacatagcaaaaccctgtctctacaacagtgttttaaaatattagccaagcgtagtggcttgcacctgtagtcccagctacttgggaggctgaggcaagaggatggcttgagcccaggagttaaaggttgcagtaagctgtgattgtgccattatactccagcctgggtgacagagtgagaaaacttgtctcttaaaaatggaagggaaagaaagaaagaaggaagggagagtgggaaagaagaaaggaagggagggagggagggaggaaactattaacattggttctgtctttgtaggtgcttgggattagatgaggcagaaatgaagggggatttcctattccattttttgtattttcatcatcttggcctcttttgtgtgtttttaatctttatttttccacgcacctcgctcctcacagaaatctttgcctcttttgaaatgggaatagattacctgtgtatgcattcttttaaaatttcatttaaatagttagtaattctttgcctttcagccctggaaaaaactcgaacagaattatttgacctgaaaaccaaatacgatgaagaaactactgcaaagtaagtctctctgcttggcctcccttatccgtacacatttctcacctgattttgcttgagtagggcaggatcgagaaggttcttgacctctgtgctgctgcagggacacagtgtatttcccatgagttacttgcgtcggttcaatgcacgttctagcactcactgggtaatccttccaacaaacttctttccttctttattgtgaaggctggtcactgctatgccttctgccatgaaaatttgggagttagtttatataagatgtgacacatgggacattttttgtgtggagttgagtctgggtaaatcacatgtctttttcgctgggccacagttcttcatttctcccagggccctttaggaaggcctgccccagaataagcacattcccacgcaggcataggggttcatgtcacacctaacaacgctaggtgtggatatacggatagacacagattcgggcaggcagagtcacaaaaggccaattcctacccagctcttgtccaaaggaaattagaggtgtccactacaagtgtactttttacccgcccatctttcatgcagaacaccagcaaggaagaaataataattgacataaatcatgaaaagatgaagaaatggcagaaattgctcctagccattgcctcctctaccaaactcccggggagcaatgccaggctagagtttgaaccactttttcctgttctggaaggctcttcccatcttccgcggaaacacacacgcgtgcttactgccatgtctcttgggtttccctattccagttacaaaggtccccgcactctgctcacacagtgcctccgtgggcatcggcaagaagacgggtacttctgaatggcgccgctgtcccaccaggctccacctctgtatggggtgccggcacttactgtccctctgccccatctcacgtgaccttgggctttgagggtgctgctgggtctgttgctttcaggatgctgtgtggggttcttggccctttgctctgggtcatttagtagcctgagacctcgagagcccagcttcgtagcctggtggtcagaatggattctgatcatgagtatgaaacttacaaagactaaaacatcaccactagatcagctactctcttctctcaattactgcttggacctgattaagcaacttacttacttgcactaagtaggttgtttttctcagtaaatctgatttttaaaacttactatatttcaccgagcatggcagtgtgcacctgtagtcccagctacttgggagcctgaggtgggaggatcacgtgaacccaggagttgaggctgcagtgagctgtgatcgtaccagtgcactccagcctgggcaacagagcaagaccctgcccctaaaaaaatttttaaaatattgttttagttttaaaaaacatgtcaggggctgattgtccttcacataaaaattagccctgtctcaggactgtagctgagagggcagtggctctcttggggtgcgccccacctgccctctgaagtaagaaacattcttgtctccccagtggtgagccaggccgaggggtgtggtgtgcatgaagggagagagactcactcggttagatgataggcatggctcagagataatagattcattcattgattcaacagacattcacagaggcttcctctgtgcctcgccctgtgcaaattctgagactgttacggctccatggggagacaggccattgcaatccagcatgcccagtgctgcaatcaaggggacagggcgctgacggtcagcaggtcagacagggagcctgcaggtggcaggcagggcactcccattgggatagtcagaagaaagtttggcagggtgcagtgactcacgcctgtaatcccagcactttgggaggccgaggcaggtggatcacctgaggtcaggtgttcgagaccagcctggccaacatggcaaaaccccatctctactaaaaatataaaaatcagctgggcatggtggcgtgcgcctgtaaccccagctactgaggtggctgaggcaggagaatcgcttgaactctggaggcagagattgcaatgagccgagatagcaccactgcaccccagcctgggctacagagccagactccatcgcaaaaaaaaaaaaaaaaaaaaaaggtcaatattgggcctatttgcagaggtgcagttcctaggctcatagtaccggcagggtttccacgcctgggtttgaatgagccagagcggggaaaggtagctagagactgaaggtgagggccccctcgaggggagccgtggccttggggagggaagagggacccagggcagcgccagggaccccttaactgatcccctctctcctcccaccagccaggggagctggggaagggcatagtacatccctagcatcaggggagcgcagggaaagaattgtcgaggaagccttcctaaagagggtggtatgggattcgggattggaagatgagtcaagtcaggttttgcagaggtttgtgaagatgcaagcctggcgaagcctgtcttggggaggacctgccagaggttccgaacgatttgcctgtggggtaggatggggcagcctggtggggcatttcccacatcagaaacggtctggacactgacaaaggcagcctaggaccaaccacgtaatgtaatagttcccagagtaagtcatcccccaaaaatgcagagaatggcctgagagaattggatcttggctactttcttttaactttggaggccatgggctcattctgagacctcccccactgcctttgcctccccttttattttccaggacagatttgtcactattccgtctgcttcaagtccaacctacatgtattttattagaccagacacgttttcattcatgtttgtgaatataagccccttggggcaaatcttttcacatatggtcttacagcatttcaaaaacaatttattttccctcttctgaaggagggattcttagggccaggcgcggtggctcacacctgtaatcccagcactttgggagcctgaggcgggcggctcacttgagcccaggagttcaagaccagcctgggcaacatggcaaaagcctgtctctacaaaaaatacaaaaattatcctggcatggtagctcctaactgtagtcctggatacttatgagtctgaagtgggaggatcgcttgagcccaggaggtcgaggctgcagtgagcctaattataccactgcactgcgacctgggtgacagagcaagaccctgtctaaaaaaaaagggattcttaaatatttgttgacgggaattggagaggcatgaaggaagatgggttttggagaaagactgacttgggattgattcactagggtccactacgagctctctgcgtgaccctgaatgagctatgagctgtccacctccctttctgacctgtacaatgggcataccggaagtcaagtcactgggtggtttttgttgttgttgttgttgttgttttgttttgagatggaatcttgctctgtcgtctaggctggagtgcagtggcacgatcttggctcactacaacctccacctcctgggttcaagcgattctcctgcctcagcctaccaagtagctgggattacaggcgtgcgccaccacatccagctaatttttgtatttttagtagagacggggtttcaccatgttagccaggatggtcttgatctcctgacctcatgattcgcccacctcagcctcccaaagtgctgggattacaggcgtgagccactgcacccagcatgctaggtggttttgaagaggcaggaatgggatgtgtgtgtatagcacctggcatggtgagagtctgaggctaagctgtcgagagatagaagctattcccagcaagctcagagcagggcgtggtatgcgtttctgaaattaacggccttggaggaaattgactttcaccgcatcaccacgacggactgggcccacattgtctgtctgtcgtggggagatgtcacagggtacccatccctctcccgttttggagagaagcccgcaggtctgtggtactgaggctgctccgagaccccggtttatcgtgagcagtcatcgccatgcgtcagctgggacagcacgggctgactgtggcagacaacggcagtaaagttttccatgtgtaggcttgaagcaaaatgtaattagcctttatgtgcagaacaagggcccattgatgaatacagctggtctttgttttgtcctgtcgttgagagtgggaggtaaaagtgttcttcttcatgtttattaatgcaagattccttagacaaatggcaagcacagtttaatatttgttggaacatgggggctttgccaaaacagttgttgtgtaagaggattgcaaggtttccgattataaccatttctgggttaaataaatgaattatttctgccctttttttcttttttgaaatttttttagagtcagggtctcactgtgttgcccagagtggtctcaaactcctggcctcaggtgatcctcccgtcttagcctctcaaagtgctgggattacaggcatgagccactacgcctgacattcttttttctttagttaaaaacatagctccttctcagatggtcaccctgtgtacggatcttcccgcttctcttagcaaatggagatttaccaccctaatagccttaaccttggagactctagcaaaggaacgtgctgtggattttaacatctaaacaattccttgggatggatggccgtggaggtggcagatccctggaatcacgcagcagtaggcagcccagagagaggcctgggcatccctcactgccccaagttcctgcatccgtctcctgcagctgttcacttacttgatcttgggtttgggttgctactgcaccctccagcaggaatgtcgccctcccagccaagcggctagtgttctgggcaaaaatgcaggaattcccatttttgctgaagtccacgatcctatgccctgtccccaagaatctggattggaaaaggagttccagctgcaatacacacagtcagcttcttgcattcctccccactcgtgggccgaggcactgagcctcgatgaaagaaaatattgaatcgcactgaaatactacattttttatagctaatgttagtcttaggagaatttgcacctcccaaacctttcctgccagtaaaattcgtatttcttaaggttactcatgttgtattcctagcctatatgcttttttcaaagaacgacattgtgtatacacatacttacatagtacggttacaaaagagacatttacgaggaacttcacttaggttaattttagagtattttctttataacatgtatataaccagtactttatcacaaaatacaacgtgctctgaaacagcagaaaactttcccgtagctaactcagcactggggagcctctacgcttctttggagggatagagaactccagatcccaaaggaggacataagacagaatttgaaaaggggaggaggctgggcatggtggctcacgcctatcatcccagcactctgggagactgaggtgggaggatcacttgagcccaagagtttgagaccagcctgggcaacatagtgagaccccacctctaccaaaaaatacaaaaattatctgggcatggtgttgtgcctttagttccatttacttgggaggctgagttggaaggttcgcttgagcctggaagttccagcctgtagtaagctatgattgcatcactgtactccagcctgagtgacaaaacgagagcccatctctaaaaataataataataatttttaaaaggaggggaggaggataccagcagttcaagacacaagtctgcatggcaaatgtgggtgggatggatactttctttttattttattttttatttttttgagatagggtctctgttagttattcaggctggagtgcagtggtgcgatcatggctcactgcaacctccacctcccgggttcaagtgattcttctgcctcagctgctggaggagctgggattacaggcttgtgccaccatgcctggctaatttttgctttttggttttttttttttttggagactgagtctcgctctattgcccaggctggagtgcagtggcacgatcttggctcacggcatcctccgcctcccgggttcaagcgattctcctgcctcagtctcccaagtaactggaattgcaggcatctgccaccacacccagctaatttttgtatttttagtagagacgaggtttcaccatgttggccaggctggtctcgaactcccagactcaagtgatctgcccgccttggcctcctgaagtgctgggatgacaggtgtgagcagctgggatggatactttgtttacatactgttctggactatttcacaatgatttcctgagtgttatcttgtttgccctttcctgaagtcactggggcagcttttattgtgctcattgcatggatgaggaagcagtcccaggaacacgcagattcaggccctggacctggtcctttaggctcaaattccagtgctttttgcttgagaccacggcggtcttcaaagcccctttctggtgccagctttgtaatcaagcagcaaaggtgagggctagtcaggtgaaggcaggcgttcctggggggttcagcctttcccagcctcacaagcccccgttgtatttaccatagcagattgatttttccctttttgaacaataattcctcatgaaagactcacagaactggggccaggtagagcccggttgagtaaacctgagaatcacccagctgtcttgaccatcatatttagacaaatattgcatcccctgattgaatttgaaagggacaacttaagcatcctgaaaacagagtctgtctgctgtacctttaagaatgtaaaattttctatttcctgtctttttgatgagtcatcagtttccagtacgagttgctgtaattaccctggttggattaatttccctaaaaatagagaagcagccacttttatggttttcagagtatggacttgaataaagaacctcctgtcctttaaaccttagagagcactaaatcagacttgcagggaaaaaccgatggccttttttttttttcttcctgtgtcttatctccaaaaggggcttgtggattttgtagaattcttgggatttttcatctctgtacaagtattttgctccacacctaaaaattgatgcctgggtgagccctgaaggattttccttgtcttttgtagtaacaccagctgtcttggccccctctgaatagtacaaccatgacctggtgtctccccaggttgggggctagacaaaaacaagggggtggcttcatagttccaagtccaggtagaaattcctctgagcgctgacgattctttgccagttctgtggcccccagacatggctaggaaatgtaattgacatgtaatagacatgtctattgcaaagcatcagtgagaattgccaaactttactcctctccttcattgatgtttagggaagggctgctttactgtggtaggtgtggtgtcaggtgctggaacgatagagtaaggacagggtgggagggggcttacagacgtcacatgcacacacacaggctcacacactctgtactcaaaaacacgtacacataaatagagaggcagccgggcacggtggctcatacctgtaatcccagaactctgggaggccgagatgggtggatcacctgaggtcagaagttcaagaccagaccagccaacatggtgaaaccccgtctctactaaaaatacaaaaattagctgggtgtggtggcgcatgcctgtaatcccagctacacgggaggctaaggtaggataattgcttgaacttaggaggcagaggttgcagtgagctgagatcgcgccactacactccagcctgggcaatagagttagactctgtctcaaaaataaaaaaaaaagagaggcactgtgcatgtggccatgtatataaacatgtttgtgaatataaacatgcaatcagtttttaaaaaatttttatcggccgggcgcagtggctcatgcctgtaatcccagcactttgggaggccgaggcgggcgaatcatgaggtcaggagattgagaccatcctggctaacacagtgaaaccccatctctactaaaaatataaaaaatgagccaggcgtggtggcgggtgcctatagtcccagctactcgggaggctgaggcaggagaatggcgtgaacccgggaggcagagcttgcagtgagccgagattgtgccactgcactccagcctgggtggcagagtgagactccgtctcaaaaaaaaaaaaaaaaaaattatcatacagtctctcaaccagtcctactgcttttttttatttattgattttgagacagggtctcactctgtcacccaggctagagtacagtgatgcgatcttggctcactacaacttctacctcccggtttcaaacgattttcccacctcagccacccaagtagctggtatcacaggtgtgtaccaccacacctggctaatttttgtatttttagtagagatgggggtttcaccatgttacctaggcgggtcttgaactcctgagctcaagtgatccactcatctcggcctcccaaagtatgggattacaggcatgagccaccgcgcctggccaataaagcaatcatattcatccagcatcctttgagagggtagagaaaatcattattcacagactgtcacctgggtttggcgtgcattcctacagattttacctatttaagagatccttaaagtttttctgattcactgttaaggtaagcctagggatcttgcagtgtatatgtgaaggaaatgggtaacggactgttgagtgaatacagtgtatagattgtagcacatatggtgatctgtgaaacgggggtgtcatgacacaccccttcctgcatcccaaaattgtgggggtcagggtggataacgggcatttctgcagcctgcacagcagtgccgaatgcaggctgcaatccagcaatgtcactgctgggtatttatccaaagaaaggaaatggctgtgttgcaggcatacctgcactcacacgtttatcacagcgctgttcacacagcagcctaggtgaggaagtgacctatgtgcccagcttcagatgaatggatgaagaaaatgtgtagatccacagtggaatatgatggagccttacaaaaggaaatcctgccatttgcaacaacaacgtggattcatctgggggatgttacattaagtgaaatgaaccaggcacagaaagacgaataccacaagatctcactcatgtaaaacgttgatcacataaaagttaagaagaatggtggttaccagggggtgaggagaggttggttaaatgatacatatttataggtagacaggaggaataagtttgagagatgtattagacagtgactatagttaatgccggtatattgtaaaattggttagtagaaattttttttttttttttgagacagagtctcccctctgttgcccaggctggagtgcagtggcatgatctcggctcactgcaacctccgcctcctgggttcaagcaatttttatgtctcagcctcccaagtatctgggagtacaggcacagggcaccacgcccagctaatttttgtatttttaacagagacagggtttcgccatgttggccaggctggtctcgatctcctgacctcaggtgatctgcccacctcagccttctaaagtgctggatttacaggcatgagccaccgcgtctggccccattttttaagtgttgactgaaaactacctcaaaagaccggctttatcccacactctgtacaccacaggcttagcacgtcgtggctctccaggaactcttgagccttccccatgatgatgagtgggtcagggttaccgcagagctgaacggcctctgtagcgttcagcctgcagcctgcccaatgaggacgtttgcgctctggaaaggtaaactcaggatgctgttggctcctaagcagaaagcaggcgccacccagccttcaagtgcttcaacagtgaagagttaggacggaggcccagcctggaacattcacgccaccttctgcccccagtaaaattccttaaagctatgaggttctgactcaccacggggagtccctggccgccgctgggagggccttggccatgcaaatctcagtgacatagcacgtcttatttgcttcagaagtggcagaggagaaagtgacttgcctcacgctgcccggttccacccagggaccttgtgaagagacgcgggaaggctggcagaaaggagaaccgtccttcctgtggaatactcccgagatcgcaccactccactccagcctgggtgacaagagcaaaactccatctcaaaaaaaaaaaaaaaaaggcactgtacatgtgtccatgtatataaacatgtttatgaatatacataaataattttttaaaaaattttgtcatgcagtctcagccagtcctgctgtttttattttattttattttattttatttatttttttgagacaaggtctcactctatcacccaggctggagtgcggtgatatgatcttggctcactacaacctccgcctcctgggttcaagcaatcttcccacctcagccacccaagtagctggaattataggctgtttccttttacatgacattattttcccttttttatgttttattttattttatttttgagatagagtctcactctgttgcccaggctggagtacagtggtgcgatctcagctcactgcaacctctgcctcttgggttcaagcgattctccagcctcagcctcccgagtacctgggactacaagtgtgcaccaccatttccggctgtgtgtgtgtgtgtgtgtgtgtgtgtgtgtgtgtattttttgtagagacggggttttatcatgttggccaggctggtcttgaactcctggtctcaagtgatccacccgcctcggcctcccaaagtgctgagattagaagtgtgaggtaccacgcccggcccgtgacattatttttaagtacaaaagccatacatgtttactatacaaagtttagaaaattctcaaagattttttttaaaggaagcagatcatcactcataatcccacagcaaagatgatcattgttaacattttggcctatttccatagtctttttttctatacagattgttccttacaatggcattatgtcccctaaacccatcgtaacttgtaaataccttaagtctaaaatgtgtttagcacacctaacctaaatgtcatagcttagcctcgcctattttaagcgtgctcagaacacccacgttaattagtctacagttaggcaaaatcatctaacacagctgtccccaaccttgttggcaacagggaccagttttgtgaaagataatttttccatggaccagtgcagtggggggcgcggttcaggatgattcaagcacgttctatttattgtgcactttattattatgacattgtaatatataatgaaataattctacaactcaccatcatgtagaatcagtgggagccctgagcttgtttttctgcaactacacagtcccatctgggggtgatgggagacagtgacagatcatcaggcattagattctcataaggagtgtgcagcctagatccctcgcatgcgcagttcacagtagggtttgcactcctatgagaatctaatgctgctgctcatctgacgggaggcagagctcaagcagtcatgagagcaatggggagcagctgtaaatacagacgaagcttccctcctgcagcgcatctcctgctgtgcggcccagttcctagcaggccacagatgtggccaagggactggggacccctgatctatatagtgctttcttttttcttttttttctttttacgagatagggtctcaccctgtcacccagcctgcagggcagttgcactatcatagctcactgcagcctccaactcctgggcttgagcgatcctcccacctcagcctcccgagtagctaggactgcaggtgtgcaccccacaccaggccagttttgtattttttgtagagacagggtcttgccgtgttgcccaggctggttttgaactcctgggctcaaacaatcctcccaccttggcctcccaaagtgctgagtgggattataggcatgagctgcttcgcccaaactcgtctgttttttaccagtggcatagactgataacatgattttgatttctagggtttgttttttgtttttgtttttttttttacctgacatgttgtaaatatttcttgcttatcattaaatattcttcagaaacacagtgcatactgcataacattccatcacgtaggtgagccctaagacttaccacttatttccctgctgttcaggagcctgatttattacactgctttcattgccctttggggtttaatctggggagctttgtccctgttctttctatgccttcatgttctgccagtggctgtggcatctttttcgtgttttttgtttgtttgtttgtttgttttgttttgtttgagacggagtcctgctctgtcacccaggctggagtgccgtggcatgatctcggctcactgcaacctccacctcccagatttaagcgattcttctgcctcggcctcctgagtagctgggactacaggtgtgtgccaccacgcccagtgaatttttgtatttttagtagagacagggtttcgccagttggccaagctggtctgacctcaggtgatcggcccacttcagcctccagaagggctgggattacaggcgtgagccaccacgcccagccggctgtggcatcttgaggtagcctcccaaggccatcatcagacaagagcgtttggaagcccagaattctccaagggctcatggcagtactggcacggggcctctgttcctagactgctgctccatgacgtttgtagatgcctctagtgaaaagtcagggacagtggatgatatgcacggctcagagaccctgactctggtcccatctgtccccaggtgtgaccccacaaagcccctccctcggccgcagcaccggattgggccgggtgccaggcaggacggaggagctggcccttttgtcagcctcttgcactttcttgcccagttctacttcccagagacctggatctcggatgctgtcccccagcagggcctgtttgtggagtggccttcaggcagggctgcatccagggcaccgggcacagcatgagtcacggtgggaagaacctgggtcgcaacatcgtaaagacctgggtttaattcccaactccatgaattatgtaacctcaagcagggcaggaggtttccttactcagaccttagtattttcataagtgaaataaaagaatgccacgcctcacctgtaatcccagcactttgggagatcaaggcaggtggatcacttgaggccaagagtttgagaccagactggccaacatgaggaaaccctgtctctattaaaaatacaaaaatttgctgggcgtggtggcatgtgtctgtaattctagctactcgggaggctgaagtagaagaatcacttgaactggggaggtggaggttgcagtgagctgagatcccgccactgcactccagcctgggcaacagagactctgtttcaaaaaaaaaagagaaaagaatgccacattagtgcctggtacaggacctctataaagggtggctgacattgctgctcctgctgcctgcaaggcacctggcatcacctggcacattttaaaaaggtctgcttacctccccctgctcaaggtctcttcccactcttaagaattatgtcgctttccatgatgagtttgtaaaaatcattatccgcactgcaagacctactcatccatattagcgtgccacagctggggcacccaggtgtaaagctttgtttcccatcatcttcctcagggaccctaaattttaaaatctgcatcagtcaccattgaggtgccactaaatgtggtggccaaaagttccaagttcaaaccattgcacagctgcaaatgccttcatagatgggtctctaaaaaatcaaacaccagggctgggcacagtggctcacctctgtaatcccagcactttgggaggccaagatgggcagatcacttgaggtcaggagttcgagaccagcctggccaacatggtaaaaccctgtctctactaaaaatacaaaaattagctgggcgtggtagtgggtgcctgtaatcccagctactcgggaggctgaagcaggagaatggcttgaacctgggaggcagaggctgcagtgagccgagattgtgccattgcactccagcctgggaaacagagtgaggctccatctcaaagaaaaaatcaacaccagaggttaataatctagtaactaactgtcttctatgtgccacatttttgcaagatccaagttttaaagtgagaacaagttgttcggtccccgcccagctgactgtgacaccaaggtggcggcccgcattggagatctggttccatctgacttggaaaatttggggcaccgtgggctggtgtgaaacaaattaaaagaggtgccaaacagccaggcacccagcaaggatgcccagggctcttgttcggggatttcgttaaaaaactttttggaacccacctcaaagaatgaaaagtttcctataggaaggcaggagcgagcgagataattgaactcattgatttccttcacggcttgtttgccctttcattctcttcccgaggtgctatttgttgaggaatgtctccaattgccagaaagacagtggggtgtctcatatttcctcgccacctctcctttcagccagtgctgagttctaaggcaagcctgcaatatgaatttttaatgccgagctttatggcatcactcccgcacagcccgactgcatcactctcctgagccttcagatttaatgctccaatgaacagagcaaagactggggcattcaacatcagtgagaattaacccccacatgaccacagcagtgccctctgattttcctaaagagggttgggaaaaaataaaaattatgtagtgttggccgggtaaggtggctcacacctgtaactccatcactttgggaggctgagatgggtggatcacctgaggtcaggagttcgagaccagtctggccaacatagcaaaaccccatctctactaaaaacacaaaaattagctgggcgtggtgacgggagcttgtaatcccagctacttgggaggctgaggcaggagaatcgcttgaacccaggaggcagaggttgcagtgagctgaaatcacgccactgcactccagcctgggcaacagagcaagactccatcttataaaaaaaattatgtagtgttgagaatccttgctatccaaatagcctgaagcacaaaagcacagcttattcttgaaattttatggaatagcctatattttgacctttttgcttcttctaagttggacgatgtgtgcttcgaagcatttctgtgatcttcccacccttaaaaaaaaaatctctgcaggctgggagtggtggctcacgcctgtaatcccagcactttgggagactgtggtgggcagattgcctgaggtcaggagttcaagaccggcctggccaacatgatgaaaccctgtctctactgaaaatacgaaaattagccgggcgtggtggtacacgcctgtagtcccagctactcagaaagctgagtcagcgagatcatgccactgcatttcagcctggtcaacagagtgagactccatctcaaaaaaaaaaaaaaaaaactctccagtttgtaggatttaatgaatatatagatgaccggctgttctgcggtttccgtggaaagcccaaatgtaattagaaatccaatttccgatcgatttttccaatggaaaaaggaccagttgtgttaagtggctaattctttttttatgcagatggttgattgtcattttcttatagtagctttctgaatttttgcagacgtcaaaactaagaaaaagttgtatataaaaattgctcaattggccaggtgcagtggctcacgcctctaatcctaacattttgggaggccgaggcaggagggtcgtttgaggccaggaattcaagaccagcctgggcaaaacagcaagacataatttctgtttaaaaaaaaaaaaaaaagtttgaacataaaaactgctcaaatttaagtacattaaagaaggacagagtctttagtaaatggtagaataacaagccaactatgtagaagccagtagaatcagagctgagccccatgcaaaataaaatctatttagttatttttatttattttttattttatttatttattttttttttttgagacagggtcttgctgtctcacccaggctgaagtgcagtggcgtgatcttggctcactgcaacctctgcctcccaggttcaagcagttctcctgcctcagcctcctgagtagctgggattacaggcgcgcaccaccatgcctagccaatttttgtattttagtaaagatggggtttcaccatgttggctaggctggtcttgaactcctgacctcaagtgatccacccacctctgcctgccaaagtgctgggattacaggcgtgagccaccacgctcagtttagatgtttaaaacatttaaatgtgaccagaaagaaatccataaaaacactaggagcaattttaggtgtatatttatataataagggggtggaaaaacttttttttaagcatgatgccaaaagtagaaatcacaaagggaagaaattcagagctttgtggagatggatgggcgggtggatagatggatgggcgggtggatagatggatgggcgggtggatagatggatgggcgggtggatagatggatggatggacagacggatgggcagatggatttagacagactggcaaaaatatttgcaatatatatgagagagagagtgtgtgtgtgtgtgtgcgcgcgcgcgcgcgcacgccacgcacacacgcatctttacagaacaataagaaaaagtttcatttcccaatagtaaaacctctatattttcagtttcttactagacatttctactatgagcatctcaaactcagattaagttgttattctccgtaacttcccccttccctatagtcagcccccttctgctttcttcctctgcccgaccatacctgctcctccttcattccagaaactgagggtatttcgtcactcctttgtgagccctcctgtctaattcatgttagttccgccttcttgcaacattgtacattcccaacttcatcaccactctcactaccgtcattttaatttgtttttctttgcttttctttttttttttttttttttgagacagggtctcgctctgtcacttgcagtggcgcaatctctgctcactgcaacctccacctcccaggttcaagcgattctcctgcctcagcttcctgagtagctgggattacaggcacccgccactacacctggctaatttttgtatttttagtagtgacagggttcaccatgttggccaggctggtcgcaaactcctgacctcaagtgattcacctgcctcagcctcccaaagtgctgggattacaggcgtgagccaccgcacccggccttaatttgtttttcgtctcttggtctcacttcaagatcttctgaacttgaccctctgccaccagtatctccctggacaaaaccaccctccaagcatctgctaaagttatctttctaaaatctgtctgatcctgctaaaacctgtcccacttaaaatctctccgtggcaccctctctcatatctaagggaaagtccaaaatcacagcatgatgcacaaggcactttgggatgcagccctgccttcccagcctcatcttaggccaactcaaactccaccgtcctatagaatcccaggcctttctttccccagctcaccttgcagccggttctacctttcctgacaagctgatcctgccctgccttgcctgctcctatgcccacacttacctgctgtggtgaaagagggctctggtctccctcattctaggggctcttcatgtggggtctatagagagaacctgggggcttcatgaattggacccagaaaaaaatacatcttttttttttttttttttttttttttgagatggagtcttgccctgtcacccaggctggagtgcagtgatgcaattgtggctctctgcaacctccgcctcccgggttcaagcgattctcctgccttagcctaccaagtagttgggaccacaggcatgtgccaccacacccagataatttttgtagtttttagtagagacagggtttcaccatgttggccaggctggtcttgaactcctgacctcgtgatccacccgcctccgcctcccaaagtgctgggactacaggcgtgagccaccacactcggcctagaaaatacatctttatttccatcagtgtctaactgcaatgtagcatttccttccattgtaaatgaagcccccacaccggggtaattgcagactgtgacctcgttgcgagtggaaatcacagaggctttcacatctcattcccgttgttacggaggtcacaaacgctgtttggattcatcactacttcaaaatgtcagtggttcttagatttgttatttagtgcaacagtaaagaacagttgttcctgtatcacaaatctggttttaaaaaaagattgtcctggcgcgctggctcacacctgtaatcacagcaccttgagaggccaaggtgggcagatcactttgaggtcaggtgttcgaggccagtctggccaacatggtgaaacctcatatctcctaaaagtttaaaaaattagctgggagtggtggtgggcacctgtaatcccagctactctggtggctgaggcaggagaatcgcttgaacccgggaggtggaggttgcagttagctgagattgcaccactgcacttcagcctgggcaacagagctagactcagtctcaaaaataaaaattaaaaaaaattgcaataactgcacttcaaaataattgttttccttggtccttaaaacatgattagacttctgtccaataatggccttgtggacttacgtctttaaaacattccaaatagatgcctgtattcttgacaagacttccagaggggaccgtggcaaaggaagggttaagcatctgcgtcagactgacagtgtcttgaccggatcctcctccgtctttcccccaccgctttgcacagtgccacatgactttttatttgttttgagacaggatccagctctgttgcccagactggaatgcagtggcgcaatcacgactcactgcagccctgacctcctgggctcaagtgatcctcccacctcagcctcctgagtagctgggactataggcaagtgccaccacacccagctaattctttttatttttagagatggggtctcactgtgttacccaggctggtctcaaactcctgggctcaagcgatcctcccacctctccctcccgaagttctgggattacagacaggagtcacagcgccaggtccctatttattttactctttgtgtgtttccttatatcctgtaaaaatgggtacagtggaaactgggcagtaattctacacgtattctggattttagctactcacatttatggttacttttacctatcaattaattgcttttcttttcactcgagttttagtgattttcactgtccaaaagaatcgtgtatagttgacccttgaacaacacaggggttagaggcactgacccccgacacagtgaaaaatccaagtacaacttttgactcctcaaaagctttactgacagcctgctagtgaccggaagccttaccagttacatgaagtgccgattaagatgttttgtaagttacatatgttatatacaatattcttccaataaagtaaggcagagaaaagaaaatgttaagaaatcctaaggaagagaaaacacactttccgttcattaagtggaagtggatcatcaaaaaggtcttcatccctgttgtcttcacatcaagtaggccaaggaagaggagggttggtctcgctgtctcgggtgacagcggaggaggacgtggaggaggtgggaggggggccagacacactcagtgtaattttactgaaaaatattcaagttgaagtggaaccatattgttcagacccatatttgagggtcaacttgtgtgtgtgtgtgtttgtgtgtgtgtgtgtgtatgtacacacacacaaaaaataatatatataaaaacatgagtcccagcaatcttatccttaatcatttctaatgtggtttcagtgagagaaaatagtcttttcaggccaggcacggtggctcatgcctgtaattccagcactttgggaggccaaggcaggcggatcacttgaggtcacgagttcaagaccagcctggccaagatggtgtaaacccatctctactctaaatacaaaaattgtcctggtgtggtggcgcgtgcctatagtcctagctacttgggaggctgaggcaggagaatccttgaacccgggaggtggaggtcacagtgagctgagatcacgccaccacacaccagcctgggagacagagcaaggctctgtctcaaaaaaaaaagaaaatggttttttctcctcaatccattttcttatttttcaatgacctattatatctttaatgtgtctgaagtttattatatcatataaaataatatttgtttctgtttgttattctttaatactcagtttgcccaataatattgatgatttcttcccccaacatataatatctgacaaatcaggtataaatacatatagctctggatttctgtctataatttcattctatcagtctagtttttcactctaataagtgccacactcttgatgacgtctccttgttttctatttcagtatttgtatagccagtttactattgttgtttttagtttaaaagaaaaaaaaacaacaacctttagtattttggtcacctattttttctgtatgcatctcgtcattttaccaactttttttttttttatttgagatggagtcttgctctctcacccatgctggagtgcagtggcacgatctcagctcactgcaacctccacctcccaggttcaagcaattctcctgcctcagcctccccaatagctgggattacaggcaccgccaccacacccagctaatttttgtatttttaatggagacggggtttcaccatgttggtcaggctggtctgaaactcctgacgtcatgatccgcccaccttggcctcccaaagtgctgggattttagacgtgagccaccgtgcccggccattttaccaacttttataaattaacttgggagagaaatgtatgtttctttgtatttaatgcagctgcacataaatgtatcattctcttcctttgctccaagcattttgtaatccaatttttctacagatggagtttatgctatgttattttaattcccacgtgcttctgtgtttacctctgttgtaaatgagacagatcttttatttcattttgtggatgtttattactggtgtaggggagtttgttattttcttgtgtttaccaagaaacatagggctttgctgaacgcttgattgtcccagcccatttgctcaagtgaatccctgggatttggggagcacgggactgcattacctacaagtagtgaacgtgcaccctgtgtgacactcagaacttctgatcctcttctttcattcctgtgttcagaaggagcattctgttataggtctgggaagaatcgtggaggctcttggtttaagcctgtgtccctttccatgttaatcaaatgctccaatgatttcccctctgtaaattgaactgtgacctggtttttagatgccatgggatcaaagccccgcaactgtgttagatccttctagtggggtagttttctattaggtcggtgcaaaagtaattgcggtttttgccattaaaagtaatggcaggttgggcgcggtggctcacacctgtaatcccagcgctttgggaggttgaggcaggcggatcacctgaggtcacaagttcaagaccacactggccaacatggctaaaccctgcctctactgaaaatacaaaaattagccgggcgtggtggtggatgcctataatcccagctactcgggaggctgaggcatgagaattgcttgaaccctggaggtgaaggttacagtgagctgagatggcaccgctgcactccagcctgggcgagaagagtgaatctccgtcaaaaaagaaaaaggtaatggcaaaaccacagttacttttgcaccgacctaatagtaggattacacttttaaatagtacatttcattccatttttattttacatattttatagattttcttgcttatttaagacaagttgaagcttatgtttctatttactgtgccatttagcatttcttatttctccctaacattattatgctacatataatattgattagtctggcttcaaaccttaccttaattagccttaaaaaaaaaatctagttggccaagcacactggctcacacctgtagcctcaacactttgggaggccaaggcagaaggatcacttgaacccaggaactggagaccagcctgggcaacgtagtgagatcgtctcactaaaaaaagttaaaaattagctgggcatggtggtgctcactgtagtcttagctactttggagactgaggagggaggattgcttgagcccaggaggtcaaggctgcagtgagccaaaatcgtgccactgcaccccagcctgggcaacaaagtgagatcccgtctccaaaaacaaaaagtctagttaatcattgcctttttactcaaaatgtgtttctaccaccctttttggatttttaaaaaatatgtattttatttttatgggtaaatttggcctaattacattttactgatataactcttaacttaaatttctctttattgttgaattgttgatccttttcttttttctaattcacagtatctctgtcctaggctttctgatctatttaaggaagattgagtgaacagcctaattgaccctctgaatgtcccctgagccttctaatccgccctgccttgagcctcctcttgtaactgaaattcactttctgatgcagaaccattgagcccttctgaaaccttttcaaaactatatatttaaattttcttatcaaactgtactgttattagattacatgtctagcatagcagcaaattatacttcattatattaaccttgccacttccctctacaatgagacccgatcttttataagatactctggacctacaaattcctgctggtgaattctttaaagttatatggattttcaacgatcgtctactccctttacaaagcagctgctgtttagcaggattatccattagtggtaagaatcctttattccctagcatatggtaaatattttttaccaacttgaggtatgccacgtagatcccacgggatttacacacatagacaaaggcattcttctcatcacattgttttaaacaatccagctgccattttagctttcactaaacttagaaatgtatcagcttggccgggcattgtgggtcacacctctaatctcagcactttgggagatcaaggcaggcggatcatttgaggtcaggagtttgagaccagcctggccaacatggagaaaccccatctgtactaaaaatacaaaaattagctgggtgtggtggtatgcacctgtaattccagctactcaggaggctgagacccgggaatcacttgaacccgggaggcagagtttgcagtgagccgagatcgtgctgctgcactccagcctgggcaacagagagagactacatcttaaaaaaaaaaaaaaaaaaaaaaaggaatggtatcaactcgacacccagggtccttctgtaagttaaaacctgggaagtgccctaccctggcatttgaaaagtggctgaatccaatttcctgtccagaattacaatgacattgtattgatacattgatgatcaaaagcatagctaagctgtaaggctggttattggatatacatcttccaagtggagagattattaccacctgaaacagcttttggcttgtccattaagactcctttccagccaggcatggtggcccacccctgtaatcccagcactttgagaggccaagccgggggtactgcctgagcacagaaattcgagacaggctgggcaacatagcaagaactcatctctactaaaaattaaaaccactttccaaaatgaattttttttttaagacaggatcttgatctgtcacccaggctatagtgcaatggcacagtcatagctcactgcagcctcaaactcctgggatcaagccatcctcctgcctcacccccttaagtggctggttctacaggggcacaccagcacacccagctatttttttttttttaatttattgtagagacggggtcttgttacattgcccaggctggtctcaagctcttggcctcaagcgatcctccagcagtcctcccacctgagcctcccaaagtcctggaatgacaggtctaagccactctgctcagcccaaaacaaattctataaccaaaccagaaaagttgttttttgtttagctttttaccttaaaactttcattacccctacttccaacaaagtatttgaggtggatttaacacaagacacagcatcaataaagctcttaagtgaagtctgagatttaaaggagcatagctcagtggggaagatgacttctaaggcttggctttgaataaagcccaactcttcaatagcttggtgtgactaagacatgctctacctatgtgggtttgtttttttgtttgtttgtttgtttgtttgtttttggagacagagtcttgctctgtcacccagggtggagtgcaatggcacgatctcggctcactgcaacctccacctccgggttcaagcaattctcctgcctcagcctcccaagtagctggaactacaggtgcacaccaccatgcccagccagttttttgtattttagtagagacggggtttcaccatgtttgccaggctattctcaaactcctgaactcaggcaatccacctgccttagcctcccaaagtgctaggattacaggcatgagccactgcacccagcctctatgtgttttttttattgttaagagttcgaggctgggtgcagtgacacacacctgtaatcccagcactttgggaggccgaggcgggagaatcacttgaggtcaggagttcaagaccagcctggccaacatggtgaaaccccgtctctactaaaaatacaaaaaaaaatttagctgagcgtggtggtgcacgcctgtaatcccagctattggggaggctgaggcaggagaatctcttgaacccaggaggcagaggttgcggtgagccaagatcatgccactgtactccagcctgggggatggagcgagacttcgtctcaaaaaaaaaaaaaaacagcattactatgccaccctgatacactgcttggctaggagggaaaacttcttgttgcaattaacctttctatttttttcgctacgtctaagtattgtgaacttcctttgtggtattttagtgattagacaggatggagggcgttcttaaagattcatggccaaatccaatgatgtcagagtgaagggaacggacggtcttcgtggggccagcaagtctggccccatctgaattgtttgtctaacacttcacaagcagaataggaaccgctgaattattcattttcaagttgccctaaaaaaggtacttagcctgccgaaaggcagactttcggtgccagcgagaggaagaggaaggatgctgtctttcctatgaacgttctcgtgcctccactgcctgggtcttcagtttcacttcccagccctgcggggtacaggaaaccaccagctaacttaagtgcaaggcaattaagcggggagggaattgtggacaaatctatagaactctgaagccacaggtgagccaagcattgactttactggggaaaaaccaggtggaagaaggttgaaggagcttgggttggtcagaagatgccaggatttgggacctgagccagggaggtgggcccaggaagtgggattgggcttggggatggggaaggagaggaagctgagagcgataactagtatgcaatcagaaattttttttattcttagttttagcttctctgcctctgccaccaaagctttgttttggtttttgagacaggctctcactctgttgcccaggctgtagtgcagtggcacaatcttggctcacttcaacctgtgcctcccgggttcaagcaattctcccaccttagcctcccgagtagctgggattacaggtgcacaccaccactctcagctaatttttttttttttttttttttttgtatttttagtagagacggggtttctccatgttggtcaggctggtcttgaactcctgacctcaagtgatccacccgcctcagcctctcagagtgctgggattacaggcgtgagccaccatgcctggtcccaacctttccttaacacttcctaccacacagtacttaggggagaaagtcattagaaacccttgtacttgggagtaaaggccaggcttttagtagagacaggttgcctaccatgcccttgagcccatgcaccactgcgccgccctgcacctcagtttccccacttgtgaaatcctagcagtcttcctctgtaggtctgcactgctcccctgtggtgtgtcttttgtgcagcgcaggaggcagatgagagagagaagcccgcgtcttgtccaaaatatgatttggcgcattcttgggcagcgtctgttggaggtacaggcgggatgctcacaggtgaagtaaaccaggaatggcaaacagaacctgaaaggtggttctgaaagagagaatgcagaaactgggcaagcagtactcccacctgtaggaaggtttgctggcgaagtttcacactaaaacatgaaggagactgttaaaaacaatgggtatagatgacagaacagcatcccttcctaaacagcctttaaaagtctgaaactagggccaggtgtggtagttcacacctgtaagcccagctagttgggaggctgaggcaggaggatcacttgagcccaggaatttgaggctgcagtgagccatgatagtaccactgcactccagcctgggcaacagagcaagaccctgtctctacaaaaaataaattagccatgtgtaatggtgcacacctgtagtcccaggtattcaggggatcgagacaggaggatcacttgaagacaggagttcaagaccagcctggccaacatagtgagaccttgtttctgcaaaaaatttaaaaattagccgggagaggtgatgcacacttgtagtcccagctacttgggaggccgaggcaggaggatctcttgagcccatgagttcaaggctgcagtgagccatggtcaaaccactgcactccagcctgggcaacagagcaagacccatctattaaaaaataataataataataaaaacaaatctgaaagtaaagaagtaacaaccggtccccatttcctgccaggttgttgtctacccgtgattcctggcacagttggggcaagtccccggagtgcaggagccatgttgcctgcgtctttgtaactgtcccatggccagggggctcaatggatggcaggctgccggcccacgatgtcaacagcaggaacttgtgcctcagtttcctccatcacctaagtgtaggcctctcaccatgacagttcccttcctgggtcagatggtacttggggggttcccttccagaattcattttcttcccattctctgttcttggctaacaatctttttcttttttatgagacagagtcttgctctgtcacccaagctggagcacagaggcgcgatcatagctcactgcagcctccaactcctgggctcaaacgatccacccacatcagtctccaaagtagctgggaccacaagtgcataccaccatacccagctaatttttgtattaatgttttgtagagacggagcttcaccatgttgcccaggctggtctcgaattcctgggctcaagcgatcctcccaccttggcctcccaaagtgctgggattacaggtgtgagtcactgcgcctggcccaatcattttctgtgtcaaagaaaaacatatatatggtatattattttttaaagtcacattcttcttatagagatgtgctctttgtatacatttttttccccttggcaagtgggtaaacgggattccgggaaggtaactgtcttgactaaagttagcagagtctggcatcaggtggaccgcacaggacggccacttcttcttttgtttttttgttttgttttgtttgagacggagtctcaatctgtctcaccaagactggagtgccgtggtgcgatctcagctcactgtagcctccacctcctgggttcaagccatcctcctgtctcagcctcccgagtagctggaattacaggcatgcaccaccccacccggccaattttgtatttttagtagagacgagcctttaccatgttggccaggctggtctcgaactcctgacctcaggcaatccacccacctcagcctcccaaagtgctgggattacaggcgtgagccactgcgcccagccaggacggccacttctaatccatattcttttccacagctgcagccacagccatgcagcgtcctttagattctccttcttcttgagtatttttatgtcttgcttatcaccttgtttcattgcaaatggaatagtagcagtcagcatcagtgcacgctttacaattaatgagtgacgatggagggatacctgactactgtgatgctcttcactttttttgttgtcttattgggttttttgtttatgtttcatatgttaaatttccgacgtacgcgtgacctggtgtcagcatctcccgttcatggcccatcccgtctcacctgtccccactcctgttttgacttgaagctactcccagaatcctttcatttcctttctaaacattttaacacacatatcctcacaataaggactttctttttaatatagtcacagcgcaattagcacattcaaaaataatttttcacctgcagtcccagcaactcaggaggctgaggtgggaggattgcttgagcccgggaggttgaggctgcagtgagctatgatcacaccactacgctccagcctgggtgacaaagcaagaccctgtctcaaaaaaaaaaaaaaacagtaaaaataataatcataataattttttaatatgatcaggtaaatctagccagttttgaaatttctagttgcccccaaacttcataatggttttattttctaaaattattttaatttaggctgggcgcaatggctcacgtctgtaatcccagcactttgggaggccgaggtgggtggataacttgaggtcaggagcttgaaaacagcctggctaacatggcaaaacctcgtctctactaaaaacacaaaaattagctgggtgtggtggcacacacctgtagtcccagctactcaggaggctgaggcagtggaatcacctgaacggagaggcggaggttgcagtgagccgagatcgcaccactgcactccaacctgggcgacagagcaagactccgtcttaaaaaaaaaaaaaaaaaaaaaaatttgaatctcgattcaagtaagatccacacgttgcagttggctggtgtatctttaagtcttggtcattgtatagattccctcttcgtcactttttcttttccttgcaatgtatttgtgctagaaatggggtcatttgtccagaaaagattctccaccccactgctgagattttactgattgcctccccagaaatagtttatcatgctcctctgtcctcatgctttcctgaaaatttgtggttgaatctagaggcttgatcagattcaggctagaagtttttggccaaaagcccctttgtgggtgattgtgatgatctcgcgatggtgtcaggtactggaagtgagcgctcaccagaagagaaaggtcctgactttgatacacaatcataatgaatccaggcatggagcttggtggtttacaaaatcttttcctttctttttgtgttcttgttttatcctcatgctaatttctttgaatttcatggctcctcctgtataggtgactgtccagctcagaagtctgtccaaggtcaaacaactaaaagacaatgggagggccgggcgcggtggctcacgcctgtaatcccaacactttgggaggccgaggtgggtggatcatctgaggtcaggagttcaagaccagcctgaccaacatggtgaaaccctgcctctactaaaaatacaaaaattagctgggcatggtggcaggctcctgtaatcccagctactcatgagactgagggaggagaattgcttgaacctgggaggcagaggttgcggtgagtcgagatcgtgccattgcactccagcctgggcagtagagcaagactccatctcaaaaataaataaataaaaatttttacaaaataaaaatgcagtggagaagaattccaacccattttccaccagccacactcttttctgtagaccacaattttcctaatttcacttgattttaaagaacaaaggaacctgcacacccagcctgctctccacttctttgggtagagcagggctgttagaactctagagagatgcaggaagcagccgccgatgaacccagatgctcatccctggaggcactgtgcggtctcaggagcagaagccgaatgaattatgcaatatcagagcctcattccctgggccgcagctgtcccatgttccctgcctggagatgactgaagcccgagtgacagtcacaggctgttcccgatcacgctggggtcacacgctctggtgagcacccagccggccagagctgtgctattggtttggcacaggtagaaagttgaccccgcacgtgccgtagaaggtcatttcgttcggttcatcagctatactcggactggctaaaggaagattttattgaaatcgtttcccatgaacacgtcaacttgtggggcaggaagggaaattttcttcccgtttgggattgaaaagatgaggcttaaccaaactcgttcttatgttcgttggtttgttttttctttctttctttcttttttttaaacagactctcactctgttgcccaggctggagtacagtggcgtgatctcggctcactgtaacttccacctcccaggttcaagcaattctgccaccccagcctccttagtagctgggattacaggcgcacgccaccacacctagctaatttttgtatttttagtagagatggggtttcaccatgttggccaggctggtctcaaactcctgaactcaagtgatccacccaccttagcttcccaaagtgcttgggattacatgagtgagccactgcgcctggcctaaacttgtttttaatcattacttttgtatcatttaaattagtataatggtaatctacagagaacaaattctggttaatttctgagcagacagaggtgacatcctggccgtttaactgtctctcggcacagtgttacttccagcaaaaatgaaaaccgctatttccagaaggttatctgtagggataaagctccacagactggaccgactctctttccaggcctttgattggggaggggtggggccaccgtggagtgtgacacatttgatccggggcttggcagatgcaagatggcttcatcctcccctctacttctgccaaagcagaagtggtttaaccttgggtggaaaacgaaagatagggcaagtcatacagatgagggctgccaagaaaacctttccccgaaaaacactctctcctcccctcctccccttccccatcagcctccgtgtcttcagtcctgacctggttcacagatccgtgttgggcacggggatgagtgatgagtggtgagctgggccacctggttctgcactccaggacctcacggtccattggacaaaaagaagcctaattctgggtctttcaatacttctcccccaagactattattgccttgtttttcagaggctctgaaaagcgaatcattttccttctgcaataacatcttgtaggctctttccttaaaagttgtatttacaatttgccaaaagaattctaccctttctgccctttagaatactagccagtgaatggctgtctgtcaagaagacaggggacctcaggtatcacaggtgtcattaatttgcatatttgggccggtgcggtggctcatatctgtcatcccagcactttgggaggccaaggcaggtggatcactggagatcaggagttcgagaccagcctggccaacatgatgaaacctgatctctactaaaaaaatagaaaaattagccgggcatggtggcgcatgcctgtactcccagctactcgggaggctgaggaggcggaggttacagtgaaccgagatcgccccactgccctccagcctgggtgacagagcgagactccgtctcaaaaataaataaataaataaataaataaatttgcatatttggtcaaccagtattttgtgagtacctgctgtgttccctggaactatggcagtggataagcaagtaatcaatatatgaacaagagactttgagacgggaataaatgcaacagaaacaaaatgaatggacaatggagagtgtggctgtggagaggcctctcagaggagggccaggagggctgagacccaggcctgtaggtgggacaagcatggtgcttccaagaaacagaacaggactaaagaggctgggcacggtggctcacacctgtgatcctaacaccttgggaggccaaggcaggcagatcacctgaggtcaagagttcgagatcagcctgaccaacatggtgaaaccccgtctctactaaaaatacaaaaattagccaggcgtggtggtgcacacctgtaattccagctactagggaggctggggcattctcaagaatcacttgaaccccgaaggcagaggttgcagtgagctgagattgcaccagtgcactccagcttgggcaacagaccaagactccgtatcaaaaacaaacaaacaaaaaaacaaaaaacaaagaaatgcccatcttttattttaaaaatcttaataaaatagggatatagttggatatttcattaataaatgtatatatataatgtattttatatataactacacattaatgtatgtgttatatatatataatatattaatatatatatattatatattactcaagaacatgagtaagttcttgagtggtgatttgtgagatttaggtgcacccatcacctaagcagtatacactgcacccaatatatagtcttttttccctcacccccctcccaccctttccccgcaagtccccagagtcctttgcattttcatcgcttagctcccacttacgagtgagaacatacaatgtttggttttccattcctgagttacttcacttagaataatagtcttcactcccatgcaggttgttgtgaatgtcattaactcgttcctttttagggctgagtagtattctgtcgtgagataagaaatattcaaagggtgtgggaagagactctgccgtctttatttgcagatgtggtcacaggatgcctcgcaaccccgagagagccactgaaaagttgttacaaaattgaacaggcttccatttccctgtggcctctctctctagacagccgtacctctctatcccagtgtcccctgctcagtaaatctgtactcatcctccagggtacagactggatgtcccctactccgggatactgtttctcctggtgtctgcagaggcccttgtaccactttctgggatgtcactgtgctgaatcgctggtggctgccatttccttccgcctcccactgggtagacaggaagggggtccctgcccacccacccacccatgcccggtatatccctgctgagctcctaggatgtgcagggtgtattcctgtgtgctagcgagaagggagtcccagcgccactacgccattgcccactcctcccctgggacatttgtttcccttgggtgtggttcatggtaggtgccccatgggcgttattggtgggagacctccctgtctcagtctgagctgggcccatcgccatcagggcacgacagccacagcaggtgcctttgctgggagtaatcttgccctggctcgcatgagactgcagaccagcccttctccgtaagttcaggcgtttgtgctccgatcagcttttcctataggtttgtcccccaccccttgcccaactctttgaccccccgagttaaggggattccagacctagagccaagtgaccttcctcagagcctggccctgtctccaccgcttcagcaacctgctctttctggacagggtccagcgagccccacctctgtccgtttcctctaccccctgtgctaaggaagcctcacctgcagtgtaggttgtggtgaaaaatgtccccccttaaggacagagcaggtcatcacgtgcagccctggggtagaaggggagagttcgcttgatcaaacctaactggagcttttcttttaaagcaggaagaattaatctgtagatatttctcctttcaatgccaaagaactttatgatctggtattgagactattggtgggttttttttgttttctttgtttttttgttttgttttgtttgagacagggtctcgctctggtacccaggctggagtgcagtggcacgatctcagctcacttcaacctctgtgaccggggttcaagcgattcttccgcctcagcctcccgagtagctgggattacaggcgctcgccaccatgcccggctaatacttgtatttttagtagaggcagggtttcatcatgttagccaggctggtttcaaactcctggtctcaagtgatccacctacctcggcctcccaaagtgctaggattacaggcgtgagccactgggcccggccgagactattggcttatgaatcaagtctaagaagatacactagtctttgaaggccgctctgtatgtttttccaactgccttgtagatatactttgttttaacagctcgttttaacagctcctgatgccagcgtgcttatttgggtattgaaatatgcgccaacaccgtgccccgatgccacgcgttagcccccaggaggcttgcgtgaaagtaaatactagaatttccagcgtggatataatttcccttccatcgaccttgaccatgtccttttcagttcctcataaaaactgtgtgttagcccagagaataccctgaaatgatctgtggtgaactgattgaacgaactacatattctaggccaaactgaaattattcgctatttgaagtcagagctgagcataataccgggcaggttaatagatcagtggaagctgtttcgtcagctcataaaaacgtgagagatctaaatttttataataaatcattttgctgagcaaacaatatgtgcggttattacagactttggaaaataaatgattttagaccaatgtcaggctgcagatactgatgtggttagttgagccttcagcatgaagagaatgaaaaatctttggaatactgttgacactcacaccatgaaaccacatgccatttaattcattactgcgcttccaagattacatttacagttgtggtattaacccctgggcatttttgtattacttattgcagacagtttgtcaggcaggattaattcagtggggggaggaggcagcagtttggagagaaagtggatgattaagactggggtggggctgggcgcgtcggttcacgcctgtcatcccagcactttgggaggccgaggcgggtggatcacctgaggtcaggagttcgagaccagcctggccaacacgataaaaccccgtctctactaaaactacaaaaattagccgggtgtggtggcgcatacctgtaatcccagctactcggaaggctgaggcagggagaatcgcttgaacccaggagatggaggttgcagtgagctgagatcatgccattacactccagcctgggcaacaagagcgaaactccatctcagaaaataaaaataaaaatacaaaaattagctgtgattgggtgtgcctgtaattccagctacttgggagaggctaaggcaggagagtcacttgaactgggaaggcagaggctacagtgagttgagattgtgctactgcactccagcctgggcgacagagtgagactctgtctcaaaaaaaaaaaaaaaaaaaaaaaaaaaaaaacctggttgggaggtgccccaaagcaagacccgcctccttggtcctggtctgcaaacactgatggccacactcacatcttccaaagcccccgatcgcacttactcagctagttgtatttttctttcggcttttaaaaaagaatacctccttagaaaaattaataatgggccaggcacagtggctcaggcctgtaatctcagcattctgggaaactaaggcaggaggatcgcttcaggccatgagttcaagaccagcctcggcaacatagcaagatcaactttgtctctacaaaaaagaaaaaactagctaggtgtggcagtgcatacctgtagtcccagctactcgggaggccaaggcaggattgtttgagttcaggagtttaagaccagcttgggaagcattgtaagacccctgtctctaaaaaacaaatttttcttttaaattagctgggcttgctagtgcacacctataagtcccagctactcaagagactggggcaggaggatcacttgagctcaggacaagagttggaggctgcagtgagctatgatcgcaccactgcactccatcctgggcaacagaaccagaccctgtatcaaaaataaaaaagaattctcagaaaaatgagtaacaaacatacagatttttgtttgtttgtttttgtttgtttgtttttttgagacagggtctcactttgtcacctaggctggagtgtagtagcaccatcttggctcatgctcctcctgcctcagcccctcaagtagctgggactacaggcatgcaccaccacacccggctaatttttgtacttttagtagaaacggggtttcaccatgttggccaagctagtctcgaactcgcgacctcaggtgatccacctgccttgccctccccaagtgctgggattacaggcatgagccactgcatctggccgacttttaaaataataatcagagcgtttcctcgccaactgcatccctggttcctcccattgtctcctcctgtggtttctggtcccttctgtgaatggagacagcagcccctccgagcctggctgtcaccacaatccctggtatggaataggcctgccctgcaactgcagagtgtggtgtcgtcattgtcattcgaaagcctggggaaagagagttgcttttgtcatgaaaggtaagtgcagtccttgttatcacattcagtattttggtccgtttagcagttgcttagtaaccaaagcacaactgaccaggagatggaaaacttgaaattcacttccaggattgcctcacactgccaagtctgcaccttcccgcgtcagtgggactgatttttttataaatgatgtgaaatcttctggagatgaggcgtggttttccggatattcggtgtcctgatgaaaatccaaagccatgtgctatctgagaagaaatccagagagtgtgcactttccaggaggtgcccaagccccacccaggccccataaacctggcaggaactggactcgacccacatggaccccagccctgccaagccggcctctgtgtaaagctgggcccctggaactttgctcttctctatgcctgggcctttggccactggcaacaccaggtcgcaagtgaggagtggatgaaagcagccaggggcgggccagcacccccaggcagccacgcctccagcttttcagctccgcactcccaagatcagggagctgcacccagggagacggtgtcctcctgttgctgctgctcccggaagagtcaaggctaagtaagctacctggccagagggttttcctggttgccaagcagcagggaggagtcatcggcaaggcatctcagagatgggggccatccccttcccttccttcctatgttcggcagaaaggcattgaatgcctaccgtgtgtttttctccttcaattcgcttgagagacacgcagcagggctggcttctctgtcctcccaccgtgtacattgccagaaagagcggctggtatccctggaggacccaaacacacaagcaaaaacagctgggccccagaggagggcagtgcttctgaaagacacacccagaccccaacagtgggtgtgatatgaggcaggacagctgggccacaaagacaaagcaccacaaaggcactcagggaaacagaggaagatattggcagtgtgaagcgaaaccaacaggtaattttcaaatggaccaagtggaagtaacagcgtaaaaaaattgaataacttaggagcaaagaagaaaggatacattgccagctgggtctgatggctcatgcctggaatctcagcactttgggaggccaaggccagagggttgcttgagctcaggagttcgagaccagcctggcaacatagcaagaccccatctctataaacaaaatgtttttaagtaaataaataaaagaatcaacacaagcctggaaaataaagatgaagatatttcccagaaagtaactaaaaagatatagatgtagatgttagaaagaaaagaaaattagagatcaattcaggagctccaacatccacctaataggaattccagaaagaggaagtagaaaatagttcaggtgcagtggttcacacctataatcccagcactttgggaggctgaggtgggaggatcgcttgagcccaggagttcaagaccagcccggataacatggcaaacccccatctgtaccaaaaaaaaaaaacaaatagaaaaattagctaggcatggtgacatgcgcctgtagtcctagctgttagggaggctgaagtgggaggatcgcttgagcccaggagactgaggctgccttgagtcgtgatcacaccactgtactccagcttgtctccaaataaataaataaataaataaataaataaatagctaaagaccagttagatcaagttaaccttgatccagaaggcagcaagaaaaggataaagaaatagcaaaatataaaagaaaagttaaatgacatggaagacagaagtagctatgccaacaatatccaaataacagtagtctcaaacagaatagaagtattcaaatgaaaatagccagaattaaagaaagagagggcttatataggggcacactggagccattaggaaaagtgctcacctagacccacattcagtgtctcttcactcaccagccggaccagtccccatccacctcccaagttctgcagccagctctgctgatgcattcagaggaggatttaggcaattgtcaacctctgcacatcttgttgtgggtacgcagcagctatgtattttcattgtcatcttttaaatctatgacatagatgagatacgcaggacctaagcctgcatctctatgtgcccattccagcaccaggaaacttttaggggtctgaaacactagtggagctagtgaatgagtgaatgacggtagccagggcagttttgacctgtgtatgtggacattggaaatacacgataggtaactaactgaagtacaaaattgtgtttaaaacttgtgatttgggacaggcgcagtggctcatgtctatagtcgcagcactttgggaggccaaagcgggtggatggcttgagcccaggagtttaagaccagcctgggcaacatggtgaaaccttgtctctaccaaaaaaaaaaaaaaaaaaattaggtatgctggcgtacaccactagtcccagctactctggaggctgaagcgggaggactgcttgagcccaagaggcagaggttgcagtgagccaagatcacaccactgcactctagcctgggtgagagtgagaccctgtctcaaaaagaaaaaaaaaaacaacacaaaaaatccttgcaatttgccttaagtaaagtttgcaagcttttattttgtgtctgaaggagtttacgctctgaattcttcaacagggcgtcaaggtagcagctttctgcattgactggtgattatccttttctgatatgttttaagacccttaacacttttaatttttttaattaccatttgtagtattagactatctttgcacagcaatttttctgtcagatcttggaggtttcactttgagatgatacagaaggatgtttcatcatttaagaagccctgacccttccccactccctgcacccagcactgtattgcagaggcccagtttgggtatttatcttacagagacgctgccttcttcatgaaatcgtcctaaaaatagcttcatttaactaggccatttgacaggctttttcagactttttctcagaccagtctgaaagccggatattatttcaaacagatacaatgaacattgaacccgatcacaaggcatctgttaccctattcaggctgctgggagttgataagactacctcaaatcgctgtgtgtagttaaaggctgcaaaagcctcaggccacaaaaattccccagcccaggggcccggagacagtttttccaactctcagcgtccagggtgtaccttagcctgttttctgttgctgcaacagaacacctgaggccagggtgatttataaagaagataggtttatttggctcacagatctgcaggctgggaagttcaaggacatggccctggctcctggcgagggcttccatgctgcatcataacagtacggatagggtcaaaggggaggtggatgcgtgccaagagggacaacccagggaggttcctggcattatgataacccagtctcaagggaactcatccagtccctaaagtctggtcagagcaagaactcattcactgccaggagaatggcaccaagccattcatgagggcatccactgccatgacccaaacacctccctctagaccccacctcccaatgcccccacactggggatcaaatttcagtagcagttttggtggagacaaaccatagcagggtgggtgggtactctcacttggacgtgcctccttgggaccatggagcaggtttcggaaggatagaactctcattgtcaggcctgtccagcaccctgggctgtccccaggagtagacttgcccgtcacagacaggatgggccacatccaggactctggcatccaacgtgacgtgcagccctgtgaatacaggacaaattctagggatatagggcaaaagggacctatggcccagcattcagagagagctcacagcgtgggcacccagtgaaaactcaaacctggaaactaggactagggacagtgccacttcctgagacagagctgctgagagggtctgggaagggtggatggggtggaagtaggagatgaggttccctgggacgagaaggcattcaggcaggcggcgcaggtggaggcctagtgccgaggaaggcctggctctttggggtcccgcacgagatgggagttgttagagcacagggtcctgagaaagagtggcgggtaaggccaagaggaggaaggagccttggcatggaagggccttgcgtgtggctgagggagggattgcatcctgaaggcagcagagtgcaggtgcatgtggactcagagccacagcatgagagccctcaaccccaaccaggtccctgtggctgtaacattggctccatggcccttgggtatgctaaaaaaaaaaaccttccttgggtcacagacagttccagcctgtggccttctaacagagaccatcctcaggacctgcttgcagacattggggtggtggtctgcccgggtgtgctgctctaacctcccataggcttttggagttggccgtgcccttctcaaaaggactctccaggccgggcgcggtggcttatgcctgtaattccagcactttgggaggccaaggtgggtggattacctgaggtcaggagtttgagaccagcctggccaacatggcaaaaccttgtctgtactaaaaatacaaaaattagccgggcgtggtggtgcacgcctgtagtctcagctactcgggaggctgaggcaggagaattgcttgaacccaggaggcggaggttgcagtgagccgagatctcatcattgcactccagcctgggcgacagagctctgtctcaaaacaaacaaacatacaaacataaaagcactctccgcattcctctctcatgatgctctgtgttgggttcgcgtatttgccttcagattactcaaggaagtactttcaaaacagaaaaagggaaagacagaacctggacaattgcttttacgaccaggctgggccatagcaatgaacccaggctgtctgcactgcagcctgtacagtcccccaacctgtgtcaccatcctcacctgccctcctcacctccagttggccaccttctcctggtttcctcattcctggtgaggctttcactgccaagtgccttttcctaaagtagcctttccccagctcctcctctcacccccagcctggcaaacttctactcatccttcaaaaccccacttacctgtcacctcctctgcagccttccttgattccctcccacaaagagaatttatttctccctctttttttcagagcactctgctcagagctctttttgaacccttggcaggacatgctgtattttatatttttatggttatgtctccccaatgagattgggaccccatcaaaggcaggcaccccatacgcaccagacacatgattatcaaaagagcgcatggcatcagcaagcacatctcttcccccagtgtgagcccacctcctcctgctggacagcattgactcacgggtctgcacagcccttcccgagccctgagctaggaagctgtcccatcagtcaccccctgagccggtctccttgtgactaacctgctctctccctctcaccctcctagggccgacgagattgaaatgatcatgacggaccttgaaagggcaaaccaggtaggaccctggacgcttttagtcctaaaacccacaatagcgggcccgtttctggcatctcggaagatgcgtcacccgaagttagaaggccggttatccttccattttttactgacagctttcaacgtcgatgctccttctgttgtcatgagaagtaggaaaagacataaaaagtcctaggaaccatttccttggcaaagtctttgatgtggttccaacatctcagacatcccatggtgaacatcccctccaaagtggtaactgtctccttttccctactccatctctaaacacccgtctttgtagctgtggcatccatgacagtgtagacatctcaccatggaattatcctcggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctcggagagttccttagtgtagacatctcaccacggtgttatcctaggagagttccttagtgtagacatctcaccacggtgttatcctaggagagttccttaccgccacgttctcatgggtcgcagccacttgctccaaagagggctctcagctgacggcccctttttggctgacacttggtgctcagagaggccttatggcaagtacccagcacagtgtccggcccagatcaggcacaggacgcatcttaaccattagcgtacttttgggtgattctaaatactctgcttcctggaaaattcagccatccccaaaaccccttcctccccccaggagcccacagaacaggaaaacattttgctttagctggtgctgctgttgctctgaaaagaaagtggtcccccagccgggcacagtggctcacgcctgtaatcccagcagtctggggggccaaggtgggaggatcacttgaggtcaggagtttgagaccagcctggccaatatggtgaatccccgtctctactaaaaatacaaaatttagcaaggcgtggtggcaggcgcctataatctcagctactcaggaggctgaggcaggagaatcacttgaaccctggaggcagcagttgcagtgagccaagatctaagcctgggcaacagagcagaaactccatctcaaaaaaatacaaaataaaatttaaaaataaatttttactacccagccttgggctgggtgtagtggctcacgcctgtaatcccagcacctggggaggccgagatgggtggatgacttgaggtcaggagtttgaggccagcctggccaacatggtgaagccccatctctgctaaaaatacaaaaattagccgggtgcggtgacatgcacctgtcatcccagctgttcaggaggctgaggcaggagaatcacttgaacccagaaggcagaggttgcagtgaaccaatcatgccaccatactccagcttggatgacagagcgagaatctgtctaaaaaaaaaaaaaagcagttactggaaggagttaccttcatcatagatcactattcctatttctcaagtttccaccgactccacctctctcctcaaggccagtcttgggcatgccttgcctttagatggcactttagggcaatctaatgtgcccaacaggagagcctggtttgttaaacgggagagccttatcctgtgaatatcagtgctctatccagaacaggttctctgtggtctcagaggcagtccccagctacctaagaagtttggcaaagcgaatgcacttctcaaggtgccaaagccactcggtggaccccagtcttaggagacaccagacaaggctgtagggacaggtgctggctccgcaatgacacgggttcagttcctaactcggtatttcctgtgtggccttgacgggtctcttaatctcttaaatttcttggtcataaaaaaatcaaaagaaaagtgaaccttgaggccattatgccaggggaaatacgccagtcacaaaaaaagacaaatactgaatgattccacctgtatgaagtatctagaggagccaacttcagagagacagaaagtgccacggtgactgccagggacgaggagaggagggaaatacgaagttgttgttaaatgggtacagagttttggttttgcaagatgaaaacattctggggattcattgcacaaccacgtaaacgtccttgacgctactgaaaagtacgctaatggttaagatggtaaattttatgctttgcgtagtttgccacgatttaaaatatgttaaaaaattttttgaaagaaaggaagggaatttagctaatgcttcctttgcaagattgtttcgaggatttgaggtaaaatgccagagtaaaaagtagatggtggccgggcgcagtggctcacacctataatcccaacacttggggagaccgaggcaggcggatcacttgaggtcaggagtttgagaccagcctgggcaatttaacaagtcccccatctccataaaaaatacaaaagttagctgggcgtggcagtgtgcctgtagtcccagccactcgggaggctgaggcaggaggatcgcttgagtccaggaggtagaggttgcagtgagctatgattgcaccactgcaccccagcctaggtgacagagtgagaccctatctcaaaaaaaataaaagaagtagatgcctaaataaatgttagttccgtagctgctgaagaagctcaggttttgggggaattgtaaagtcctgccttcaggaaagggtggtgaggggtagaggtgagttctcaccaacaactcagccagagtttatagcctgatacggctacattaatagaaatacagtttctagaatgaaggaggtggtgattctgctcattggcagcaaggagtccgtgcctaggaaattccattttttaaatttatttatttttcttctttgaaatggaattttactcttgtcatctaggctggagtgcaatggcacgatctcagctcactgcatcctccacctcatgggttcaggcaattctcctgcctcagcctcccaagtagctgggattataggcgcccaccatgcccagctaatttttatagttttagtagagacggggtttcaccgtgttggccaggctggtctcgaactcctgacctcaggtgatctgcccaccttggcctccctaagtgctggggttacaggcaagagccaccgcgcccagccggaaattccattttagactggaagccacagtataaggaaaacagctccttggagtgcattcagagatgactccatggccaggacagggaggggctctaacataaaaagaactagggggttcggagacgttcctaatcttggggtagcagggaaagacggcagcaccactggacagcaggagcaagaggaataatttcaggaatctgggacgcgaaaagataagggggaagggtcatgggggcatttgtgggttctgtccttgtagttctcaagagccgaccagaaagaaaggccaggggacggagccaggctttttctgagagacccctgtagaccccagccaagcatagaggctggcgagaggaaacttttttgtttttgcttctgagacagtcttgctctgttgcccaggctggagtgcagtggcacaatctcagctcactgcaacctccccgtcctgggttcaagtgattcccctgcctcagcctcccaaatagctgggactatgggcatatggctccccatcctgggttcaagcgattctcctgccacagcctcccgagtagctgggactacgggcatatggctccccatcctgggttcaagcgattctcctgcctcagcctcccgagtagctgggactacaggcatatggcaccacgcatggctaattttcttatttttagtagagataactcctgggctcaagcgatctgcccacctcggcctcccaaagtgctgagattacaggcacatgccaccacacccagctaattattgtgtttttagtagagacggggttttgccatgtttgcccaggctgctcttgaactcctgggctcaaacgatccacccacctctgcctcccaaagttctggggttacaggcatcagccaccatgcccagccaggaagcttattcccagtggtctggctctccagagttgccacgctgaaagatgcttgctctggagagagtgagctccctgtcaccagagctatgcaagcagattcaggccagccctcccagagagcatgagatggggaatcacgcacagagtggaccgaaggagggattgaacaagaaggctcaaagggtcccttttgaccctgaagtctaggatttcgtgaagctacaggtgaacccattggcatgagaagcatccagggaggaaagatgcaagcccttggaatatcgagagaatatttccagcaggaaaagaagtggaaggttaaaggaaagccagagaaggggacgttgccctgggccatcaactaagagaaaagctgcccagagccaggcatggtggcggcggtgcctatagtaccggcagttggagaggccgaggcaggagcatcacttgagcccatgagtttgagaccagcctgggcaacatagtgagacttttttctctacaaaaaagtttaaaaaaaaaaaaatagccaggtgtggtggtgtgcacctgtggtcccagctaacccaggaggctgagatgggaggatctcttgggcccgagagttcaaaaccaacaccagagatgcgggtcagagagtgggctggtaggacgggacctggccaggcctgtgggagggtctgagtatgaaggattcatcctgggagcagtgaagaatcgtaggcgggattgagacatcaggtttgagttctagaaggatctctctggctatacattggagaacagatgggagtggaaagaccagaagccaggagagctgtgggaggctattgtgtaagtatggggagagatggcatgggcctgagctgaggccatccctgcggaggtgagctggaggcgggctgggcaggaagaggagggcgcagacacagtccaacactggtgcaggtggcaggcatctggaccaacacctttcccatcaggaaaccccccaggaggagcaatttactagctcactggcatacaacattcgttttccctgggtgtgtagttagaatgttctacggagacctgaagtgctcgtttattgctcaaccactgtgctcctgttatggagaagtagcagaggggtcggcacctgtcagttatgtccgagcctcattcacacctgtttgttgaacatcagggcactggcataaatactcactgtcccaattggtgacagtaaaggatcagatctcttgagacttcatggtcaataagaagccacagctttacactttgaactgcatgtgaaaccccgtcccgtccgggggctttcagcaattcacagcctttttgtggtgaaaaaaagtggcccgcccaccacccctccggggcctcctttctgagcagtggtgatccgagttgctggtgggtctcaaactcctgggctcaagctatcctctcgccttggcctaccaaagtactgggactacaggcatgagctactgcgcccggctttgaagccagcatttctttactacctacgaggcctgctcagagtccgtgctcaaaaagatgtattgaatgaatatgggctttgacgcacaggctggagcgcagtggcatgttctcctagcccacagtggggctgggagggagtcattgaagtgagctgccctcttcctgttcacctgcctggtgtttatgtcacaagactgccctagtggaggactctccaggttgaggttaggggttggaaaccacagctgaccctcaccacggagagtgggtctccatggaggccttggccactggtgcagcatcagcgtgggacacgtggtggtcagcatttggtctccagctgtggtagctgttcccgacctccttcctgcagagtcagtgacatggagttacctctgggagtcgagatgttcactgtaattgcatgctgcgggtagggcagcagggccttagcccatcatcagctcctgggtctactttgttcctcgggggacttgctcatctctggtgtcctcaagcctgagttttaatggccatgcaagcagagaacaagagacaaaacctggggccaagaagggggtggaagattggatcagagaaaacccccctcccccgccatataaaaccagggacttcaaaggccacactctgaaagtgtaaactggcagggtgggggaaggagtctgcccttaaaggggagacggtgagggttctctcttgttggttccagagggagaagaaaatgagcctcccaagagaattcctaaccacagccacctctccacaggtctggggccatgtcgcacatgagaccccccagccctctccccacaccttcgccccaccaggctgcagctggcccaaggccctgtctttatcctctgcaagcccacccctctctgtgtccttcccatgatgccttaccacgttttatgagtcaaattgttcagactttagaggcctggaagtagctgtctacatcctgtattcacatcccaatcgggcactgcggttaggggaaagcttttttttttttttttttttgagatggagtctcaccctgtgacccaggctggagttcagtggcgtgatcttgactcactgcaccctccccctcccagattcaagcaattctcatgccaattctcatgtctcagtctcccaagtagctgggactacaggtgcacacccccacgcccagctaatttttgtatttttagtagagacaggatttcaccatgttgaccaggctggtctcaaacccctgacctcaagtgatctgcccacctcagcctcccaaagtgctgggattacaggcgtgagccacagcacccagcaaaagcatttacttaccatccttcctggggcctttcagggacccttgagggatgggcaggggttggggggcccgtggaacttcttctaggatgaggtgacctcgtggacccctggttccggctctccttccccaaatcacccagtgaggaatatgacaccagcccagggagcagaaaagcctccttcaccttccccagagaagcgaggctcccctgggtctcacggtggaaaccatctctgtatttgctggcttgactctaacaggaagaattcctgagacacggtgtcgctggctgcttgctacctcccaggtgactgctgaggggaggcagagtttaacctgatgccagctaagagtaatttcccccaaaagggtcttccattttgagatgaggaggatgtgaggtgtgcctggggccacacatgccagggaccttcgtgacaatgtcctggacaccatcgccaggtgatgggcatcggcttgtgtgagccccgtggccaccagtccccttgccgggtggctgttttctgccatcgtggtctgggttaccactgatatgcaagcagtatcctcctcgcccctgtgtttctagcatcaactctgatttctcagcaaatgacagagaatagacaagaaagagcaagaaagatctcccaggacagtgctcaggcttggcgaggggccgttctcatggtggggcagacacaaaagtagaacgagggctcccagtggccctgtctctgcagggacacaggaggagacgggagtccggcggtgaccacagggaagtgatgtctcagggccgccaccgctagatctggggttccagatctagaaacacagctacagctggtttaacaggggtcttcaggaagacgccagagcctcaaaaccagtgtcaccacacgccgacccgggacagggcccccttcttcctgcctcagctgccaatgatgggctacgcttacttctcagctcctgaaatgaatttatcccagctccagatcagtgtctgtttccctgttccttcctttcactgccattaggcctgtttttagtttgaattctcctgtttcgtggatctcaccacacaaaccacctcaacgcttcattttgtgagttttgtattttttttcgacgccctcaggacagaaatcctgaataactatgtgatcagaaagttgcgtgaaagtaacgaaggcaagccacaagtgatagaagtctgacaccgtgaccgccaacagatgggccacagagagactgtccgtgaacttggaaactgattgcaagtgcaaatgctccacagaaattatgcaatcaggccgggcgcggtggctcacacctgtaatcccagcactttgggaggccgaggcaggtggattacttgaggtcaggagttcaagaccagcctggccaacatggtgaaaccctgtctctactaaaaatacaaaaattagctgggcgtgatggcgggcatctgtaatcccagctactcaggaggctgaggtgggagaatcacttcatcctgggaggtggaggttgcagtgagccaaaatcataccgctgcactccagcctgggcaacagggtgagactctgtatcaaaaaaaaaaaaagaaaagaaaagaaaaagaaagaaattatgcaatcagaaattgaaatcatcaacagctagatcccttcttttgtgaaccatcaccctgtgatgagatggtatccgctctgaacggctaaatgcctgcttgagaccatgtaggctcccggggacaccttgtaaccagatgcccgggacttccccagcgctggccgttccagaacacttcagagccagtgttacaagtcagggtggtgaggccacctccttggctgccaccagaacagcttctccactaggctaagaaataggttttctagcccaagagaccaggagaaatatctccaaatacatcttattccaggcagagtcttagatattttctgcccaagagttgaactgaccagcaagggaggcgtaagctcttcagtgatttgacgtgatcatcagaaacacttggcatgacacatctggaaataaactgggaaaaatcttttttgttgaagaggacatttttctgtagtcttaatagttgattaggtcggatgcagtggctcacacctgtaatcccagctctttgggaggccaaggcatggatcacctgaggtcaggagttcaagaccagcctggccagcgtggcaaaaccccgtctctacaaaaaatataaaaatgagtcggttgtggcattgtgtgtctgtaatcctagctactcgggaggctgaggcaggagaatcgcttgaacccgggaggcggaggttgcagttaactgagattgcaccactgcactccagcctgggtgacagaatgagattccatctcaggaaattaaaaaaaaaaaaaaaaccagttgattaattagcatgaaccagaaatcacctctacagtcctggacatacaggtcaccttgccaccttcctgatggctggttctagattcagtgtggacgagagatagtgacagaggtgacctgcttgggcctagacacacccacccaggcaccacatgaattcaactgaatgtaattccaagagctcctggagaggcaaggcaggcggccaccagcaccgccctgggcggacggaactgccattagaaatatcctaaattggctgggcgcggtggctcatgcctgtaatcccagcactttgggaggccgaggcaggcagatcatctgaggtcaggagttcgataccagcctggccaacatgtgaaaccccatctctactcaaaacacaaaaattagccaggcatggtgggcacctgtaattccagctactcaggaggctgaggcaggagaatcgcttgaacccaggaggtggaggctgcagtgagccaagatcatgccactgcactccagcctaggcgacagagcgaggctctgtctcaaaaaaaaaaaaaaaaaaaaaatcctaatttgtctgtatgcagggcaaatagattcaatgctgttgccacagaattgcttaaagctgccaaagccactcctcctagaactagattaatcagccagttccaggacaggccaacttcttgtttgtctttctgagtcctttctcagccattgttagccacacgctgccatgccacaaaataaaacacacgatggagacgctgcttggccaggcttttcttttcttttcttttcttttcttttattttcttttcttttcttttattttctttttttttttgagatgtggttttgctcttgttgcccaggctggagtgcaatggcgtgatctctgctcaccgcaaacctctacctcctgggttcaagcgattcttctgcctcagtctcccgagtagctgggattacaggcatgtgccaccatgcccagctcattttgtgtttttagtagagacgaggtttctccacgttggtcaggctggtctcgaactcctgacctcaggtgatctgcccacttcagtctcccaaagtgctgggattataggcgtgagccaccgtacccagccaattttttgtatttttagtagagatatggtttcaccatgttggccaggctggtctcgaacccctgacctcacatgatccacccgcctcggcttcccaaagtgccaggattacaggtgtgagccaccatgcccagcctttggccaggcttttctgattgaatgtttctagcagtggaatgtaagtctgggaggaagaagcagaactttcacctcagcccacgtgtcccatgtcattcgccaccatctcccacctgtcttagaactgtgcctcagtcctaagtattaagccggcacaaggccattcacaaacgacctctgcctgagttgtgtgtcctgggcacttccgtggctagggaccgtgttcccattttccagacgggtaggcagcagctcagtgagtttgggtaacttgccatggtatgtcttttcccagacaccctgtcgggtggtgggcactggggtgacctgtcctcgtcatccagtgggaaatccccatctgctctctgggggtggttgtttccttgttcaggaattgcaggcaaatgatggaaaagtccactcatttgtcccgcagcccccagcactggtctatgctgtcctgtctacgtcctcggattggcctggttggctgaaaatgccaggatcagcattcaaaacactttgtccagtgaagggttaaatatgttgaaataagcccggcctttacaaaagcagtggcatttacatcctgtacgtttatggaaatccttgctgaagaaaaacaaccacaacattgtttgtgcgtgtttttaggaagagaatggccaaagtgtctttaattcactgtttacccgtgagaattactcccaggagtaatcccgcaataaaatcttcttggtctatgagaatagaaagaaattgaatcaaaagactcgatttccacttgtatttattcagtctgggaaattcagtgggccggagtattagtatcagcaggggattcctttgctcctagcgttaaattactgtcataatcgctcaattatttcttccttgtactgtttaaaataaaaatccatcacattctgtgttttttttcctagcatttattaggttgagtgtttaggaaaatcaattatagtcagtcaggcatgaattgatgaatgttcttgtaataattgtcagttgttaaactgaatgtactttctctttcaccccttttcatttccttcagagggcagaggtggctcagagagaggcggagaccttaagggaacagctctcatcggccaatcactccctccagctggcctcacagatccagaaggcaccagacgtggtgggtagccccggccccgtgggggactgtccccgcctggcctccgcaccttcgagttacagccgcttgctcctttttgttttcagcatctctttttgggaatcacgttttaactagtactgctttctcggtggggtttgctttgaccaattgggggccggagcttgttaaagtcgaaggaagagctttgctaactgtgcgtgggtgggctgaggctagcgtggcatccacccagggccaaggtggaggctacgcaggcacagtcacagacacagtcacgatgccccagccaggcctgggggtgtgatcgctggcatgcgggtgcagacccgaaccaggagcctctccagaatgacacggagaaattgagggtttccgctgtgcctttccaagatgaggaacagttcaggatgagctgggagggtaggggtgggcgggcagagaggtaataaaataacattctgcaccgagtttatagagcaggaagagtgggtatcacaccacttttttgcagcttgctttttctgaaattagcgcaaatggctcttagcccaaacattcccagctcgatcaaggtggctttgaactatgggtttccagactctctttcaatgctgtatagggacaaggaacagcgtaggagctaagaccttgggtgttggagccatagcccccagtgcagaccccagctcagcagtctggtgatggggacaaaggagcttaacgtccctgagtctccgtttccccgcctgtaaactggggggttggtgcgaaagttattatgagcaaataacttagagcaaagctggacatgtaataagactaagtaaaccttagcagtaattctagttgtagttggcaccattatctctgatccctcagttttgggttttttttttttttctttttttttctaagacaaggtctctctctgttgcccaggctggagtgcagtggcgcagtcttggctcactgcagcctccacctcccaggctcaagggatcctcccagctcaacctcccgagtagctgggactgcaggcgcacaccaccacacctggctgattttggtattttttatagggactaggttttgtcgcgttgcccaggctggtctcaaactcctggacttaagtgatcctcctgcctcagcctcccagagtgctgggattacaggcatgagccaccacgcctagcctgatccctcaatttctagcacataatttcatcactagttcacttacaaacctcagttttcccatgtgtaaaataggaattaagtgatcacaaggccgctctatggagccctcatcctaaggttacaatgagtacatatcagttgtaggagtccttttatccaacagtgactccgtcaagcccttgccgtatgctagggcttgtagtggacacccgaagaaccataaggagtaagatgaggctggttgcagagagtacagtctcatcagaagaacttgctcttgtaataaattcaatcattgacaatcattatttccacccaatctgtgaaacagaataccgttatttcttttttttgagagagagtcttcttctgtcgcccaggctggagtgtagtggcgtgatctcagctcactgcaacctccacctccacctcccgggttcaagcaattctcgtgcctcagcctcccaactagctggagctgcaggcgcataccaccatgcccagctaatttttgtattatttgtagagatggggttttgccacattgcccaggctggtcttgaactcctgtcctcaggttatccacctcccaaagtgctggggttacaggcatgagccactgcgggatctcactcggtcacccaggctggaatgcagtggagtgatcatggctcgctgtagccttgacctgggctcaagcgatcctcctgcctcagcctcccaggtcttgaactcctgtcctcaggttatccacctcccaaagtgctgagattacaagcatgagtcatcattcccggccctatttttttatatagatgaagaaacaaaacctccatgaatgtaaacaccttttcccaaagcacagtcaatctaatggctgagctaagacctgaattgggcgttctggcaccccagactgtggcttttaaattattccccaggaatgaatctagatcaaggtattaagactcccttctaagaaaagattttagccttctttttaaaattaacattaattaaaacatttgttgctgggcgcagtggctcacacctgtaatcccagccctttgggaagctgaagcaggaggatcacttgaggccaggagtttgagaccggccagggcaaaatatcgaaaccccatctctacaaaaattttaaaattagctgggcatggtggtatgtgcctgtagtcccagctactcaggaggccgaggcaggagaattgcttgaacccaagaggcagaggctgcagtgagttatgattgtgccactgtgctccaacctgggcaacagagagaaaccctgtctccaaaaaagtaaatatgagactgggtgtggtggcacacacctgtaatcctagcactttggggggccgaggcgggcagatcacctgagatcaggagtttgagaccagcctggccaatatggcgagaacctgtctctactaaaaatagaagaattagctgggtgtgatggtgggcgcctataatcccagctactcaggaggctgaggtaggagaatcgcttgaacctgggagacagaggttgtgcagtgagatcgtgccattgcattccagcctgggcgacagcaagactccatctcaaaacaaaacaaaacaaaaaaagatatgattgaagtgttcctggatgtagagaaaagatttgcattgagcaggccatcacgtccttcatacttcatggactctggaacttaattttaactgaatgtccccttggctctgttacagttccttcctctaagtttagacaaactggatccagcaccatggctagggtgggaggcagccttcaggacagggtcagcggcttcccctggcccctggggtcctgcttcattctgcaaaggaagtcgtccattctgatgtgtctacacggggcccctgagctcagtgttttggttgaaaagaattctggcactatcctggactgcagcaaccaaaacatttcagaaggaaatgaatgtttttgcaggtagagtccgttgtggatcctaggggcgcttaaacacttcatcatcggttaagtgccgtgtttacatggcaccggttcagtctccccagagcagccccgtggggctccccgcgggcgtgtattcccacatagccagtgggttccagctgcagccagttggggagcaaacataggaaactgggccagcggaaaaatggtctgttgggcttggctggcagaatgcagcagagaaacggtggagtctgtagatctagcaaaggccaaaacccatccattgggtatcccagtggaatctccgattctagaaggtgagcggtcactgagtgagctgctggcccaagtttgcagccatgctgggctttgcatagttttgtttgtttgtttgttttttagtgagatgtagccccgctctgtcacccagggtggagtgcagtggcgcaatctgggctcactgcaacctccactcctgggtttaaccaattctcctgtctcagccttctgaatagctgggattacaggtgtgcgccaccatacctggctagtttttgtatttttgctagagatggagtttcaccatgttggtcaggctggtctcaaactcctgacctcaggtgatctgcccacctcagcctcccaaagtgctgggattacaggcgtgagccaccgcacccagcctccctaaagctttgaaggccacctcttcctctctctgatttcctctctagcttttgcccatgtctctcccagccatcaccctatggactgacaggccgctgcttctcatccaggccccctggatcgctccccaagcccctctctgtttctttcttcattctcccttatgtccttgtgacagcacaactgggagtgcccactgtgttgagatggagtgagccacagtttcagataaaggaaggatgggccaggcgcagtggctcacacccataatcccagcactttgggaggccaaggcaggcggatcacaaggtcaggagttcgagaccagcctggccaaaatggcaaaatcctatctctactaaaactataaaaatttgcctttgccaggcatggtggcatgtgcctgtaatcccaactactcaggaggctgagacaggagaatcgcttgaacctgggagggggaggttgcagtgagctgacgtgacaccactgcactccagcctgggtgacagagcaagactccatctcaaaaaacaaaaacaaaaaaaacagatagagggaggatggtcatgtctgtgtcatttccaaggtcttactgctttggggttcattttcacctcatttagttcgtgcgagacagcgatgatttttgctgttttatgaaggaggagtttgtggcttgagttgctgggagttggccagtgtggccgagctcttgtggccatgcccagccgggcgcaggagttgagccctcgaccacccgctgcccggtccccactctgggtccagggacagcactgaaatccacacctttgacctgtgtcactggaagcacctgtcccagatacattcactttgacttgcgccttgtaaaacccacattcccttggctggttttactgacccttttcgtaaaagccctttaatcagtgtctatggccagcacccctcagggtggaagattaagatgaagacgtgatatagcatgattcaacctgtgcccagactgacctccctacatgtcacttctgccatgtcccctccttgctccagagctggcagggactccccagggctgccaccacatgtccaggcgcctctggctacccctggcagctgtcactcctccagccctgccccacactcctgccagcctctgcacctgcctgcatgtcctccgcccttccccggcacccaccctgagatggagccccctttccttccgacaaggtcccgccagccctcccgaggcccacccattcccccctcctgtggctcagccccacgtgccactgtcctggtcctcctaccctggagggctcgtgacgttggccctgcccggcattattcagagcggtgctttccagactccctgtgatggacagttttgttttgttttttaaatttccagtctgtggcagactgatcgttttatataaaagacatttaaaatgtcaccgaaatgccgaatcgctataaaagtttctaaacacttattctcgatttctgtaattgcctcactgtgcaccagcaacagtttgcaaattggcaacgatccctgcagctcacgctgcacagaacgggcctggacagcctgtgcctggtaaataagccgacaggagatgctcgctccagccccccagggccacgcgcacagctgtcagaggtcaggagaaccgaaacacctcttttacaacctcatacaaatcaaagaagcaggaaggagtaccctctttgcacacaaaactttacagacttaaatggtaaaggcctcattttccccgagggagatataaaacattatttccctgagtgaatgcctgcctgtccccaaatttgaaaatccgtggtgagcacacggtgcatgggatggcccagctgtacctgccagctggggccacggtgccaccctttccccacaatacaagcaagatcaggacgtgaaactgagcacttcagaggggggacagcggcaaggacagtggctttctgtgttacagcatgagctgcccccaggattcggctgtcatagacaccatgcagctctgccctctccacccctgtccccgtctgtcatgcccagaattgcatctgccctgcagaaaatatttcagaatctttcaggagccaggattcctttttttttttttttttttttttttttgctttgacacagagtcgctctgtcacccaggctggaggtcagtggtgcaatcatggcccactgcagcctcaacctcctcaagctcaagcaatcctcccgccccagcctcctgagtagctgggactataggcatgcaccacaatgccttgctaatttttgtatttttttgtagagatgggttttcgccatgtggcccaagctggtctcgaactcttgagctcgggtgatccacccacctctgcctcccaaagtgcttggattacaggtgtgagccacagcacctggccccgtgattacttttaaaggttgaaaaaagtactacttgagtcattgagaagtagaattacagatttgactttttcctttttttttttttaataccttagcttttttctattttgcgtattttccacaatgagcatttagtgaggttaaggggtgggtagccaggtttttttcacatcaattatcctaagagttcttcaacaaaggaacaccaaatatacattttccacatcttttaattcttttattaaataaaatactggccgggcacagtggctcatgcctataatcccagcactttgggaggccaaggtgggtggatcacttgaggtcaggagttcgagaccagcctggccaacatagtgaaaccccatctctactaaaaatacaaaaatgagccaagtgtggtggtgcccacctgtaatcccagctacttaggaggctgaggcaggagaattgcttgaacgcaggagacggaggttacagtgagccgagatcgcgccactgcactccagcctgggcgacagaccaaaactctatctcaaaaaaaaaaaaaaaagaaaagaaaaagaaaatgctgatacagagttttcaatttgtcagacaatatctcagcttccgggtaatttaacagtgaatctcaaggaccttgaatcccaccttgtggtggaaaatctcggtggtttgggagcattggagggaggcttcctcctctgagccacccactctgctgttcccctgcctggagcactcttccctcttccccaacgctcagcagcccctccccacctcctcctcctccaggtctctgctcacacatcaccatctcagtgagtcttttcctggccatcttactaaaccccctgcctctcagctctgactctggcctctgttttaagtctcctttgacagtggtcaccccgcacacttttcattactaataagtgtattttctgcatctcactcatcctgccgcatccctgctgggctgtaagccctgggaagacagggacttttctcctgtttttttttgtttttttgagacagagtctcattcctttgcccaggctgaagtgcagtggtacaatctcagctcagcgcaaccttcttctcccgagttcaagtgattctcctcctcagcctcccgagtagctgggattacaggtcaccaccacgtgcctataattagcccagctaatttttgtatttttagtagagacggggtttcaccatgttggccaggctggtcatgacctcctgacctaaggtcatccacccaccttggcctcccaaagtgctgggattacaggcgtgagccattgcacccagcctggactttctttgattcactgctatatggttggtacatggtaggcactcagtacatatttgtccagtgaatgaatcgaggtggcagctaaccacagggggaggaaggttgcataggggaagtgcaagcaagggcaagaagtgacatcctgccatcaccatccacacactgacatctgtgcagcttctgtctcagttgccagcacaggtagcctcgagcacccgcctcaaggccagcgcagttttgtcatctcttttctcctccccaggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaagtaagggggctgcggggcccgggggtggcccgaggaggcagggcggatggctggacacacgcgcacacacacaccctctgcctttctggacttgatagcaagtgtggcaaccttgaacctctgtaaagtagcaccaagcagagtcccggagtccatggcagggagactggatgttaaaccctggcatcagcccttgtgtaaacagcatttccctctttttttttggagtcggagtctcgctctgttgcccaggctagagcacggtggtgcaatctcggctcactgcagcctccgcctcccaggttcaagtgattctcctgcctcagcctcccatgtagctgggatcacaggcgtgcatcaccatgcccggcttatttgtttatttatttattcattcatttatttttgagacagagtttcattcttgtcacacaagctggagtgcaatggcatgatctgggctcacagcaacctccacctcccaggttcaagcgattctcctgcctcagcctcctgagtagctgggactacaggcgcctgccaccacacccagctaatttttgtatttttagtagagatggggtttcgccacattggccaggctggtcttgagctcctgacctcaggtgatctgtccacctcaggttgccaaagtgctgagattacaggtctgagcctctgcacccggctctttaactgagttttgcagggcatcctagctttctgaggatacccctacaggaggagctggtgtactataactccagcacttccggtgcatgagccaaatgaaaccccagaggtccatggaagtcacatctgaccttctaagggacattctcttgtccaagcaccttttccctcagtggcccctgtccaggtgctgcttcagtctaggctccctcccactaggcactcttggcttttccataaatttctatcccagacgcagaacccagagctttttccacatattaaaaagtaatgattatactttaggtatttatgatccgttgaagcaagtgtaatttgaagagggtcctgggacccttgattcacaggcttcagagccaggggagactctcggagttgtctgtcttgacagcgaagaaggcaggaccttcagggcagggcttcagccccaggccaggggttccctgctctgcccgggggctgcccgttcaggcccattccttccccaacccggtacctccatgttgggtgggtgagggaatgagtggctgtaaagtatattcattgtatgaataaagtgggtcagggttcattgtgaacatttaaaggaaaccttttctggtatgaagtagtcctaggatgtacttaggtccattgtgttttgtcgttgttgttgttgttgttgtttttgagacggattttcgcttttgtcgccgagactggaatgcaatggcgcagtcttggctcactgcaacctccgcctcctggattcaagcaattctcctgcctcagcctcctgagtaactgaactacagtcacgcgccaccatgccagactaacttttatatttttagtagaggcggggtttcaccatgttggccagtctagtctcaaactcctgacctcaggtgatcaccagcctcggcctcccaaagtgctgggattacaggcgtgagccactgccttttttttttttttttttttgaaacggagtctcactcactggcccagactggagtgcagtgacaggatcatagttcacggcaacctcgaagtctcgggctcaagcgattctccttgcctcagcctcccaagtaactgggaccctgggaccaaagacatgccccaccacacccagctagttttttaattttttgtggagatgggatttcactgtgttccccaggctggtctgggacgcctgggctcaagcaattctcccacctcggctcccaaaacactttgggattataggcatgagccgctgcacctggcccaatgtctttttttttttttttaattgaaattttctttttgacacatgaccaaatttataccaagactaagtttccagcaatctattgcctatgctgatggctcccacgaccctccctcactcctttcttctgcctctttggggtgaatttcacccattcactgagaactgcccagcgccgggtcccttggaggagacagtcctgccgactttggggaaatggttgaaacctggttctgtctgtcctcagccaggtcgttttttttaaatttttattttattttattttattgtattttattttattttattttattttattttattttatttgagacggaatttcgttctgttgcccaggctagggtgcgatggcgccatctccactcactgcaacctctgcctcccatgttcaagtgattctcctgcctctgcctcctgagtagctgggattacaggcatgagccaccacttccggataattttgtatttttagtagagatgggatttctccgtgttggtcaggctggtctcaaattcccgatctcaggtgatccacccgcctccgcctcccaaatgctggaattgcaggtgtgagccaccgcgaaccaggtcatttattttgtcaccgccgtttcttcctctctcatcagcttacccaatgagtaccaggattcagtttttatttctacatttaatctcattttctcatgttacagccatttctgaccccagcaacggcattatgatgagataatttgcctttctctccattgtcaagttaaagggcgtgactcagatacacaccggctacaagagagcaaagctgtagacctcacattttttattatagagcaatttcttccaaatcagttaaggtttcaatgtttgccttcacaaaaaaatgaaacgcggttttgcaaattaatgttcgttatccgtatcttgggggaattgtttaataccgtgcagttaatgaaacaattcagcgatacttcttccaaaatcattgctaccttatcttcatctaatctaataatcaaaacatatcttctagtaacaagacttctgattttaattatcttaactccttgttgccagattgtcctgatacgaaacccacatgcagaaagcatctgacttcaccaaaccagggtttcctctcgccccaaaggaataaggttaattgaatgagatatgttctgagggctttttgtttttcctaatgtgtataatgtatagcctcaaatataacctaaaggaatacaattattaggaaaatatttttatgaataagacttggcaaattggcaacctgatgcttttgccatggggaaccctgcccccgcagtcttggctactcaaagaactcacctttacttaccacggagctgctttctttctttcttcttcctgtccccttcccctctttcatgtcttacgggggaccctcggacacacgatggggccttgaatcaggttgctgtttgggagaggaggctccaagctcccagctctgggctcagctgtttggagttgcaggtggttttcccatgaacacttggcagcaggtccttgatctttgagacatgtgccagggtgtttggtgacagtcacttggggagagggcatttcccataagcagaaggcttattgggcagaatcttttgtcctgagttcactgagttgtttccacccatactttccaatgatactttctgtagttggatatatcagaggactgactaattggttttctttctctaacccattgaaattctccatctttctgccactgagatttctcctcttccctcaaatttgatttgttatttcacaaggataccagacagctgcacatcttcgagtctgtcctgtccagggctctactttttcaagcaaagctccccataaatgccccgctatccacgtgtgtcatgggacatcgctaacctttaattaggcatggaaacagacgcaaaagtggaagatgtttcctcctgcctaatctgacaagtgcttaagcatagtgccacttgtaaagaagaactgtttttgcaattaatgaaatagcccgaccgccgtgacaaggctgctttttgataactctctattctgtggtcttctgttggaatgctttaatatagaagcagtataattagctagtcaactgcactgtacttgctacagcacagaagataatgctaccaatagcttcgatttaaaatagatatttataagaaaggctaactaaaagaacaccagtctcccagaaggagaaattatatttttctagagatgcgttaaagatcagtgcttcccactgggtggatggtcacatgcgttagaatcacctaggggtcttttccaaactgcttctctttccccactcctgaggttctgatgggtcccatggagacactatgggatgatgctgtgtccctcggggcactgaggtggtataaaagaggtggtataaaaccgtccctctggccttgggtgtctctcttttcatcttgcattctcggagcccaggagttcaagaccagctaattttttgtatttttagtagagacagggtttcaccatgttggccaggctggtcacgagctcctgacctcaggtcatctgcccgcctcagcctcccagagtgctgggattacaggcgtgagccatcgcgcccggccccatctcttaatttttttttttttaatgagccagagtggtggcacatgcccgttgtcccagctacctgggaggctggggagagaggatcattggagcatacacagcacccaccccattgctttggagatttggactcaccgtccagagtccacagtatccttgggctcctccccaactcccagcatcagcagaacctaaatctccatgcctgctgcctctgcctgaggaaccatggagacacatgtccttatctatggagagtccttgtccagtagaagaggaggtgcatgctgcccaggcctggaccccagagatgcagtgtcagctaagggtctgtgcctcagacccctgccctgggccagggggtccccgtgagaccgaagactcccacaccaactctaacctgagccagtcagacagcaccatgtggagcctggccccatttatctgcactgcagatgccactctgcccccacggtcagaattttatggaaaagagatattgtcaccttgaccactggctgtgcaacctggaagacatgacctttccctgggtctctgccttagtcagacctgccagaggcccctttgctgtttttttgagacagggtctcactctgttgcccaggctggagtgcagtggcaccatcatagctcactgtagcctcgacctccctggctcaaggaatcctcccacctcagcctcccaagtagtcgggactacaggcacacgccaccacacccggcgaatttttatatcttttgtagagatggggtcttgctatgttgcccaggctggtgtcgaactcctgggctcaagtgatcctcccacctcagtctcccctagtgctggggttacaggcgtgaaacaccatgccctgcagtagatagacatagtttatagattaaacacctaatttgctaaagccaaaatagttggcattgtaaagtttattatcatttaagtcttagccaggcttttaagagcttcaaatagacaattcttctggcatttcaggacccagctggggagcaccagctaggtttctggagccatgtgggctccgtgtatcttttccatcgtattattacaacaggcgtgtttgattggcacttgatcatcctacatctcaccactgtcctttgaaaacccatattcattctgaatctccccattcttcagatgagaaatgtgaggcccaaacaggctaaggttatccaaggtcacagtcagctagggtaggaccaggttggcagccaggtctctgacacttggccttttcttacctgtctgtgtaaagcccacgtgtgttccttagattcatgcattttattttattttatttttaaagacaggatcttgctcttttgccccaggatggagtacagtggcgtgatcataattcactgcagcctcaacctccagggctcaagtgatcctcccactttagcctcccaagtagctggaactacaggtgtgcaccaccacacccagttaatttttaaatttttgtagagacagggtctctctatgttgcccctgctggtcttgaactcctaggctcaagcaatcctcctgcctcggcctcccaaagtgctgggattcaaggcatgactcactgcacccagccagacaagtgcatttttcaggaagatgaccagttcccagattctctttccacagccttggacatgaagttacccttgacagcgggagccactccagggcacatgtgctctttctctgtggctctgctacagaatagcggggaccctgggaggtgacaggctgagatccgcagaccttcacgaacagagcccctggagaaacagaaccagagactctcttcagatccaatgtagccagattcaaccccacctagcagggatgtagtaattgtagtaacaaggacagtaacagtgctaaccaccatttacagagcactttgccatgtgcccacactgtactaagctctaagtacccaatatttttttaatcctcatcaaagcactgtaacatataaacatgatccccattttatagataaggaaactgaggcttggagaagtcaagtctgggtgggtaggttggttggttggttgattggttgatttatttatgtatttagagacagggtctcactcttttgcctggggtggagtggcaccatcacagctcactggagcctccacctcccagactcaagtgatcctcctgccccagcctcctgagtagctgggactgccggcacatgctaacacacccagctaatgttttggggttttttttttgttttttttttttggtagagacggggtcttgctatgttgtcgtgcttatcttgaactcctatgctcaagcgagctaccacacctgacccaagatgttgagtcttatctaggttcaccctgcaagtacgtggtggagccaggatctgtcggactctggagtccaggtttgcagagagcccccggctcatcctggcctctccggcatctcacttcctccctgcaggcacgtaggaccggcctcagctctgtcaagatctgcactgtaggaccccagagatttttttctttctttgggtagtcagacccatctgcaaaagttttgcaatcatgaaatcagatagcgtatgaaatgctaggaataagcgcaggtctagcataccacgcggccagcggtagcgtgacctgacaggaggagtgcgtcttcagagacattgggaaactggcgtgcctgtcgcccgtcccagggtcagagtcttcgaaaccaggctttctgggaacccaacaaggagtttctgatcgaagaaccgcactgaggacagttagtcttttttccacactgggcattttcagcattggaagtcaatgggagccctgcgtctgcaggttttgagatgtggcactcacagcagggtcactagaatggagacatccatgggaccaggttacaggcgctccggcagttgggagaagcgtcgccaagcagcctcccctaggctccatccagcttgtctgcccaagacagaaaacgtcatagaaggtttacagaagagatcttggggacttcctagttcaactgcccctaggtagatggcagaaccctcaatggaagctgtttagctctcagcaaaactcacggccaactaaaatacagtcgtgtgtcacttaacaatgaggctgtgttctgagaaatgcgtcaataggtgaatgcgttgttgtgcaatcatagtgtgtacttgcacaaacctagatagtatatatatatatatatatttttttttatttatgcctatttttcatacagaaaaccaaatgtcccagcaccattactgagcattagtcatttcccttgcttgatctgcagtgcctttataaagggccgtatgtcaactttctctgtatgttccattagaatcttacgggactcaggccaggcgtggtggcacacgcctataatcccacactttgggaggccgaggcgagtggatcacttagtgttaggagttcgagaccagcctggccaacattgtgaaacttcatctctactaaaaatagaaaaattagccagacattttgcaggcacctgtaatcctagctacttgggaagctgaggcaagagaattgcttgaacctgggaggcagaggttgcagtgagccaagatcgtgccactgcactccagcctgggcaacagagcgagactccatctcaaaaaaaaaagactcttatgggacttaggcagcctttgttgaccaaagcgttatgcggtgcatgattatacatggattccactcctaaaaccttccaattagggccaatcacaggccttcaaagaagacctgcagccgtgcccctagacagaaactgtaatgggacttagcagtgctaagagtcccaatatcaagccaggaacctggaatctcggcactttgagaggccaaagcaggaggatcacttgagcccaggagttcaagaccagcctgggcaacatagtgtgacctcgtcactacaaaataactttaaaaaaaaaaacaaagagtcccactgttgagggcccagagttgccaacatctgaactggttctttgctttgtgcaaacccttgagtaattgctgttattcccattttacagatgagaagtttattaacttgtccataggcacccaggtcagaagtgacagactcgagttccaggctcaggctgtcggccttcttggtctgtgccatgccaggctctgagaccctctgtgtgctcctccctctgtctgccttattcccagccggctcctattctctggatatgaccacgtttatgcacgctaaatttagaccacacctggctaattttttgtattttttttttttttttagtagagacggggtttcaccatgttagccaggatggtctcaatctcctgacctcatgatccacccaccttggcctcccaaagtgctgggattacaggcgtcagccaccgcgcccagccctgaatttttaaaacatcgggcaggttgggatttggatggtgccatctcctccccaaagtctagaatgttctcagttggctttaaactgtggtcttagccatggctagtcaagggcacctacaggcatggtggctcacgcctgtaattccaacactttgggaggctgaagtgggagaatcacttgagctcaggagtttgagaccagcctgggcaacatagcaagaccccctctcttaaaaaataaccgggtgtggtgatgtgcatctgtagttccagctactcaggaggctgaggcaggaggatcacttgagcccaggagttggaggctgtagtgagctatgatcgcaccactgcactccagcctgggtgacagagcaagatcctgtctcttttttaaaaaaaaaaagaagaagaagaacaagaagcataatacctagaaaccctgtagaggggaagttaccggaaatgacaattgttcacctctagcttggaaacatgctgaatggccagaacaccctcccggcaccgcccctccatattcttgttttatgtagagttgcctcatttcctccaaggagctccctttagaaaagatcaaaagcaaactagtccaaaaacaccttcagagaagaaagcaccccctacgaccaccctacagcaatggctcctctcacaagaaagccctgcagagctgtgggcagaaacggccacatcaggctgggtggggtggctcacacctgtaatcccagcactttgggaagctgaggcgagagggtcacctggggtcgggagttcgagaccagcctggccaacatgacaaaaccccgtctctactaaaaacacaaaaaaaagtagccaggagtggtgatgcatgcctgtaatctcagctactggggaggctaaggcaggaaaattgcttgaacttgggaggcggaggttgcagtgagcgaagccaagatcacgctactgcactccagcctaggcaacagagcgagagtctgtctccaccaaaaaaaaaaaaaaaaaaggattaaaaaggaaaaaaaggaaacaggccacatcaatccccagtgagctcacagacctttctggagcccactggagcgtcatcatactttggaaatgtgccatccctcccctaggcccctgagagggagcagcatctcggtcagggccctccccgcaggactcagaccagctggctgtcagggaagccaccaagcactcgactgaacaggtccctgctcctaaaaccccagcatccaggggttcaggagtggaaaggcctttgccctgatgcctatctgatgcctactctcaatacaaaagggctgtgtctctcgttagtagaggtcctcccaaaggtgttgacaaccagctgtatgagtccctcagcctaatatattttgtttaaaaccacacgctgcttttcagacaccaggaaagcctctcctcctgtcctcctgtttgctgtttcatggcacttcctacaaagtacacttttcctcctctgcttttcacctctgcaaagattcttccttcttttttttgggtgcggggggggatgcttttttttttttttttttaaaaaaaaaagaggtagggtctccactcctcactctgtcacccaggctggagtgcagcagcacaatcatagctcactgcaccctccaactcccgggctcaggcagtcctcccacctcagcctcccaaagtgctggaattacaggcgtgagccaccacacccttcattctgcttttgctaagttgtacgttacaaccttacagcatccctacacactttgccgtgcctgggcacgcactcacactgggcaggccaggagcgtgagggacaaaagatggccccagcaccgttgactccattcgcaagggctggcttcccctctcaggcacagctggctgttccgcagtgaatgccgtcggtgaagtccgtcgacctgttgtcaggcatggccactgatcaaattcttctctgttttcagcaactggaagaaaaactcaaaggccaggctgactatgaagaggtgaagaaagagctgaagtaagtacggagagccctgtggcccctcacacgctggggcgcattagggccatctgctaacaatgccaggctggtggcaggaagccttggccccctgccctctggctcagcagatgcccgtaaatgcagccagagttctaccactgcatggtgtcctgggctacccaccactgtgggcgtttgcccttgggcctgtccctgaattctttggacttttgctaaaagctgtgcattgcaggtattccagaatgtatggaatcaggggcatagggcttttacagaaatgatcaaatatgaccttgttttgcaactataaattccccaaacagaaacaaagcacaggagggaaatgttttcgggttgaaggtgggcatatggcctcacgctgccccggcctcctggactcaggaactctgtcttccaaactctattctccatctgtgaggctgtagccgaaagcttatcatcttttcagggctaatgatggcattctcagttctcaagcttcaaagttcctttctcggccagcagcccccacctctgcctcctcaccctgagcctgctttggcactctggagctcccaggtcctggtctttacctgtccccccacatccataatgctccaggctcactgacctcccctgcaagcctggagcctgtggtcagaccctctacgttcatacagctcccctggatcgtcagccattccaagccttcccactggcatgcccgcctcactcctaggttattaagcactgcaaacgaaggttgcctagggcatggtgaccagccccacaggtcccccgtgcttctcgcggctggagctctgctggttcgaggcttcctcaggggttcctccctgcccttgtcactgttaccccaaccactatccacagatgccctagccctctgctagggacagactcccgcctctggtcttgggtgccacctcccatctctgcaggctgccccctctgcctagaccttgagtcccttccttcctgcccctcctgctgtcccatcagcccctttctctcttgctgctattttccatttctccttttaagatgagcctacacccactcaccacgttttctttgtgttgttaattccattctgctaagaaaagctcctcgggcatcctcttgaaccatctcacttccatgaccagctgccttctctcgcctgggacccccagcctccctggcgtctgctggccctggtagtccctgtccccaccatgctctccccctgagcggtctcatcccctctccagctgcaaagcctctgccggcacctcctcggacagacccctacatccctctaacagttccagcctctgtaacttacttacttgcttgcttacttatttatttatttgacagagtttagctcttgttgcccaggctggagtgcaatggtgctatctcggctcaccgcaacctccgcctcccgagttcaagcgattctcctgcctcagcctcacaagtagctgggattacgggcatgagccaccaccccgggctaattttgtatttttggtagagatggggtttctccatgttggtcaggctggtctcaatctcccgacctcaggtgatccacccacctcagcctcccaaagtgccgggattacatgtaacttattattaaacattacctggttaaccttctctacctgcctctcctatcccattctttccttcctttccctcttcttccctcttccaaaaagaaaaagaaattgggccttttaattttgagccagagaaactgctgcgaaggcctttgcccagcctcaccctgggagttagtcgtcgtcttcattgtcgtcttcgttgtcttcttctttcttcctctcttcttctttcttcctcctcctcttcttctttcttcctcttcctcttcttcttcctcttgctcctcctcctcctcctcttctcccccaacccccacgttcacttcatcccctgggagctgaggcttccaggctccagcctgcaacacataccgttctactccctctcatccacagcctgccggaccacaggctgcccctacccccactgaagggctgccacaccagccccgcttgtcactgcatttctgctaactctttctgttgcgtccgcacatgacaggccccaccaccatgtgcacatctggaagccccactcaggtggcttctttgcccaaatgcgctcctagttttccacttcctggtgaaccagctgtgctcttgagctcttgcccgcgtccccttctcagcatcgtcccatttccacttcctcacccccacgcaacaggggatgctgacctcagatcctcatgcactgcagcacaagacaccctgtcccttcagggcccttctccaatgcttgttcatcatgacactgagacgtggtctccaatccatcaagatccctcctgctggggtcctcacaagttctgtcttaatggaccacttggagtcttgcctattacctgtaatggcctgtaaatttcctggagtacggaccaggagtggttctgattccccacggcaacaagcggatagcaggctgctggtaaagatctgtagaatagataaagagccacgtggtcttttattacataatcctaaagaaaataggaaacgaaggacaggattccatcttaagaaacccctttcagctgggcgcagtggctcacatctgtaatcccagcactttgggaggccgacagatcacctgaggtcaggaaaccagcttggccaaaaccgtctctactaaaaataaattatccaggtgtggtggctcacactagggggacagaggccgaaattgtggctgcaggaacatggcgaaggtccggttgactctgcacctgcgagtcgtaaatctcacggtccagccagcctgctctgggtctctctcttccatccttggtatttcaaagaaacacttgcagctccttcaaagccacatagcctcacttcccctcttctccctggtaaactcagcaaaaaagggacatccacagcaaaaggaactcaagaaacagtaataatcctggggacctggactcactgagacagcccagagaccgtagtgatcagggtgcggcccttttcagtgccattgagaacaagggagggagaagtcaccttctcttgccacatctttgtcattgcactccttccccaacctggggctgcagagaaggtctgcccacctggcttctgagtcatccaagtctaggaggttgctctttgcctatgtcccctggtccccaggtaggtgccagttaggagtgaggtgtgggcagtggccgccctggtgggttcccctctctctggcttctccttacaactttttccttccctttaagctttacaaatacattccacttgcaacaatgttatgtctgtattaaactttaaaattatactctgaacagacctggtgtgattccatatggaatgatttacatgctaggcaagaaacttttgccagccaactgctagttgaatagttattctagagacattatcagattctattactgccagggaagttgttaaagttgacagttcttcggttcctggagagcaggaaattgtaatgttaatgcttattaatgtggctgttgtcaaaggtataagtagaaaataatcactctggtggctcatgcctgtaataccaacactttgggaggctgaggcgggtggatcacttgaggtcaggagttcgagactagcctggccaacgtggtgaaaccccgtctctactagaaatacaaaaattagctgggcatgatggcacatgcctgtaatcccagctactcgggaggctgaggtaggagaatcgcttgaacctgggcagaggttgcagtgagccaatatcgcgccactgcactctagcctgggtgacagaacgagactctgtctcaaaaaataaataaaataacccctctgttgtgctcttgcagcattctgaagtccatggagtttgcaccgtccgagggcgctgggacacaggtacgtgtctcacctcaatggtcagcactagcatcagccccgctgctggttaccactggtccctccggcatatcccatgatccactgtttctacgagacctctcacttacagccgatgagtcatacttcaagaacatttaaccaagttgaagcaaattatctttttttttttgtctcctttttttccatgtgtccaaggcatgaaccaggcatagatcaaaagccaagctggggatgaacaagggattgcttcatccctgactgataggagatgggcactaccaaaaagcaaattatctttaacaaaaagaggcaaaaagagaaaagctagtgttttccaaactggtaactgaagtgaaattgtgatttcacttcagcaggtactaagaacataaataaaaaacaatttcagattgtgtttaagaaggccaggctcagtagctcatgcctgtaatcccagcactttgggaggccaagacaggaggatcgctttgaggccaggaatttgagaccagcctgggcaatatagcaagaccatgttgctattaaaaaaaaaaaaaatagccaagtactgtgacatatacccgtggtcccagctacttgggaggctgaggcaggaagatcgcttgagcccagtagttcaaggctatagtgagctatgatcgcaccactgcactccagcctggacaacagattgagactgactattttttttttaattgcattaaagagcagccaaaaatggattggtttaggaactttagttacatgctgcctcagtagagaaggtacaagggaaggatgactgtggcccagggtcatctggtggccaattaaaattgacatcccagaccaagcatggtggctcactcctgtaatcccagcactttgggaggctgaggtaggtggatcacttgaggtcaggcatttgagaccagcctggccaatatggtgaaaccctatctctgccaaaaatataaaaaattagctgagcgtggtggcgcacgtctgtaatcccagctacttgggaggctgaggaaggagaatcacttgaacccaggagccagagggtacagtgagccaagatcatgccactgcactccagcctgggcgacagagtgagactccatctcaaaaaattaaaaaatcaaatcaaataaaattgacatcctaagtggaatctgactcctgatgcccagaagacagccaacatctttgtggctggcaaaaaaaaaaaaaaaagaaaagttccctttacagtaacgttcggacagacgtttgtggcttggcagccagtcttatggccaaatgaggcacgggctcaggtcgcttgagtttgagaacagatgagagaataattaatttttttaggagctgtggaagtctaagaaggaaaatgacttcaactagaatccattctttctaaagggaacttgttttccacgtgtgttaaacgacttggggggaaatcagctgtccgcagcccacttcctaatcagatcgagagctgggtgggaacgcggacagatggagggaggcagggctccaggcctggtggccccgggagcgggtgagtggccggccccgcagtgagacccccgctctgccccttctaggatgcggccaagcccctggaggtgctgttgctggagaagaaccgctcgctgcagtccgagaacgccgcgctgcgcatctccaacagcgacctgagcggtaggttggccgggcttcgcgcgtgtgcggtggttggttcgcttccaggggtcggtcgaggacgaggaaggtgaatcgtgagtctggacagatgcatggccagagaagcgccggttgacgagaacctttgactaacgcgtgttgggtgccctcctcctcaccgctcctcccttcccttccccgccctgcttaaagctggatgtcgagacgggccagccgcacaggctctgcggaggtcagttaggggcagtgcggctggaatccccgggagggacagctcggaggacgtcggcctttctgatctgtgtctggttgtgctgcacagaggccaggggcagtgtgaacccagcctcgctctggtggtgttttcagggacagccccgggcctgccgggtccagtagaggtttttcttccttggtcaggtttcccctggggacgcgtcccccatccttagcctttcttggctcatcccccaaatggtggcgtcacttgactgtgcttctggtttgggcagctggtaaaacgcgtacaggtgtctcgggctctaatggtattgcattctcaaaacgggcgcgcgcctccacatcgagggggctcggtacggtgcatcgcctcagagcaagaggtgcgagcgaatccattggtcctaaaatgtcagtgtttgctgctcctccggccggggccagcgggcccagtaagaggcccgcgacccgtcaactcttccctgtgtgtgtcaccagctccttgtcacgctaggagtttgagtctatgtcaaggggactctccaggctgcaacgtacaagaaaggcgcaaacatgaatgcatgttgcttgttttgggaagcctcgtttggctgacttacaaatttaatcggaaaacaaaccaacccacctcattggcccttgtaaaaaaaacctgcacttttttttgttttcccttttgcgggggcaaacttttgcattttggtcttggtttttttttccccctttggaatcccccataatgcattctgtttgcccttccttgtagggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagaggtgagagactggcgttgggtggcgccagcgtgcgagcccgtcacagagttgcacatgtgtgtgtgcatgcgtgcgtgtgtctgtgtgcgtgatgaaacatttgtgcatcacatcaggtaaagttctctttgcttctgccacgtccagagctcaagggtggcccggcatgagttaaggctgttagatttgggagatctggcctttgaaacgcactcagcactccatacttaggaaaccctatagtatttcaatactagagatcgtatcagagggaattgcattacatgatgtatagcgtctccgtatgcttagtggccgcgggtccaattggccttgggtgctggtctcacttttgggaggagcccttaagtcccctccagccccatagcagcaacgttgactgggctcgatcctcatgcaaagctggttctgtagggagaacacatcacagatgacacctcccctcttcccaccccgcagaagagggcgtgtcccatggccaccttccctacattgttcacggtccattagtgatttgtttagcattatgagtaaaacaggcctggcttgagtaaaatacacaaaagttttatttaagcaccctttctaccccaccctccgtaaaaagataaaatgtcagtcacattcataatttcaaaaaatcccagccgggcacagtagctcacgcctataattccagcagtttgggaggctgaggtggatggatcgcttgagtccaggagttcaagaccagcctgggcaacatatattttgtaatcttttgatctacaaaaaaatcaaaaggttagctgggcgtggtggcgtgtacctgtggtcccagctacttgagaggctaaggcaggaggatggcttgagcccaggaggtggaggctgcagtgagccatgattgagccactgcactccagtctgggcaacagagtgagaacctgcctcaaataaaaaaacaaaaaagaaagttccttttctgtttaagaccaggggatcaatgtgccacatcaacagagctattgagaggtcatttcatcagacatgtttgaaacaccctgaaatttagactcaaacagagcagggagatgttttgaacagcatcaatttgcaccaagaaaatgcagtgttttatgaggatgttaaccgaaattgaatgtctttggatgattaatgcgagctttgttctgggggctggcgggtgatcctccttcaaggcagtcctccctcccatggacctccctggcctcaatgccgtaggtcgctacttagatttcccccatctccttttgcagcagagccacggcctctgcgggccggtcagccagggaagggcctctcagaagattctagaaactcccgagttgcacaggcagccctgagccctttctttagtgacaggcggctcagatttcatgtcacacagcccatatcgtcaacaccaccattcccctgattgttttgttcttaccacacttgtttttcaacagagaatccaggccagagcctgaacagactatttcaggaagtaccgaaacgaagaaatgggtctgaaggtatgttgcaggcaggcgttttctttgcagtcagtcacctagggaagcagcatgtccttagctgtgtatttgggttaaaactgtgcagtgtgattctggcctggaacctgatggaaaaacagctagtaagtataaaacaaggcacgggttcaagcacacccagccccttcctcccgagctgcctgccctctcccaagcacaggcgggggtgagaagaggcattgctaagctaagccccccgagtctgaatcccagcccacttcagatcctaattacccggtcccccgtttttctcagacgcagttgaaaaaataacagcggttgctctgagaaaagtcaggtgacccgtcaaattaaatactgctgcttcctcgtatttttaactcggaaacacactcaaggtcctatggaacggacgcatcccacatcgtcccggtggcatacttgtttttaaatggtggtatacttgttttgaatgcagtggttcctatttaggaaggtagtaagaaattaaactatccgggtggcttcccgaaagagctggggccagcccctgggccatagtagcctcatttcgtcggcacgtgtgcctgcacaaaacatcaccatgtggccgaaagaatccatcctccccacttaggaatttctgcaggctcctttcctcgtatgtaaattttaaaaagatattatgtgataataggtgcaaacaattttttaagttaagcctttcttcaccctgtgcctctgaatgattgatagacaatcagcctcaaaccctctgccctccttttccgtttatcctgtgtgggaccccagcatccaataaacatctaaccccgaggagagtcagtcccaagccacagcagttgcttctaagtgactcatgagaaacattgccttttaatcactcgccttttatatatatggattaaatgatcggttctcccgggtactaacccacgggtggtgtccggctttggcagagtaacattgaccgtaaggtcaaatgagcaggaaatccctcctgcccggtgtcgctgtgaagttgcactcacagcaaacacaggccactgggaggccacatctgcctccttgtgtcaccagcccccacccggggctatatatcagaatgacgtcttcgcgcagcgctgatttttgtccggggtttgggtttgatgtcattggcgcaacttctccccacaggtaacatcaccacccggatccgagcctcggagactggctctgatgaagccatcaagtccatcctagagcaagccaagagggagctccaagtgcagaaaactggtacagcttccatttcttcatccactgtcttcaaacttaattaagagaattgtcatgagtgctctggtcagcagtaattaactattttttttttaaacaataatgaatgcctgttctcaagcatttaggcacgtagagagaagcaggtctgtgtgatctgtatttgcctaatagttacctttttttttgagatgcagtctctctctgttgcctgtgctggagtgcagtggcacgatctcagctcactgcaacctctgcctcccgggtttaagcgattctcctgcctcagtctcccgagtagctgggactatagacatgtgccaccatgcccatgatatttgtgtttttagtagagacggggttttaccatgtcggccaggctggtctcgaactcctgacctccagtgatcctcccacctcggcctcccacggtgctgggattacaggtgtgagccaccgcgcctggcccctagttgtaattattcacagaaattacgctccttaactttgacagaaccacttgcatttcagaatatagcacaggaaaatgaataccaagtataaaaattatcagaggtcaggcgcggtggctcacacctgcaatcctggcattttgggaagctgatgggggaggatgacttgagttcaggagtttaagaccagcctatgcaacacagtgagagaccttgtctcttaaaacactagccaggcatggtggcatgcacctgtggtcccagctacttgggaggctgagctgggaggattgcttgagccagggaggtggagggtgggtacagtgagccgtgatcgtgccactgcgctccagcctggacaacagcgagatcctgtcgctaaaaaaaaaaaaaaaaaaaaaaaaaaaaattctcggggaaaggagccccaggagggcaggtcggggagcactttcactgacaccccctttattaccctctacatctgtgtgtataccaaaggccaccaggtcatcaagctgtagtgtcaggccctggtccttggttgagacaagatgcctgaatgtttcactgacaggggccatgctggggaaatacacagtgtggttctcccaaataacccacactttgcagtaggtcaagttaggatgagaagcatgtccccagctgaagggggccgccctgccacactctcacccctgtttctccatgcagcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtaagggatctgctctgggggctttggttctcccatctcttctccttgctgaggaccaagtatctatcccgcagcctgtgaccctcacccatttcaattcacccaagagcagagcgtaaggcatcctctgctcccagacttccaaggtgcggctggtgaacattgcagccccgatcccatttgccgagccccgactgcagccaggttctaggctcagcctttcacctgcatgctgccctttcgacccctcacttggcgctgggaagtggatggtaaaatccccaattgacagggaaggacaccaaggcttggggacgttaactacttgccccaagctgaccggcagccgagtccacatccagcttttgctgccaaggggagctgagaggcacccctgcaggcttccttggccaaaaaaaatcccatctgatcacacagagggaccaccagtacgcagagagccaaaagggacttactagaaaaagctgcagagagcattattgttcctttctgtgtaactcttggatattgttcagtcagagaggtcaagcaacctgcccggggacacacagcttggggatggcccaagcagggtggcccgtgtttccctatcatccttccctggctcaggaaagtgtaatcgtgcatggacgagcttctaggcctttctgttcttggcactttcctggtcactgagattcaggagaatgagggttaaccgtgcctgccaaatctaaaataaacatcatgtcctagtatcattttatttatttattttttgagatggcgtctcactctgtcgcccatgctagagtgcagtgacgctatctcggctcactgcaacctctgcctcctgggttcaagcgattctcctgcttcagcctcctgagtagctgggattacgagtgcccaccaccacacccagctaatttttctatttttagtcgagtcagggtttcaccatgttggccaggctggtctcctgacctcaagtgatctgcctgccttggcctcccaaccccctaccattttagattaaataacggagtgctgaatagaaggagaagcacccctctcccctaaaaggcaccttcctgagggagcacgtggctggatcagcaggggacaaatcccaccccctcccctgccaagccagggtccctgcatggcgccgtccccgcactccccaccccgccttccactcagtgtttgccgtatgctgtgctgtgaatcccggtggtgtccgatggcgaactttgccctgattttgcaaaaggtgaaggggggcgactagaaatgaggatgagtatttcaagtcccttgagatttctagttcagtgttgtaaaaataccatttgagaacattgaaatagacattcgtgctcatgccttaaatttagcagagacttaataacattgaacttgtttggcccgtgagtgcagttttattctggaacttgagaacttttcaaaagagtgatcggatgcagcccctaaatatcccagggcggcatctgtgtcctgtggggggtgtttgtgcctatacatatgtatggccatatgggagcgtcagaaaactcgggtgtgtacacgcaactcggcaatcatctgcggcggaatgtcactcccaggccggctccccaggtcccaccagctcacctctgggcccccacctttgatcaggatgtggtcagaacaagcagacctttctaaatgctggcctggctcagcgtttgcagaggacaccagcttcgccagtcccaccggcacccactgccccacctctggagggatcttgtccctggaaccttagcctttcccggtgccaccaagtgaagagcaaggtgcttgtacacacctcctccgcggggtgtcagggtgacagccctgccatcttggcaggatcaagaccctgggatgagaccctcttccctccctgggagctgagagctgtggctgtaaccatggctcacccgaaagtccccctgtgccggggtctcagccaccgttgatctttaaatgcatattccctgcccacaagctgtcaccgccaccaggccgtggttctgtgctcagaagtcagccctagacgcgccctctgcgtggtgggtgtgcattgcagcagcatctgtggtgtcatgctaatagccaggcactgatggcctgtgtgttcggtgccactccaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccaggtaatgggggtcctgccacaggagaggggctgcccccccatagcaaggacctggtcacagcagccccacctgggctatgcagagagggaggagggaactccgccccaggaggtggccaaccacactccccaccgtgggctggtgctgggggacagaaccgtccccttcctccacaacctgttgccgtgggactgacttcagtgtttaggagagatcatgcctgtctaattttataagcagcagaaaatgagttaccaatttaaaaaatgctgtttatacataaatacaggtaaaagtcaagtagctgaatcagggagtcaggaaagaaagtcagccaaaggtacaaaagtggaagatgtcacaggcgaaacctttcacctgctcccggcccgggggcctggccttgcaacagcagcgcctccccggcccgtgggtccccatgcccgcccctccccaggaggaatgggaagcctccccgggccttgccacattcagttaggaagctttaagccctgggccgcgttccttcctttaattataacctttttctactttagtcctccactccgtgacatcgctccaggacccgctgcagcagggctgtgtgagctcaggtaagcagccagtttctgttgcttttgcatgaaatgtctcactgccttttctgttgtcccgtgctgtggtctgtcccggcgagactccgagggaccgcacattctggatttggggagctgaaatatggcatcctatctgcaaacggggtccctctctgtgtcagtttctaatggagagcgagctgacagtgcatggagggactctgccaagatttgcacgcccactgtcatcctttgtcggcccagagccttgtgttcagggctggggtctaagtcggagacagattccccactcagggggcttaccgtctgataggaagggataaagcacgggcacacgtccctctcctggtggggtcatgtcgggggacttcttatctaaccggaagacatccaggcagcctctgagcaagaaaatggggagctttgagcttgagcagtgggaaaggtagggtagcagaaaggaaatggccaggaagcccctgaagacagctcaggtgtgaacgaatggagagctggggactgagatctgagcctgggagcaggtggtggcggagagtggtggctgcaggctgagaaactcgggctccttcctgtctgcatttcacagcctcgaggtctccaaccacacttgttctctttgccacatggtgcctggacacagcccaccgaggctgacccatggccacggctcccaggctctcgtctgcgcccccccgcctcccttctcgtgcgccaatcccacacttggagctgagcttttcacagccagcttttaggaacagccagcactgtgagctggtcctctttttccctttctgtatttttctaaacatgttgattcgtctccatatcccattgattcattgaaaacacaaacaaagctaacaggagcacgaagcccgccagcttgccgcaagctccacgagggggaacatgtgtagcacggggaacagctgtgtggcagtggctgctgcttctacaagagaccaaaccctcatacagatgcagccggggcacctcggtggcatccaagtccccagttgagagttctgcgtgttttccgtgttctgatttgactctgaccaacgtgggggtcgagaggctgcatctcacccgcgccgtgggtcttcttggctggacatctaggtggagcgggtgcccattggaagaagggatcactcattctggcttggccaatttaattagaaagtaccaagaactaatccagcactggctcgagttcagaatacttcaggggaaataatggacatagctgtttgtgctggagttttacggacgtctgcttggaaagttagccttgaccccctgctctaacgggaagttggccttcttgaaactcacgagagtatttgattccattgaggcaggactgaacttggcagaaagtgactaatgtattctagatcaaaaccccttgttagaccaggtgcggtggctcacgcctgtaatcccaacactttgggaggccgaggtgggtgcatcacctgaggtcaggagtttaagaccagcctggccaacgtggtgaaaccccgtctctactaaagatacaaaaaaattagctgagtgtggtggtaggagcctgtaatcccagctagtcaggaggctgaggcaggagaattgcttgaacccaggaggcggaggttgcagtgagctgagatcgtaccactgcactctagcctgggcaacagagcgagactccatctcaaaaacaaaaaaaaccctcgtcctacataaaacaggaagtctcccctggtgccaggcctgctaatgatcgatgccagaagcaacttctatgtgacggaacaaatccttgaagaatgacgttttactttgtattgtaacggatcatcgccactgtgctggaacgtttgtacaacagtcacatttcaaacctaggaaaaacacactaggctcctaagaggaatgtaaatgatatttgtaaaatatcaattgactttatagaataaagttagttaagactcctgggcaatctcgcagattggaagcaggagagagaaaaaggcgatgagcccctggatgaaacggaacagagtgtagaagttgccagtggtttttgtgaagaggcagcagatgggtgtgtctcccccacccgccttccatgtcattccagcaagaggggaggttgagcacaaatcacttacccaaaatcttgaagtcataggaaagccaccagcagaagcaaaaatcgtggtgactagggagaaaaatggaaaaagatttcttatttgcaggaaaaaatatttttttttttttgagacagagtctcgctgtgtcacccaggctggagtgcagtggcacaatctcagctcactgtaacctccacccccccaggttcaagtgattctcctgcctcagcctcctgagtagctgggaatacaggtacccatcaccacgcccggctaatttttgtagtttcggtagtgacagagtttcaacatgttggccaggccggtctcgaactcctgatctcaggtgatccccccaccttggcctcccaaagtgctgggattacaggtgtgagccactgcacctggccaggaaaattttaaaaaattgtatagcataatgatggccaagtgaaaatatttctctggaccaggaagactaggagggctttgccagaaagaaaagagattatcatatggttttcctcgtctgaatctttactatcagaggttacttttcaagggagtttcacacagaggctcacatctgtaatccaagcactttgggaagccaaggcagacagatcacctgaacttaggagttcgagaccagcctgggcaacatggtgaaaccccatctctacaaaaaatgcaaaaattagccaggtgtgatggcatgcacctgtagttccagctacttgggggactgaggcgggaggattgcttgagcccaggaggtcgaggctgcagtaagccaagatcacgccactgcactccaagctgggtgacagacggagaccctgtctcaaaaaaaaacaaaagagaaaagaaaaaaagctatgttcacagtatatggagtgtgtgtgtgtgtgtgtgtctgtgtgatggagtctcactctgtcgcctaggctggagtgcagtggcacaatctcagctcactgcaacctccgcctcctgggttcaggcgattctcctgcctcagcctcccaagtagctgaaactacaggcatgcgccagcacacccagctagttgtatttttagtagagacggggtttcgccctgttggccaggttggtcttgaactcccaacctcaggtgatccacccgccttagcttcctaaagtgctgggattataggcatgagccaccgtgccccacctagtatatggaatttaatttagaaaaatagagttgctaacagtggtttttagtaaatccttgggattagtgacatgagagactagaatcttccttgactgtgtctctgtggaagcttccagcagtgctgcccctgaagcaggagagcgagcctctgtcctaagattgctacaggattccgattccctgttcttcccatggctaccccagaatcctttcaagaggcccccagacccagaagatgctccctccattgcttgcctcaagtagctcgccgtggtagaaccaatgtctgcagaaaggtcattgcaagcccggcttggcttcttcctgaatgtcagtgagaaatgctcagtgcttgagattctgggcctcgaagatggactggcggttggttttccttcccaggtaggcagggactttggacaacttgctcagccagccacagccctgcagtaagggaatcgggcttacagcggagtccgtgggggcggatggctctgtgctctgtgctcggttaccatggtgatcaggtgccctgcgctagagtggcctcgcccatctgaacagcaagctgctggcccaggagtctattttcttttcctcactgagagctcccgtcagccttttcctgccgggctctgttgccttgtctgtccttccgttttccttaatgacttagacgccaatttgccaaaaaggagagagaaactgacatttcattcacatcatcactttttcctcttggtggatacaactggttctgaatgttcctctaagaatccgagcatgggggtgacgggcttgggcattaaggaaatttgatgccatttttaagcagcagcgtcactagtgacccaccactttttcttagacactgttgaggccttgaaaaggcgtaaggtgagcggtaggttccatgccagtcatgagtaactttttttttaagaaaaaggatttttaagagacaaatcttcagatcagttacctgttcatagatttcctggtacgtcttaactttctacaaatatttttttttgtttgcttcttgcaaaatgcccagcaccttgggatataaaggggggtgtagttataaccagggtcatctttgatctcatttggaaaacttcatttcaagatggagttgcaggtggtccttggggactgattctgcaagccccttttgtctgtcagtcattccaggcttcatccctcatttctggacctcacactacttaaccataccaaatgttcatagaggagaaggtagaggctcattaaggcttgtttgctcagagtgtggccttcttatcatttagcaatttattgtatcttattctatttattttatttattttttatagacagacggggactcactctgttgcccaggctggagtgcagtgacacaatcacagctcaatacagcctcaatctctcaggctcaaacaatcctctctcctcagcctcctgagtagctgggacttatagacactttccaccacactcagctaatttttttattttttgtagaagtgggtctctcttttttattcgtttttgtttttgttttttgagatggagtctcgttctgtcacctgggctggagtgcagtggcgcgatctcgactcactgcaacctacacctccggggttcaagtaattctccttcctcagcctcccaagtagctgggattacaggtgcctgccaccacacccaggtaatttttgtatttttaatagagatggggtttcaccatgttggccaggctagtctccaactcctgacctcgggtgatcctcccaccttggcctcccaaagtgctaggattacaggtgtaagtcaccacacccggccttttttattctttatttccaaatacccaagtaacctggtctctgttgccagggctggtctcaaactcctggcctcccaaagtgctgggattaccgatgtgagccaccatacccggccactttgtaactttttaatgtgggagcgtttcattgctgtggctaacaagctgttacgtctgcattcacactggcttcaggtgtattatggctatccaggtggaaggatggtcccctgcccttggctgaatcgtgaaatacccagctctttcctggcgtgttaggaatgatgggttccaagccttctctgctgcctgttgctgttcccagtcagccaacagagtatcagttgcctctttgagaagacagctgctatggtctgtctctaatgtgggtggtccaatgtgtgcccctctttgacgtgaagcccacggggccgtgggctgtccatgaccttgtacaaccaggagattccccttggctgcagcccctatcgcggacaggtccacgttccttttgaatgtgcatgcgtatcatggtcatggctcttagctggttcccaccagacagccaggaacacgtgtccagggctcgtgagctttgaactctgcagtaagattctaaagcagtgtccttgataagcagtcagtcggctctcccacattcatggctaacagtcagtgtcgggggcatgtggatagcatgttcatagggacaggagaggctgattgcacccctgggcattccacagcactgtctaaagcaggcaggggccaggcgcggtggctcacacctgtaatcccagccctttgggaggccgaggtgggtggatcacttgaggtcagaagtttgagaccagcctggccaacatggtgaaactcggtctctactaaaaatataaaaataagtcaggcatggtggcttgcacctgtgatccctgctactcaggaggctgaggcaagagtatcacttgaacccaggaggtggaggctgcagtgagcaatgatagcatcactgcactgcagcctgggtgacaaagcgagaccctctccgcccgcaaaaaaagaatacctcttcaattggagacattaaagaatcagcttttcggctgggcgcagtggctcacacctgtaatcccagcactttgagaggccgaggcaggtgcatcacctgacgtcaggagttcgagaccagcctggccaacatggggaaaccccgtctctagtaaaaatacaaaaattagccaggcgtggtggtgcacacctgtaatccagctccttgggaggctgaggcaggagaattgcttgaacccgagagacccaggttgcagtgggccgagattgcactattgcactccagcagggtgacaagagtgaaactccatctaaaaaaaaaaaaaaaaaaaaaaaaactcaacctgatctcggctgagctaagatgcaaagggactggctgtgccactgtgaacccttccagaggcaggtgaggcaggccgcgcgggagcagcacgggaagtcccggctgatgagatgaggctggggggccgccccaagagccacaggaggaagggcacatgcgcttctcaaaagttccttgatgtgtgatgtatagggatcactcagggaccttgccggaaagcccctttgtcactgtgcgtgacctgcttgttcagttccccaagcgcctccagatgcttgtgggattcaagatgggggctggccacatgttgctggaaccagcaccctgtgacatttatgcaggagaacatgggtatttgaagggtcttttgttcctaggacagccctgcctgggggaccctgcacacacagatcctgcacagatgtcaggggcagccagtgctgagtaccacagcccactttaggttttgtttcaaagcaacaaacgtcgctgtcatcaagtgagcaaggcagcctacgcaggctgccagcaccgccccagcaccctgcagtcccaccttccagcaccactcgtcacacacccttggggaaggctgctttgccagaactcggccccccaaagtctctgttcctagagcagaatttgtccctgtgcctcacccaaagagagggaagtcatagcccagagtcaccgatttatttgacttttttgtttttattatgatttgcaggattttttccaagaagtaaaatgcaccatagttacaaaatgcaagcattcaaacttacagtctttttaagaaatcggtcaccatccctccctcatcttcctgtcacacaccacccccacccccacaccccaccccaccaccatccccagtttgtcatgtgtccttcaggacagtcatgcacctaaatatttattccacgcagatggggggcgtgcaggcctcaaaaaggccgtgtgccttgcttttctcacttagtaacacaccgtggagaccttcctccatcagcacatggagaattttccctttttgtgtgtacatgtgtgagagggagtctcgctctgtcacccaggctggagtgcagtggcacaatctcggctcactgcagcctccgccttccgagttcaagcagttctcctgcctcagcctccaagtagctgggatcacaggtgtgcaccaccacacctgactaattttttgtatttagtagagacggggtttcaccatgttgctcaggctggcctcgaactcctgacctctggtgatccacccatcttggcctcccaaagtgctggggttacaggtgtgcaccaccacacccagccagatgtctgcttttaaaacagaatctagtcgcatcttcccacctcctttggtggagattgtcccttgcagatggtgcagggtactcctggtgccgcagtcctgtgagaggtgatctatatgtgcctttccaaagtctcgacttctacaaaatgctattccatccttggaagttgcctgttcattgaccaattccttaaagtggacacaaaaccttgagcttccagagtaagactatagggcctaggtcattgcttaggccatttggggccaagctagtatggaaccaggccaactaggctagacacagccggcgaggctgagggctcacataactctcgttcttcccgtcgctttccctggaccctccatcctggtgctccctggtttccccttctgaaaaggcccgacaggcccagtccagcttgtagacacatcccgttctctccccttcaggctttccatagaaaacagaatttacagcacattgggcattcagtacaagaggcaaaagtaggtcataggagcaaatgaggacttcagttttcagtggttgaattctagggaaggaatgaagaagcttaaatgcctagaaaccctcaggtgattgcagaaaggggggtgggaataaaacaagggagtccacatgctggtgtggtctctgtgccactcacagagctgatgtccgtaatccttaatcagtaagtgaggccgggctcagtggctcacacctgtaatcccagcactttgggaggccaaggcgggtggatcacctgaggtcaggagttcaagaccggcctggccaacatggcaaaaccctgtttctactaaaaatacaaaaaaattagctgggtgtggtggcggatgcctgtattcccagctactcgggaggctgaggcaggagaattaactcgaacccagaggtggttgcactgaggcgagatcacgccactgcactccagcctgggcaacaagagcaaaacttcatctcaaaaataataataataataataagtggaaatggttcccttctcttacggatggagtaaaccaaggctcagagataaaaggtgatttgccccaatcaagaagaaggtggtggccaggcgtggtggctgacgcctgtaatcccaacactttgggaggctaagactcaaggatcgcttgagtccaggaatttgagaccagcctgagcaacatagcaagaccccatctctacagaaaatttaaaatttagccgagcatggtggtgtgcgcctgtagtcccagctactcaggaggctgaggcaggaggattgcctgagcccaggagttgaatcagcaaatcagtgacagcatggaagccacatttactaggtttggctgttggaaaatgtgtaatccacctggcctaggctgcatggagtgtccatgctcctttgaaacctcttctggtctaaattcagtgaacgtatacacactggcttgaggtcctctgcctgctacagggcagccctgcctttcagctgtcacggccccccggagccatgccgacacccaggccccagccccatgcggactggcccgagggacctgccccgctcccggtgaggataaggaggggagtttcttaatggcattgccctggatagattgggagccaggcaggaggcttccatcggggcctcctctagattttgcgtttacttcttccctttggaaccggattcctaaatatagcccgagtctgaattggcagatgttgggtctgtcctttccttgacggccaaaattagtctgtcatttggcacctaaataaagcagccaaactacctttataccagctttgcaattaggcggtagttggaacattctatttgataaggaaacttttatggatgccttagcagcacctctgaacccaggaggctgaggagagaggacacccgggccccagagggacactccttcctcgccatcaggccttctcattccagagttaaggtcaattttgttccatgtggcttaaaaacacctcgtgaatgtggaaaagacagtcaatgctccccagaaatagcattctaagagcatggcaatggttactccaactttttttttttttttttttttttttttttgcaagcaaagaaaaatctgtccagagtgcctggagctgggttagtgcagggactccccaggggcagcagaaagatgttataatcaattatcacatcataacactgatgtatgataattactgagtgtttctcctgagatagtgcagcatttggctgggatgccgctctttcacggtccactgcctgattaatatgcaaataataggctgattgcatgatgaatgcagaaatgagttcgctgataacgtgagcaccgaagcgggaagatgataaattacttttactgactgtcctacattaagtaccctttctcaacaatttcatcacaaattaagtaaagcagtatggagagattaggaggacgtgtaaaataatgtaccttaatggtttttctaataccatcgtggaagacgaaaatctcaacttggttctgcccgggtctttgtagggccaagtgagttcactcacctgggcattgagtggaagacaggaggcaccccaccacaccggcgtgttccacgggccatgatcagccatggattctctgaggaatatcccattgcagcccagacattacccgcacactgggccaacaggcagcatcatggagggaggaggacaggctgctctcggggcagacgcagcatcctccacacagatgggcacccccaagcctgctgtccaccatgtgcctgcaggaaaggagcatttctgggctgcaggcctggaagactcggaaagaaaacaacatttaagacctcctgcctgggcacagtggctcacgcctataatcccagcactttgggaggccgcagcgggaggatcacttgaggccgggagtttgagaccagcctggacaacatggggaaaccccatctctacaaaaaatacaaaaattagccaggcgtagtggtgtgcatctataatctatagtctatagtcccagctactttggaggctgaggcggaaggatcattggaccctaggaggtggaggttgcagtgagctgagatcacgccactgcactccagcctgggcagcagagcaacaccccatctcaaaatttaacaaacaaaaaaagacctccttgacctctttttagctcttccaagtctcagaaatctggaaaaattaatttcactattagaatggcagtgggcacaccggccagagagcatgacttggtaagggatgggtaggtttgtccaaagccagaattgaacccttgagaaaaagagggcgtgcgtgtgtgcgcgcacacacacactctcccccccacacacacacacccacacacgcacacacactcccacacacacactctcccacacacacactcccacacacacacacacactccccacacacacacccccacacacgcacacacacacactctcccacacacactcacacacacacactcccccacacacactcccacacgcactctccacacacacatgcacacagagtcccacacacacttctgcacacacacactcttccacacacactctcccacacacacactctcccacacacacccccacacacactctcccaccacacacacacacacattctctctccctcacacacacattctctcacacacacattatctcacacacacacacacacacacatttgcagtgattaatctttgattacagcaaagcaatttaactagaggctttgttttttcccgtcttagtaatatatatttagactgtttgtatgacatacattttgtcttaatgcacagggacgcattgataagtgttcgtacacacagctggcttggtaataaggttattgaaggtaatttgaaagcatcatttctaaatcagtatggatctgcagaaaagccggaacaaggcgagcctgtgcccctgaagcagggccatctgtgtcacccagtgtcccttcagcaatctggccagactgagttcactaccaaaatcgaattgtaatttaagcagggtttttaatttttaatatcttcaagctctgcttttgatatgcttatttccttaagagcttataaaagatacacaagccaactgagcccagagggaaagtgactttccactccgaatccccggcaggtcccctccccgcccgcgggtgagctctggttctgcgcaggttcccgccaaccacagggcctcatcacctctgcagcttcctcctcgtgcatttcaggccaacacagaatttctaagatcatttctccccaccgtaccttcccatgtcggggagatgaaagaggagagtcgaaaaccatccccagagggagggaggctccagatggatgccatggtgtctagagggagggaggctctggatggatgcgatggtgtctagagggagggaggctctggatggaagcaatggtgtctagagggagggaggctctggatggacacgatggtgtctagagggagggaggatctggatggacgtgatggtgtctagagggagggaggctctggatggatgtgatggtgtctagagggagggaggctctggatggacacgatggtgtctagagggagggaggatctggatggacgtgatggtgtctagagggagggaggctctggatggatgcgatggtgtctagagggagggaggatctggatggacacgatggtgtctagagagagggaggctccggatggatgcgatggtgtctagagggagaaaggctctggatggacacgatggtgtctcctctagttagaggagctcatggttgacttctcagagcaacttctcactcgcttggcagcagggacctgtcacacccctgtgctgtggccaggaccatgttgcctgcactgctgcacctccagaccctgccctgacactgctctccccagaaacaccctcgtcccagactctttgtttgagtgacctgcttagtgacttcggcctcccgctttggttacaagatgtgggggcgcagggtctgccttgctcacggctgtacccccacacctggcacatggagggtttccccattgtggaaagctcaggtcccatcttcaagtaacttagaagtcaggtttggggaggtaaaatacaaatcacacaagttaaacaaccttgctctaattgaaacaggttttctttggggccagatatggtggctcatgcctgtaatcccagcactttgggaggccgaggcaggagaatcacttgagcccaggagttcaagaccagcctgggcaacatagtgagaccctatctcgacaaataataattatagtaaattagctggaatggtggtatgtgcttgtagtcccagctgctcaggaggctggggcagagggattgcttgagcccaggaggtcgatgctgcagtgagccgtgattacgccactgcactccagcctgggcaacagggtgagaccatgtctcaagaaaaaaatcaagagagaaagaattttggctcccatgtcattataagagtttctcgggcaaacctaaaaacatatattgttggccaggcacggtggctcaggcccataattctagcactttgggagtctgaggcgggaagatcactagagtccaggagttcaagaccagcttgggcaacatagtgaggccccccatctccacaaaaaattaaaaataaccaggcatggtggtgcacgcctgtcgttccagctactcaggaggcaggggtgggaagatcacttgagcccaggaggcagaggctgcagtgagccaagattgcaccattacactccaacctggacaacagatcaagaccctgcctcaaaacacacacacacacacacacacacacacacacacacacactatggctatatagttgtcacacagacacaccccagcacctactaggtaccagagactttgagttcatcttatcctattctttctttagtccctgcagagggtgtgtgtgtgtgtgagagagagagagaaagaaaatcattgctgttccattttatagaagaaactggcacccattggtgggggtgggggggacattgatctttcctggagtggggcagagctaccacccatcccctctagttcctctgaggcatcttccctcccactccaacccttctccacctcctcccccacaccccctacagaatctttctcaggttctttctgctgttgaaaaacagtgatttgataggtttggggctggcaagggatgtgcccaaagcttgatgctgccacttgtaagggcacagaccttcccagggggcagaaggccaacccaggaccctcgggaattggaccttcgcgtcggccccccgctggcgtcaggcatagctgctcaccttcttggaaagaaagccattttgtagtttggccacgctgggtacgtctctgatattccttaggatgttgttgggctacttttgtttctttcatggtaaggaaacgtccagtggcccaggaaggaggtgcagaaagctcatgagtgtctctgtgacatctgctaaagtcgctgcatattttgtttcaagctcttgctaatcagtcaagatgccagtcttactcaaaagaagaatactgtaggtttttatatgggcgatgtctaatggagatggaggactgttccgatggagattcagcagggctgtgagcttctgctgctggattcagaagcaaggcttgggaactgaggagcccagcgtcgctgccatggttgaggaaagccttggtgttcagaaatttcggagctggtcatgcaagggtgtctcatgtttgtgatatgagcctgtatgaccaaaatacaggaggccagggccgggcacagggccgggcacagtgggatcacacctgtaatcccagcactttgggaggctgaggcaggcagatcacttgaggtcaggagttcgagaccagcctggccaacatggcgaaatcccatctctactaaaaatacaaaaattagctgggcctggtggcacacacctgtaatcccagctactcaggaggctgaggcaggagaactgcttgaaaccgggaggcggaggttgcagttagccgagattgcaccactacactccagcctgggcagcagagtgagactccatctgaaaacaaaaaacaaacaggaggccaaatgagcattgctgttcccctttgatgctgagaaactcactccaggcgtaaaccaccagggggtgtggtctgtttagagcacagggtcagttccggagcaggtctggtgcccacatcacgatctgtccctctaaacctagctaggaagtatccaggctggtggccaccctgttgtgtcttctgaagctgtcagcaccggtcgctggaaaggcccgcaggctgggaagagtctttctgagcctctagggctcctgccagccccggcatgcccacaccgggcacctcagagcctgccgtgcatccttgtatcttgcaccagtccccgccacctccaggcccatccctccctcgggctctcctttcctctcctccagggctcccttgatgttttttatttgtgtttttttattttgtattttattttatttacttatttatttttttgagatggagtagctgggactacagacatatgccaccacacctggctaatttttgtatttttagtagagacagggttttgccgtgttagcagggctggcctcaaactcctgacctcaagcgatctgcccacctcggcctcccaaatgttgggattacaggcgtgagccaccgtgcccggctcccctgctcattcacacttaatgtgccaggccacgaccacctcccctctcccctctcccctaacctcctccctccttccacccgcccttccatacgtgtctgtctgtatagtcattggaatttcctggcttggcatgggctcaaagccgaaaccatggacagaatgaaaagtggcgcatcagaccagccgccagttaaataatgtttgggttcttgtcagaatgtcacggagtaccctgtcattttgtttcagcaacttgtccttctgaatgcacagttcgccttatggcatgccagcagtaaaaatgtcacttacaataattactttttggtgaaaatgcttgctgacttcccaccttcaagctgttttttacacagtggggagataataagaaacgactttatcctgactgctcaaatgaacactaaatggaatttgggttcttattactgcagatagagggccgggtatggaaatttcaacagtagatcggaagaactgcagagagatgtatctccgagaattacggcgggtgcgggttttcaattggctcccattgaaaacttaaggcagctgttgtttgcctgctgtttttggaatataatatttttcataatccttttatagttcgtgaatgccttgtgtatctcagagggccttgagtcactatctctgctttctgtagcttgctcaccaagctcctcttatgccagattcagtgccttgtaaaaaaaaaaaaaaaaaaaaaaaattaattcacatagatgactttttaaatgtaacaccttactattgctgtcaaaactggatggatggtactgtgcagtggggcttttaaaatatgcaaattacccattttcaattgtcctggtcctgcaggctgcagggtccttggaagcgaggtttttgtctgatttctcccttatccccaagacacagagtaggtgctttaaaaatatgtgagtaggctggatgcggtgactcatgcctgtaatcccagcactttgggaggcagaggtgggtggttcgctggagcccaggagttcgagaccagtctgggcaacatagcaagaccccatctctctacaaaatatacaaaaattagccaggcgtggtggcacacacctgtggtcccagctactttgggtcatacattggcaaggaggctaaagtgggagggtctctgaagcccaggaggtcgagactgcagtgaaccatgatcacaccactgcattccagctggagcaacagagcaagacctcgtctcaaaaaaaattaaaatgagagtgaaatgacgcaggaatgacggtaggctgcaattcagaatcacgtggtgttggcagatagcaggatgggtaggaaggtcgaggttttcccctcctgatccttgcaccatctgtgtgactttaaccaagtcacgttgcctgtctgagcctctgttttctcacctgggatgtagggtgtaaatttccaccccagggaccattgggagaattgaatgaagccacatgcagacgccctcagctcgctgctccattcacgcctggtatgaaatgtgttttggttcccttccacaatcctatgagtggatcagctttttgtgactcatcgttaagtcttcgagattcacgcatgtcgatatgtgggttgtagaaaaactgtgcctgggaaggcaggcacagtcactctgtcactaacgcacacttgggcgcagggtgcaggcgccaccagctgtacaggggctgtttagaatatggcccatccacctagctcctggctgtgtgtctcggggcaccgtatcttttttttttttttttttttttttttgagacagagtctcactctgttgcccaggctggaatgcaatgacacgatgtcagctcactgcaaccgccacctcccaggttcaagcaattcccctgtctcagcttcccgagtagctgggcacgcgcctggctaatttttgtatttttagtagagatggggtttcaccatgttggccaggctggtctcgaactcctgacttaaggtgatctgcccacctcagcctcccaaagtgctgggattacaggcatgagccactgcgcctggccagggcaccatattttacctgtgtaaaatgtgggaagtggccgggcacagtggctcacacctgtaattcagcacttttggaggccagggtgagaagatcactcgaggccaagagtttaaggaccaacctgggtaacatagcaaaaccctgtctctattttttaaagtttaaaaaaagtttaatgttttaaaaaagataaatgcatcatacaggatgtggccttttgagtctgtcgccagcgtccctgtcatgtgtcaggcattgtgggagaaatagcactcagtcataagatttatgttgactgtaggtctttatagaaacaaatacatttgaccaggtgcagtggctcaccctgtcagggtggcgagggtgaggggaccctctgtgcagcggggagagttggcttcctgtaggattcactgtctgtcctaacagaacaaaaatatggtcaatagaaaagaaacattacttctcctttcaaacattagcagatggagccctgtgattaaaacgatactttctgaaacaacaaggctttgctctgttccatgcaattaaaaataataataaaaaaagaaaaaaagggtcaggcgcggtggctcacacctgtaatcccagcactttgggaggccaaggtgggcgggtcatctaaggtcaggagttggagaccagcctggccaacattgtgaaaccccatctctactaaaaatacaaaaattacctgggcttggtggcacgaacctgtaatcccagctactcgggaggcagaggcaggagaatcgtttgaacccgggaggcggaagttgcagtgagatcgtgccactgcactccagcctgggcaacagagggagactctgtctcaaaaaagagaaaaagaaaagaatgactttctccccaacatgatgttctgagctcgtggattcacggtgtctccaacgcgtctgtttgctgtggcatctctccatgcctgtgcaaaaaacatgtactcaatcctgtttctttgacctgagaccatagccacaactgtgcatgcagatgtctgttggcgagtaaactatctcccaggaagagcatgcagcttccagctgtcttctacattttatttatttatttatttatttagagacagagtctcactctgtccccaaggctggagtgccatggcacgatctcagctcactgcaacctccgcctcccccattcaagccattctcctgcctctgcctccccagtagctgggattacaggcacccgccaccatgcctggctggtttttgtatttttagtagggagggggtttcaccacgttggccaggctggtctcaaactcctgtcttccaagtgatctgcccgcctcagcctcccaaaggtcttctgcattttagactcagattgagagtggagagacagatacaagccacctccagcaaccagccgccacatgtcactttcacatgcctggacctctcagggctcggacagggctttgatctcagggggcctgcctttgtctgtagtcacagcctggagcacagagggacacctgtaacagtagtgagcgcccctgtttagttctcctgggggttcatgatggcacaaatccacgccactggcttgcaaggcgcactggaagaaagaactgtacagcctctgagtttcgtggtggctctgcctccgccagcacccagaacaaaacagggagatgccacagcagccggcaccacactcggtttattagccagacagccatgatgttgaccttgctgtgggttaaaggacacaaaacctgaagagaaatctgtttatcatttgggaaattcatgccatccttgacagtatctggtgagcaagatggatgatctgccaggccggcccctcgcatgggtgaatcacgccatccttacggtacggttcctctgccggcttcagacacaaaaataacatttgtggggttttatatccagttctctggtgacccggggggtgagcagagagaagaaatctgatttgtaagattcacattgccctaaagatttatacggaccatttctgcctcttacgcttgtctcttctacatctttcaaaaaccggtttggcatgtgtttttctctttgtaacctgatttcccaggtcaaggacacagccttatgcgatggcggaagtttgtgccggttcaggacgataaacgggttgatcgcttaagttgcaaatgttttatttgaggttttgctctttctaggtatgaatacaaaatattccttgtagttggaatgtatttatggcaggttagtgtatcctggatacagtatgtccagaaaaggactcttaagataaatggtaaattgaagttaagttgctgctctatgctacattttcttttcagccaggtaacaagtattttgggctatctactatggtgctgatgttgactgagtgacctgctagggcccaagggagaagcagcaagagtaagacccttggccaggcacagtggctcctgcctgtaaacccagcactttgggaggccaagaagggaggatcacttgaggccaggagttcagcctaggcaacatagcaagacctcatctctacaaaataaaaaattagacaggtgtagtggtgcaagtctgcagtcccagctacttgcaaggctgaggtgggaggattgcttgagcacaggattttgaatcagccagggcaacctagcaagaccccatctccacaaaaaaaaattttacaagaccctgggagcagagagcatggcctgggccctcttacctggcactgtggggtcttactctgtgtcaccctcagtgggcatcaggggagagattgtgccaagacactgagctgggccaggggcagattctgccttgcaggcaggacctcagcccgaagccacatcttcctccaggacagtttctatctgcagaaattaggaaatggtctaagtctttatcccagacatcccagaactggaatccagcctcttttatcaggttttatgggctgttatcagaggccagagggatcactcaccaacagagcccagctggcatttcccactgggcacccacggcgaccccaacaaggcagaggagagtgtagactctggcttgtccacaccagcccagtcacttctgctgttggttacagcatggcttataccagcaaagagctcggttttcagaagcaggcagaaccagcaagtcccaaggttggaggtagaactctaaaatggaagagctggggaaacagggtgctcctcctctccttgcctctctccatcttcccctagagttgggtgctgtggagttctctgctcttcacaacaaaaaaacagctgggcatggtggtgtgcacctgtggtccaggaggagccgtgattgcaccactgcactccagcctgggccaccgagcaagaccccatctctaaaaacataaaagtaaaaataaaccaacctaggtcctgagacccagtgctggaggaccagaagctatagccttatgtttccgcagttgttgttttttttcttttttgagatggagtctcactctcactctgtcacccaggctggagtgcagtggcacaatcttggctcactgcaacctccacctcctgggtgcaagtgattctcctgcctcagcctcctgagtagctgggattacaggcgtgagccaccatgcctggctgatttttgtatttttagtagagatggagtttcaccacgttggccaggctggtctcgaactcctgaccttagatgatccactcgcccagccacatttcctcctaagggtcttcctaactgtggtgactacgtattgtgggcagccctcatttaaaacaatctgtctatgctttttgttctggaaaatatggacaacataactacacaagttatgatctagccaaagtgcttctgaattaccaaattatggggtttcattagaagaaatgacagcgataacatgattaataggagtttttttagcagaatgccctcatgttaagccttccgaagcctttcttttaaacccctagtttttctcgcaatgatgttatttttgttttttaatatggaagactagaggttactctcagtcaaaaaaatatgaaacagttcactaagacccacagaaaaccctaccgtctgcttctcctacagagcgtttaattagtatttcctagataaggaacgtagatggtcgtggtaaaagacagctattttcaggcacggtttctcgtgtgctttaattacagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggtaggttctcctctcggctgctgagtcaggaggtggcagggagtttgcaggaggagcaggtgaagggcgggccctaggccaagccaaccacagagtctcaacttgtgtaggcaccctttgagaacatgaaacatcctatagttgtgaacagtaaggagcgtgccgtctgcaggtcagtccccacctcctccccaccctgcacccccacggggaccagttagaagatgagcatggagtcagagtggactcgggaggatccacacagactgtctcttttttttctttttttttttttttttttgagacagtcttgctctgtcacccaggctggagtgcagtggcacaatctcagctcactgcaacctctgcctccccggttcaagtgactgtcgtgccccagcctcctgagtagctgggattacaggtacctgccaccactcctggctaatttttgtattttcagtagaggtggggtttcaccatgttggccaggctggtctcgaactcttggcctcaagcaatctgcccacctcagcctccaaaattcttgggatcacaggatcccaagccaggcatgagccatcgtgcctggcttagatgtatctcaatagagacagtctgagtaagtccagatttcttgaggccacagtctgagaccagcctgggccacatagcaagaccccatctctacaaagaattttaaaattagctggacatgttgatgtgcacctgtagtcccagctactcaggagcctaaggtgggaggatcacttgagcccaagagttcgagaccagcctaggcaacatagcaagaccccttctctataacagatttaaaaattaggccgggcatagtggctcatgcctgtaatcccagcacattgggaggccacagcaggaggatcgcttgagtccagccaggagttcgagaccaacctgggcagcatggcaaaaccctatctctacaaaaaatgtaaaaattagccgggtatggtggtgcacgcctgtagttcagctactcgggaggctgaagcaggagaatcgtttgaaccctgtagttttaggctgcagtgagctatgaccatgccactgtacttcagcctggacaacacagtgagattctgtctcaaaaaaagaaagaggtagacacccattagagcctggcatcctcggggctccagagctgggcagcgtccacccggcagtgccaggatggcttagtggaaggtctaacggaccccggttctcactctgctcactgagtccgtgatgctggccaggctgcctgcattctcagatccccctccacgaaactggagtaaccacgcctgcctgggagcagtgagtagcagcattttctagcaccaggcccgactggtaataatagtcattgttattttatcattgctgttcccgctgccttgcgaagccatctccatttcacagcccacagctggggcgggcagcccctggggaactcactccgtcaccctggcatcccaccgtgcctcagacctggcctcggcctggcacatgctctagccccctgggtgctcggcctgggttggttgtctgtgctctgtgtcactggtcatcagctgctgtggctgtaagaatgttacggtgtttcatcttttttttttttttttttgagatggagcctcactctgtcgcccaggctggagtgcagtggcgcaacctcagcttactacagcctctcggctcactgaatgccgggttcacgcgattctcctgcctcagtctcccgagtagctgggattacaggcatccgccaccgtgcccagctaatttttgtatttttagtagagacagggtttcaccacgttggccaggatggtctcgaactcctgacctcaagtgatccacccacctcggcctcccaaaacacagggattacaggcatgagccaccgtgtctggccttttttttttttttttttttttttgagacagagtctcaccgtctcactcaggctggagtgcagtggcacaatcgcggctcactataatcactgcctcctgggttcaggcgattctcctgcctcagcctcccaagtagctgggattacaggtgcccaccaccacgcctggctaatttttgtattttcagtagagacagagtttcaccatgctgccaaggctggtctcgaattggcctctggcctcaggtgatccacccaccttggcctccaaaaatgctgggattacaggcatgagccaccacaccagccaagcctattttgtcattttaaaccaccgtgctcctccagtgtggtgttaaccaggcagggttccctggtttaggcacgcggagattggaaacccaccctttctatctttatttcccaagggtgaaagtcagttaaaggggcagtgttctctgcagagcatgtaagcacaaccctaccgagtggttgcagtttgtctgctgctcatggaaaggccttgtgtgtcttttctttctcccatgggatgagaagagaagggaggccgagcatggtggctcacttgagaatgacaggtggcctgtaaccctagcactttgggaggctgaggcaggtggatcacctgaggccaggagttcgagaccagcctgggcaacacagtgagaccccgtctctacaaaaaaaaaattttttaaaaattattatccaggcatggtggcacccgctgtaatccctgctgcttgggaggctgaggtgggaggatcacttgagtccaggaggttgaggcagcagtgagccacggtggcatcactgcactccagcctgggcaacagagcaagacactatctcaaaaaaaaaaaattaaaaaaaaaaaaaagaacagagtagctgagttccactaaagtttgctcagtgatctaacagcctggaggttaggccagcttgtccagtggaagcctcccatccccatgtctgtatgcaacagacaaaacagaatgagagaaaaagtcatatcaatgagaccttatataattaagtcaattcataaaaataaaaatgtagctgttgatttgaaaaaatggctaattcccatatgttcatcagttattgaatcatgcagggattcctagacttgagtcatctcccacttcatagctcgtcacacatccaaggaagcagaccagttgcatcactcctgcccacctccttataggaagtggcatttcgtgtaaatgttgaaaatcagatagggtctagctctgttgcccaggccggagtgcagtggcacgatcatagcttactgcagccttgaactcctgggctcaagcaatcctcccacctcagcctactgagtagctgggactacaggcacacaccccaagcccggctattttttttttttttttttttttgagatggagtctcgctctgttgcccagggtggagtgcagtggcgcgatctcggcttactgcaatctccgcctcccaggttcacgccattctcctgcctcagcctcccaagtagctgggactacaggcgcccaccaccatgcccggctaatttttttgtatttttagtagagacggggtttcactgtgttagccaggatggtctcaatctcctgacctcgtgatctgcccgcctcaacctcccaaagtgctgggattacaggcgtgagccactgcgcccagcctttttttttttttaaatagagatggggtttcaccatattgcccaggctggtctcaaaactcctaggctgaagttatcatccatgccaccatcattgctggagttttccttgatgttggttttactgggtgaaggtttgtagctttcttcaggctctcaaatgggtctgtagccccaaaacaattaaaagtcatggctaggaaacatctaggagtcatacagataattttccaggaataatcatctgatttttttttccccattcagctgggaggcctaagcaaagagcaactagctattcatatatattgctttcccgaacatagcaagctccttgaaatgaaaatagattcttttaccatgttagcattaagtaaaattttctctttttttttttttttttgagatggagtctcgctctgtcacccaggctggagtgcagtggcacgatctcggctcactgcaagctccgcctcccgggttcacgccattctcctgcctcagcctcctgagtagctgggactacaggggcccaccaccacgcccagctaattttttgtatttttagtagagacggggttttactgtgtgagccaggatggtctcgatctcctgacctcatgatctgcccaccttggccttgcaaagtgctgggattacaggcgtgagccaccgcacctggccaaaattttcttataacaactaaaaaaaaaaaaatcataaggacttgggacatttataggctaaagagtttgaaaagcagagaaacacaggtttacaaaatcagtaaatttatctttaagttttttgttttgttttgttttgttttttctttttctttttctttttatcttaagtttaaaatgactaagccaggcgtggtggtgcacacctgtaatcccagctactcgggatgctgaggtagaacaattgcttgagcccaggagctcgagtccagcctgggcaatatagcgagaccctgtttctttagggaaaaaaattaaaaagactgataagaaattaatgtctcagcttcagtgctttctaggcagtaaacttttacttggaggcccccttcttagaagccagtgtgtggtgtttctatttcacatagaggatgtaagccacagagagaacaagccagccctctgtcgtctccctgccccggatggggagaggtgccttctgttctgtacactttatggggtcaaacgctggcccctctgatcccagtctccacttccacctaataagtcctgttcattcaagtactcccgtcaggccttccaggttatcactgatcctaatttgtatctttacaagcggtggccctctaaaccagcagcggaatggccctcagagaagtgagcctttctttctaagctcctgacaagcattgccaactcaatgcggctgtgctctccatagcgaaatgccctctgatcagcctgtgaagcgggctgcctgcccctgcctgggagaagaaaaggtatcaggaaaggggttttgatccacttccagttactttatttagcaaaggcagcctagactgcaaaagcagactttggaattggaatcggccggcctctcagaaaagcagagctgggcagctccctctcctctgtcctgctgtgattgtgggttgcctgccccgttttctcagcgagacctgataaccttgctaattgtggaaggagacgcaggttgccctctgatttgaggttgtacaagagaggtctcctgtttgctgtttggcctcctgagctctggcttagagatttcactgcctctgagaaacaccacaggtgttagcgtgacctcagcacatacaaagcctgaaggcttttttttttcctttttttttttttttttgagacaacggtctctctctctgttgcccaggctggagtgcagtggtgcaatcatagctcactgcagtctcaacctcctgggctcaggcaatcctcccatctcagcctcctaagtagctggaactataggtacatgccaccacgcctagctaattttttgtgtgtgtatttttgtagagactgagtctcactgtgttgcccaggctggtctcaaacccctgggctcaaatgatcttcccgcttcagcctcccaaagggcccttccggccaccgcaccaggctgaaggcttaagagaaacgtcactggccagatgcggtgactcatgcctataatcccagcactttgggaggctgatgggggtggatcacctgaggtcaggagttcaagaccagcctggccaacatggcgaaaacccgtctctactaaaaatacaaaaattagccaggcgtggtggcgagcacctgtagtcccaggtactctggaggctgagacaggagaattgcttgaacctgggaggcggaggttgcagtgagccaagattacactactgcgctccagcctgggtgacagagcaagactccatctcaaaaaaataataataataaagagaaatgtcattggttgtgtgtacggagaatgcaagagcaatgccaactccctggccaatggagagtattataagtctggttgaagatatatttctaccacatgtttgctgtaagctaggatgtcaccagcccaaccctgagcctttaaactcctgtgtctgattttaaccttgacacgtacttgtcccttcagatccctggctctcggtgacaatacctgtcttgcttctgttttctctctaggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaaggtaagtctccctgccccgcccgggccggctgcgtccgcattcatagacaggctgtttctttcaaatctttcacacacagctgatgagggacattgacccatgaccaagggaccagaggacagggcaaaaatatttttggatggtcatcagctaatgagtacctaagagggctggaaagttgtgtaactttttctctccagcagcctgaatctaaagatttttttagcactgggagcacttttaaccaaggagagcgaaacagctctgggggcgctgcatttggtttttgtgttgtgtgggtggctgatcgggctatcacagcatttactgagcatgtaccaggtggctagaggccttcctttgttatcagagagagaaataagaaatgcattttgtaggcagggcacggcggctcacgcctgtaatctcagcactttgggaggctgaggcaggcggatcacttgaggtcaggagttcaagaccagcctggccaacatggcaaaaccccctcactactaaaaaaaaaaaaaaaaaaaaaatatagccaagcttggtggcgtgcgcctctataatcccaactacttgggaggctgaggcacaagaatcgcttgaaccctgcaggcggtgaacagagattgagccaccgcactccagcctgggtgacagaccatgaccctatctcaaaaaaaaaaaatgcattttgtagatcaggaaacagaggttcagagaggttcggtgcctccaccaaggtcacccggcctggaaagtgacaaagcaaactcctgccacaacagatctctctcttgctgttatttcccagcctctggggatttggcctccctagaggaataaccccacgtgcacccacatgtcatctcgaatgtggattcatgttcttcttgcagcctgtaggctacagcataggaaaaatgcctaaagccaggtgtgctgtgcctcttggtttgcagtttctaagcgctggtcctcgccagtgagtccgcccctcgagcaccctcagtcctcaggtcacctatggtgctgggagctcactgggcggctgaactgcatcccttaggggcagagactgggaaccagctgctgccggtctgaccgtaagaagcggcagcctccctgatcagctaacgcagaggaccttaactaagagtgggcatcccaggggccgggcacagtggctcatgtctgtaatcccagcactttgggagtccgaggcaggtggatcacttgaggttcagagttcaagaccagcctcagcaacatagtgaaaccccatctctactgaaaaatacaaaaatcagccaggcatggtggcgcacgcccgtaatcccagctacttgggaggctgaggcaggagaatcgcttgaacctgggaggaggaggttgcagtgagcagagatgacaccactgcactccagcctgggcggcacagcgagaccccatctcaaaaaaaaaaaaaaaaagaatgggcatcccaggcccttgagtggctctgccccagcccaccccacccccgtccccgccacacacacacacacacacacgcgcacacaacatctgagccaggggtgggtatggaacccaggcctgtcagttcttaattcacccagaaattccagccaagcatcgccgttctcacccaacccgggaaaggactgctgaaggagagagagtgtctggtgcctcctccaggaaccctatgggggttcctttataataatagaggcttctattttctgagaactgccctgtttgccaggcactgcgctaagactgctgttcatccacacgactctgcttagatgtccttatccaggaaatacgaacctcggtgcttcatgcagcctagcagatttcaatagctcctatcagtagggaacgggaattcatactcagggctgtcagatttcaaagcagatgctcttaaatatacatccgctgcctctgtgctgcgagctgcccccctgggatgacccaggggcactgctgctgcccactgatgacctgcccaggtggtggcctctgccccattcagggcccctctagcgagctctggcctgcccttgggcctgtagtctaagggtctgaggtaggccatgcctcttgggcagccccaggcagcgctgtaagctgcagaggcctggtgccacattgcccccctaaaagttttcaacttatttttcgttttgttttttgttttttgttttttaaagtctcgctatattgcccaggctgatcttgaactcctggcctcaagcagtcctcccatctcggcctcccaaagcgctgggattacaggcatgagccactgcgcccggccttttcaatgtcttattatgggaaatctccaacataaacaaaagtagagaaaatgctgtcatgaacccaatagatctgtgcagagtttcccgtgatcccctcacccgagcagcgtgaagcttcctgcactagccaggaggcagccctcagcccttaggagggaggaggccctgacaacccaactccctgctgtgtttctcaccctggggcccttaggaaaggaccttagtccccgcaaatacatctccagggcttcccaggcctcccatctttccctcggcacaggctcggggcgccctcttgtgttacaaatgaattactgtttctgcggggcccagacctttccaaaggtgccctagtatccaaagccgctgtggtccgatggccttctcttcactcctgggggtgccggccacaaaggctgctccctagagaggccttctccagccccctgccagcccctggtcagtcgtctgtcccctaggagggaactggagggagtccccacggttggacaatccaactcctttctctggatccagcagctttgactccgctgtttgggttttctatggggaagatttaccttctcaattgcttctgagttctcatgacaaaatggcaagttaattaaggaaatcccttgcctaagctgtttattttatttttttagagacagggtctctgttgcccaggctggagggcagtgatgcaatcatagctcactgctgcagcctcggtgttctgggctcaagtgatcctcccgtcccagctactcgggtgcacgcagcctcggtgttctgggctcaagtgatcctcccatcccagctacccgagtagctgggactacaggtgcacgccaccacactggctaatttttaaattttttttgagacagggtctctctatgttctccaggctggtctcaaactcctaggctcgagcaatcctcccatctcagcttcccaaagtgcagagattataggcgagagccaccacgcccggcgatgtccttcaggattcagtttaaacatcatctcttctaggcaacttccccttctgcctccccaggtgtagggaccagccccacagggtctgtgggtctctccccgtgtgtggagacgagagagtatagaaataaagacacaagacaaagagataaaaggcagctgggcccggggaaccactaccaccaagttgtggagactggtagtggccccaaatgccaggctgcactgatatttattggatacaagacaaaggggcaggataaggagagtgaaccatctccaatcataggtaaggccacgtgggtcacatgtccactggacagggggcccttccctgcctggcagccgaggcagagagagagaggagacaaagagagaaacaacctacaccattattagagacttttagtactttcactaatttgctactgctatctagaaggcagagccaggtgtacaggatggaacatgaaggcagactaggagcgtgaccactgaagcacagcatcacagggagatggttaggcctccagataactgcgggcaagcctgacaatgtcaggccctccacaagaggtggaggagcagagtcttctctaaactcccccggggaaagggatactccctttcccgggatactccctttcccggtctgctaagtagcctgtgtttttccttgacactgaggctaccgctagaccacggtccgcctggcaacgggcgtcttcccagacgctggcgttacctctagaccaaggagtcctctggtggccctgtctgggcataacagaaggctcgcactcttgtcttctggtcactcctcactgtgtcccctcatctcctatctctgtatggcctggtttttcctaggttatggttatagagcaaggattattataatattggaataaagagtaattgctacaaactaatgattaatgatattcatatataatcatatctaagatctatatctggtgtaactattcttgttttatattttattatactagaacagcttgtgtcctcggtctcttgcctcggtacctgggtggcttgccgcccacacccaggcctggccgaggaactcttctcagtatccccatggtctcttgcacttacttacccccaccccacttttcactctgctgggaacatctctctggatacttctctgcctcccctactaaactgttaagttgtgcagggacaggtgaggacctgacattccgtcagagcaggtccttggtgagcatgtgctggtaacagaatggctctcatcttagcgttgtttcttttgttttgttttgttttgttttgtttgagacggaatcttgctctgttactcaggctggagtgcagtggcaccatctcatctcactgcaacctccacctcccaggttcatgcaattctgcctcagcctccctagtagctgggattacaggtgcgtaccaccacgcccagctgatttttgtacttttagtagagacggggtttcaccatattggccaggctggtcttgaactcctgacatcaagtgatctgcctgcctcggcctcccaaagtgcttggattacaggcatgagccaccatgcccagcctcatcttagtgttttgagatgctctatgcaaagtcctgcaagccggcactgtgccgtcccgctagcgggactggggatttgggctgctgtcccagctgggcctgaccttagtctgccatctcttcctccgcagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtacgacggctggctcacagggagcgccggtcggcccaggggaaggggctgatctgtccggaggccgccatggcgcacaggggtgaggctggggccggaggtggggcgctgggagctcggtgattggtccgttccttggtcccttagggttttttttttcttttcttttcttttcttttgagatggagtttcaatcttgttgcccaggctagagtgcattggcgcaatctcggctcactgcaacctccgcctcctgggtttaagcagttctcctgcgtcagcctcccaagtagctgggattacaggcatgcaccaccaagcccggctaatttttgtatttttagtagagacggggtttcactatgttggtcaggcttgtctcaaacatcctgacctcaggtgatctgcccacctcggccccgcaaagtgctgggattacaggcgtgagccaccacgcctggcagttccttaggtgttattggaggttttaactgcagagatgtaaggccacgtcccttcccgtcactgtcacatagttagaaacaggtggtatctgccatgacccagaaagaaaatcacctctcgattacatcatttaataagggagagtgtaggcattcatggttcaaaaggagtgaaacttttgtggtttagtttatatatatctatatttatagttatattcatatttatttatttttagagacaagggcttgctctgtcacccaggctaaagtgcagtggtgcaatcatagcttactgcaggctggaactcctgggctcaggcagtcctcccacctcagcctcctgagtagctaggatgccaatgcaccaccatgcctgctgattttttatagagacaggggtctcgctctgttgcccaagctggtctcaaactcctggcctcaagcagtcctaccacctcaacctcccaaagccttgtgattatagacatgagccaccacacctggcctgaacttttatttcttagtgattttgcagtgctttctcggggtcttctgccatgttatcttccaaattagtttgattagttctgtaattaaataaatgaagtcatttaagacctttgcatttgggaaagttcatgagttaatgaagacagattgagcatcttctagatctcagattctgagctaagtatttcaccgagttatatcacttaatcctcacagctcacaaatgtatatgagataccttattcttgtcattccttttttgttgttgttgttgtttgagacggagccttgctctgtcgcccaggttggagtgcagtggcacgatctcggctcactgcagcctccttctcccaggttcaagcgactctcctgcctcagcctcctgagtggctgagactacaggtgtgcaccaccacgcctggctaatttttgtatttttagtagagacgggtttcatcatattggccaggctggtctcgaactcctgacctcaagtgatccgcctgcctcggcctcccaaagtgctgggattacaggcatgagccaccgcacccagccagttctcttcattctacagatgaaaaatatagaactcagaggggctaaggaggtcaggccccagtgctgtcttggtagaacaaagtgcactgggatgaagtgtttggagtagatggaggaaacccactgaaggatcctgagttgctgatcatagctataaccatactctctgctgctagaaaccaagaattccagggccctgatggagatccctaagctagtgccttgccattgaccatctcaggtgctgcttcccattgtccctagggcacgataacattggggtaggtgctcctggttcaaccaaggtcaccctacgtaggtctagccgatggcagtggggccctcccagctgtgcacatgacacagtcatgggcagcacaaagtcacagtcaggctggaggggaagttgtgtctctcaccgggccctccctcccccataaggtccactggagttcctaaaggggcccagtaaaccacccaggctctgaacaaattgggaaactaaaatattaggtcagagtccaaatcacacctttattgcccatagaggcaaagtcacaagatgctgctcattgtgagaactgagcgcacctgctacgtggaccctagactcaggcaaacttccccacaatggcagccctggccccgcacaggcctccccgtgttccagctacctcccgcaaggacaaaatccaggattagccaggcgtggtaacacgcacctacagccccagctactcaggaggctgaggtgggaggatcacttgaggccagaaggcggaggttgcagtgagccgagatcacaccactgcactccagtctgggtgatagagccagaccctgtctcaaaaaaagaaagtccaggagctgcacagccagtttcttcattccaaatttagcaatcagatcaaaacagaggcagagggaggccagcagttagaacagtggaggtccctctacttggaaggaaacttcaacagtaatgaagcagaatgaaggaaatgaacggaaacgtggacaggggtttcctgaagcttctctttgccaggtgccatgctatcccatttccactttctttctttcttttttttttttttttttttttctgagacagagccttgctctgtcacccaggctggagtacagcagcacgatctcggctcactgcaacctctgcctcctaggttcaagcttctcctgcctcagcctcctgagtagctgaaattataggcacccaccaccatgcccggctaattttttgtatttctagtagagactgggtttcaccatgttggccagactggtctcaaactcttgacctcaagtgatccacccacctcggcctcccaaagttctgggattacaggcgtgagccaccacgcctagatgccatctctactttctagccacagagatgcgtgcactttgaagtctcctgcaattcacatccattttagggcatgtgtgataacgctttctataatatagacacatgcaaagccctaggttaccatctgggcatagatgctaccaattatacaaaacagttccaaaagtatgttccctggccctgctggagccacgtttgtttcccaagtcccccaacaggcctcagctgcatggcagtcactgccccctggccagggtacacaccctcgggtttctcagtttgctgcttgtcttgctggtcttctgacagtcatacccgtcacactgtagtctgcggtcattgtggggatgcctcttttgtgcattttagcactagcaaattcagtggtacacctgtggcaaagatagagaaggggagagaagaagaataccagtaggacctcaaaacttagtaagtaaaatttagtaatcacaggtctgggctgggtgtggtagcttatgcccgtaatcctagcactttgggaggccaaggcgggtggatcacttgaggccaggagttcgagaccagcctggccaacatgatgaaaccccgtctctactaaaaatacaaaaattagccaggtgtggtggggtgcgcctgtaatcccagctgctcaggaggctgaggcaagagaatcgcctgaacctgtgaggtggaggttgcagtgagccatgatcataccactgcactccagtctgggtgacacagcgagactctgtctcaaaaaaataaatgaatcccaggtctgaatccagagtagacactcaacaaatgcttcctttcaaaaataactccacaacaaagcaggctgggctgagtcaaatatgggatccaagagatgagtttgagctgcagagatctggaaaaatatcatggaagaggtatgaaatgagcaggctcttgaaaggaggattggagtagagaagaattttataagcaacgaaacaggtggaaggagaaacgaggggccgagcacagtggctcatgcctggaactccaccacattgggaggctgaagcaggaggatggtttgaggccaggagtttgagaccagcctcagtgagaccctgtctctacagaaaataataataataataataataataataataataataataataataaaataaatgaaggagaagtgagcattcaaaattagcatgaagtcgcttgtctaagatcacccagcaggggcgggcttggtggttcacgcctataatcccagcactttggaaggccaaggcgggcagatcatctgaggtcaggagttcgagaccagcctggccaacatggtgaaaccctgcctctactaaaaatacaaaattagcccggtgtggtggcacatgcctgtaatcccagctactctagaggctgaggcaggagaatctcttgaactccggaggcggaggttgcagtgagccgagatcacgccattgcactccagcctgggcaacagagcaaaactccgtctcaaaaaaataaaaataaaaataaaaaaagaccactcacccagcaggccaagggcagagggcagagcagagatgcagactgagtttcttctccaacactttggttctttcactaaatgctttgtacagaccaacctgccgttatacccgacagagcttcccgacactggatgtgttaaatccctaaccaagaacgtagttttttacgttcttttctcaggggttaaacaggaaaagtagattttcttttctcctgtcccactggaaccctcagggagtaacacttggtgtcaatttttgccccctcaaaaaaaaaaccgagctttatttcctcttatcctttcactttaagggaattagaaatatctctggctaaaggcaattaaaaatatctcaggctgggccgggcacggcctgtaatcccagcatttggggaggccaaggtgggaggattgcttgagcccaggagtttgagaccagactgggcaacatagtgagaccacgtctacaaaaaatagaaaaacaggcgggcgtggtggtgcatgcctgtgatcccagctactcaggaggctgaggtgggagaatcacttgaggaggttgaggctgcagtgagctgtgatcatgccattgcactccagcctggggaacagagcaagaccctgtcccccagcaaaaaaaaacatatctcaggctgaccatttacccaggattgatgacgagattgccagaacaacatgccacaggacactgctctcccctggaaaaacaggtccacccagttaggaactcagattctgaaccctcgcagccacggcattctgcgagccttgtgtgacttccctaaaaaccacaactgctcctggaagctcatctttctaggccagaagacagtattccttagaaatatggagacaaatctaggctaaaaaggatgatgtctcacatctgtggagcacaaagcatgtgccaggcactgagccaaaaaggtttttgtttgtttgtttgttttctgattttggttttggttttggttttttgagaaagggtctcgctctgtcgccgaggctggagtgcagtggcaaaatctcagctcaccgcagccttgaactcccaggctcagccaatccttccatctgagcctcaggagtagctggggcttcaggtgcatgccaccacacctggctaattttttgtatttttctgtagagatggggttttgctattttgcccaggctggtctctaactcctgagctcaagtgatctcccacccaggcctcccaaagccctgggattataggcatgagtccctgcacccggcctgagcagacagttttatagatatatcatcttattagtccctccatcagcacccaagtgcagtgctgctggccccattttacaggcaaagtctgcacacaggggccaagctcatgagcatggaaacacaagccccatgcctaacggtgtccgctccccaccccagccttagggcttatcacagcacacaaacagcggctggatagggggaagggtgacccctttttgaatggctactttgggtcctacatcatacatttaataccttatttaatcttaataacttctctgcaaggaagataccattctccacatttttcagacaagaaataagaaaactgaagttgtagccaggcgtggtggctcacccctgtaatcccagcactttgggaggccaaggcaggtggatcacctgaggtcaggagttcaagaccagcctggccaacatggtgaaaccccgtctctattaaaatacaaaaaattagccagttgtcgtggcacgtacctgtagtcccagctatttgggaggctgaggcaggagaatcatttgaacccaagaggcagaggttgcagtgagctgagatcgcaccactgcactccagcctgggcgtcagagtgagactcccttctcaaaaaaaaaaaaaaatgaaaaatgaaattttcttatttctcacagaatgctatggctatgaggttaaataacttctccaagttgcacagctagtaagcaccttagccagatatccaacccaagtgtgcctgcttccaaaaagcctgtactctggttttgggtcgggctgggaccaaaccttcactacccatatagcctcccgcctccccaaccagaataggtggggtggagagtttcaccccaactagcagtctcactgccaaggaacttgaaagccatagcgcccaggaacctgttcacagaagccaccatttcctgggctcccaaggtagccccagggaagggggaaagacttacacaccttggaacttctggggggcttctcagaacctttcctttctgaaccagagctcacaaatctttcaggacaaggttcagagctcactgcacgcaggaatcaaataactccatagcagattcacaaccccctgcaccccaccagagttcaataccctgggctaagctacagtaggatcttccccaggggagtccccacagtcagcacaggacccggcgcagagtaggagcccagaaaacctttgttttttttttcccttgagacaggatcttgctctgtcgcccaggctggagtgcagtggcagtcttggctcactgtaacctccacctcccaggttcaagagattctcctgcctcagcctcctgagttgctgggattacaggtacctgccaccacgcctggctaatttttgtatttttagtagagacaaggttccaccatgttggccgggctggtctcgaacgccgggcctcaagccatctgcccgcctcagcctcccaaagtgctgggattgcaggcgtgagctaccatgcccagcctcagaaagccttattggccgggcttggtggcttatacctgtagtatcaacactttgggaggccaaggcagcagaatcacttcagcccaggaggtcaagtttgcagtaaactatgatcttgcccctgcactccagcctaagcaacatcatgagatcctgtctctacaatattttaaaaatttaggcatggtggtatacacctgtggtcctagctactcaggaggctgaggcaggaggatcacctgagcctgggaggtggaggttgcagggagctatgatcacaccactgcatttcagcctgagtgacagagcaagacactgcctctaagtaaaataaggaaaggaaaaaaaaaaaaagaaagaaaaaatacagaatttggtggaattccaccctaccctggaccacaagcccccaacctgaccttctgtggctcagagattaaaattgtcactttggccactatccaataattggtcctctctcctgaagtcctgatggatgcagcggttatcaggcagtttcactgatgaactcacccagccttcgttactgcacaccaggcgccagtgcaaggcctgggtgtacaaagaataaataggaccttgcctttctcagtctagttggagcgggatgggatgggatggaggaaacgtgtcactcgataagaaccctggccagaagtggtggctcatgcctgtaatcccagcacttggggaggcccaggcaggaagattgcttgagcccaggagctcaagactagcctgggcaacatggcaagactccatctctttaaaaaatttaaaaattagcaagcatagtgacacagttgtggtcctagctactcaggaggctcagatgggaggatcactcaagcccagtagttggaggctgcagtgagctgtgatggcaccactgcactccagtctgggtgacagaacaaggccttgtttccaaaaggtttttgaaaaataaaataagtggccggacgcagtggctcacacctgtaatcccagcacttttggaggccaaggcagatagctcatgtgaggtccggagtttgagaccagcctggccaacatggtgaaaccccatctcttctaaaaatgcaaaaattagctggatgtggtagtgggtgactgtaatcccaggtactctggaggctgaggcaggagaatcgcttgaacccaggaggcagaggttgcagtctgcggagattgagccactgcactccacctgggcagcaacagggaaattctgtctcaaaaaataaaaattaaaataagtgcccgcggcaatttgttgcagtggagaataggggagtggtgtcccagccctgggatggctcctggccaggcccggaggggtgggtggtgactctggagaggggctgccccgtggcccgagggtcgctggaggggcacggaggggcctccaggctggacggagcaggagccccagagagaggggtctggctggggtagcaccagaggccctttccccagcagcacccccctcacgtccccgccgcttgttgtcttgtaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggccgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcctgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatggtgcattcattatttcttaagtttaattaatattacttttttttttatttggggggtgggagggagttataattttaaaggtatgctctggctgttccacctccgtgtgcttgttaattaacttgtaggactttgactgtaagatgtgaaaccacgtttcttgcatgatgttttagagattatttcatttacagtcttttaacctgcagctgcagcacttagttcacgttttcacaaatttcaagagtcactacactaaagacaatgccttttcatgaataagaagttttcagaaggctctagggggctgggaggcaggctgttcgtttgtcttttgttgggggtatcatttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcatgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacaaaagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaagccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttgcaaggcccgcatgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaagaatgtgtgggttgtttttatttaaagtgctctggcctgaggacgagcagcaaacactgtcattcgaggtccaaagggcacctcaagaatcgccgttcccgaggtcgtcccctttgcacctgtccgcaggtcctcgggcgtgtggcttccgggcacacagaaaaccgtgtggttctaggatacatggggatctcgggcactgctctgtcaatctgcatctggttcacaggaagggcttcgccagggcctgcgttcctacttgctgttgtcaccagcactgtttgcctacccttgaaccaagcccttaccctccctggcgtccgcttccttttctgtaaaatggagacaccatctcctgtcatataggcttgctgtggggaaccaggaatggtggccagtgctggtgcggcactgggctggtggtggcagccccaatcgatggcacttgggcgaccaggactacggccagtctcctctgccgtgtggcctgcagctggtcagtggcgtggcctcagccttctgtgtgggggtctcactgtgcccctgactcctgatgtaacagaaagacaagtgaaaggcaccagttaatgcttgcgagtgggacagtggcttgcgggtctctggaatgacggggctactgagaagagtctctttccagatggcgctcgggctggaggtggggggagagctctgcagaggtggctgttaggcttctccgcgcagttgtgactcagaggctgttgctcgtcttgggttggaaaagagctgtctgccaggccgacgtgtgtctggtggaagtgggggatgacttggtcgcatattaatttggagatttcagattgtgaaatgtccacatgtgatacagaatcgtaagcccctctcccaattcaactggattcaatcctccctccagtgggagaacccagagtatgggatggagacaccccccagtgccaggtgccctcggcagccccgtgtctgatgcagtcacttagggccgggggtgtctctagagttgcccaaaatgctggtcccctcagataggagaggcctgcataaaaccctaagagctggcccagcgcagtggctcacgcctgtaatcccagcactttgggaggccgaggccggtggatcacttgaggtcaggagttcaagaccagcctggccaacatggtgaaaccccgtctctactaaaaatacaaaaattaaccaggcatggtggcgggtgcctgtaatcccagctacttgggaggctgaggcaggagaattgcttgaacctgggaggcagaggttacggtgagccgagattgtgccactgcactccggcctgggcgatagagcgaaactcagtctcaataaaacaaacaaacaaaaaaataaccctaagaactctgccagtttggtatttgacagactgaagtctaacgtggttaatttttctgtttgctagtttaggtatgcccctatgtatttcatgatctgctaactaaattaaaataagaaatgttaaaaaaaaaaaaaaaagaaagaaaagagaaaggaaggaaggaaaggaaggaagaaagaacagttgggcacagtggctcattcctgtaactcctataggcccagcactttgggaggaggtcaaggcaggaggatggcttgagcccaggagtttgagaccagcctgggcaacatagtgagaccccatctctacaaaaaataaaaaattagttgggcatggtggcatgtgcctgtagtcctagctactctggaggctgaggtgggaggatcacttctgcccaggagttcaacgctgcagtgagctatgatggcaccactgcactccagcctgggcaacacagcaagaccctaaatcttggggggaaaaaaaaaaaaaggaacacttagctcaaagtctttttcctcagaaagttgagacaggatctcagtctgtcaccacctcctcctcccaggcttaagcaaccctcccatctcagcctcccaagtagctgggaccacaggtgtgcaccaccacgcctggctaattttttgcagagaaggggtttcaccatgttgcccaggctggtctcgaactcctgagctcagaagatccacccacctggttctcccaaagtgctgggattacaggcgtgagccaccgcgcccggccccttatttgttatttgtttcgtttcgttttgtttttaagatggagtctggctctgtcacccaggctggagtgcaatggtacaatctcggctcgctgcaacctccaccgcctgggttcaggcgattctcctgcctccgcctcccaagtagctgggattataggtgcccgccaccacacctggctttttttttttttttttttttttttgtatttttagtagagatggggtttcaccatgttggccaggctgatctcgaactcctgacttcaagtgatctgcctgcctcagcctcccaaagtgctgggattacaggcgtgagccaccatacccagccgcgttccttatttgatgctctgaagaaacacaattgcaggtagacagggtggcgcgacgtgatgatgagatatattagagcacttgaattgtctgcaatggtcctgtgtgcttctgttacaaagcccctctgagtggctgcctgggggcatgctgctcctctccacggtcttaacatgccagctttgggggcacacagcttgctggtgtctacttcagctcatcactgattcctgtgaggtggcagaggcctgggcctgcatgtacggacccaaccagggaactgggagggctccacagagctaccgtgatgttgcccaggctcccggccagtgggccgttgcttagcaaccgactcatgcagtgtggagtgaccggcctccacagacaggggagacacagcctgggcccagccttaggcaggcattgctgaagttcctgtcttttccaagaagttcagactcttagaataccaacaggaagggccctggtcgagcatggtgggtcacgcctataatcccagcactttgggaggctgaggtggacagatcacctgaggtcaggagtttgagaccagcctggccaacatgatgaaaccccatctctactaaaaatacaaaaattagccaggcatgatggcacatgtctgtaatcccagctactcaggaggctgaggcaggagaatcacttgaacccaggaggcggaggttgcagtgagccaagattgcgccactgcactccagcctgggcaacagagtgagactctggctcaaaaaaataaaaaataaataataccaatacgaagagcccttttttttttttaagcagaatcaagtatggataagtaatagcagagcttcccatttggggcagtggtgtggcctccagggagcgggatttgaggacaaccctcccattgttcagggaggcgtcagtgtctctgtggtcaggagacactggctgtatcaggatcccagcagcgtctcttagtggctgatgaccgtgagcaagtcttaagtcgatgctcaggaaatctttgaaagaataaatgagtttaacttcctagtgcttctgtttctgtctctgtaaaggggatataaaaagccaaactcggtcgggcacgatggctcacacctgtaatcccaaggctttgggaagccaaggcaggaggatcacttgaggccgggagttcaagacccaccctgggacacatagcaagaccccatctctacgaaaatgtttaaaattcgccggatgtgctggcacatgcctgtagtcccagctacttgggaggctgaaggatcgcttcagcccaggagctcaaggctgcagtgagctataattgcaccactgcactccggcctgggtgacagagtgagaccctgtctccagttgaaaaaataagaggtaggtggctcatgcctgtaatcccagcactttgggagccgaggcgggtggatcacgagttcaagagattgagaccatcctggctaacatggtgaaaccctgtctctactaaaaagacaaaaaaattagccaggcgtggtggcaggcacctgtagccactcaggaggctgaggcaggagaatcgcttgaacccaggaggcagaggttgtagtgagccgtgatacctccactgcactccagcctgggcgacaaagcaagactccatcatggatggatggatggatggatggatggatggataactcacagggttactgagaggacccagtgagaagacctggaaaccactcacccagcacccagtggcagggcagagcctggaaggatccaagtgaggcctatgcagttactggcagtggaagcagcagaggactggctggccctgccagggtcttgctgcccgtggccaggccccatctcctggggtctttagtctcctctaacacacatggcctctgggtttggctgtgatggggtgggactgagccgtggtagatgcttacatcagacggattgcaaagagggccagctgtgccccagcctgggagaccctgcagctgtgggaatcccggtgcaactttccaactgaggaaacagatgcttgccgcggggtagtatccactcgcccgtgagctaatacataccgaaggctgaccgtgggccgctgccttacacgctggggttattacagggcaaaccaggagctcaccttcttgtgggagggacagacagtagacgtaataaataagtgaatgagatagttgcttcgaaggtgatcaatgttataaggaggatgggaagagcaagtgaaaagggttaaactttttttttttttttttttggagatgaagtcttactctgttgctcaggctggagtgcagtggcgtgatctcggctcactgcaacctccacctcccaggttcaggcgattctcctgcctcagcctcccaagtagctgggattacaggtgcatgccaccacgtccagctaatttttgtatttttagtagagacaggggtttcaccacattggccaggctggtctcaaactgctgatctcaagtgatccacccgccttggcatcccaaagtactgggattacaggtacgagccaccacacctagcctttttttttttttttttttgagatggagtctcactgttgcccaggctagagtgcagtgacacaatttcagctcactgcaacctcctcctcccaggttcaagcagttctcctgcctcagcctcccaagtagctgggactacaggtgcacactgccatgcccagctaatttttgttatttttagtagagacaggagtttcatcatgttgtccattctggtctcgaactcctgacctcaggtgatctgcccgcttcagcctcccatagtgctgggattacagatgtgagccactgcgcccagccgaaaggggttaaagttttaaatcgggtggtcagggtaggcctccctaagaagttcacttctctgtttaatttattatctttttctctttttttttgagacagggtctcactctgtcacccaggctggagtgcagtggtgcgatctcagctcactgcaacctccacctccggggttcaagcgattctcctgccccagccttccgagtagctggaattacaggcgtgcatcaccatgcccggctaatttttgtatttttagtagagacggggttcaccatattggccgggctggtctcgaactcctggcctcaagcgatctgcctgcctcggcctcccaaagtgctgggattacaggcatgagccactattcccagacagaagttaacttctttttttttttttttttttgagacggagtcttgctctgtcacccaggctagagtgcagtggcgtgatgtcagctcactgcaacctccgcctcccaggttcaagtgattctcctgcctcagcctcccaagtagctgggattacaggcgcccaccaccgcgcccggctaatttttgtatttttagtagagacggggtttcaccgtcttggccaggctggtctcgaactcctgacctcaggtgatccacccgcctcggcctcccaaagtgctgggattacaggcatgagccatcgcgcccagcccagaagttaacttctaaacagtactggcagagctgagggaacgagccctgcagatgtgagaaggaaggacgttctaggcagtgagaactgccagttcaaaggtctcgtggtgcaaatgtctctggaaaccagcatggccgcagcaccgtgaccaggaggaagagtgggaggcgatgaggtcagagagaccaaggagaggcggagcatgggggccttgtcggctattgctgaggctttgttttttactctgagtcaactgggaggcattggacggtttgaacagagggtcctggctctggtggggaaacaggaagtaggattcattggtaggagtgagtaaggaggggtcagcacaggggaagccctcagaagctcacccaggaggccacaactggggctgcgtttaacccccacagccatgccagatgagctgcttctcagccaccacgtgggatcgatttcttccacattgaacttggtcaaggcccgctgctttgtgctgtggatcttctggcagccagggaacttagacttggccctgcatatggcctcaatcacaccctcatggttctgctcttagtacggatagacacaatgacctggccaacataaaccctggctgtcacaccctggggctttccaagggcaccccgaatacttgcctggtgcctagaccacagacagcacgaggtcagagacacaaatgtccagtggaaagaattgtctccaacgttccttagggcaacccatgtaagaaacagactgtgtggccgggggtggtggctcacgcctataatcccagcactttgggaggccaaggtgggtggatcacctgaggtcaggagttcaagaccagcctggccaacatgaagaaaccctgtctctactaaaaatacaaaaattagccgggcatggtagcgggcgcctgtaatcccagctacttgggaggctgaggcaggagaattgcttgaaccccggaggcagaggttgcagtgagccgagattacaccactatactccagcctgggcaacaagagcaaaaatctgtctcaaaaaaaaaaaaagagaaagaaagaaacagactgtgtactttactgaggaggctgctgtttgcaaccactgcaccctacaaggtcactattttttttaagagacagggtctcactctgttgcccaggctagacggcagtggcataatcatcgctcactgcagccttgacctcctgggctcaagcaatcctcctgcctcagcctcccaagtagcagggacaggcgtgcaccaccacacacggctaatattttaattttttgtagcgacagtctggctatgttgcccaggctggtctcaaactcctggactcaagcaatcttcctgcctcagcctcccaaagtcctgggattacaggcatgagacagttgcacccgaccaactttttaaaaggctctctctggctgctgcttggtgcccagatcataggttgcagagggaggccaatgaggaggctgatgccatcatcacaatgagaggtggtcatgactcggactaggtggcagcagtggtaaaaagagactggattctggagatattttgaaagtagagccaaaaatgagacttaaggcaggggcagtggctcacgcctgtaatcccagcactttgggaggccgaggtgggtgggtcacttcaagccaggagtttaagaccagcctgaccaacatggtgaaaccctgtctctactaaaaatacaaaaattagccaggcgtggtggttcatgcttgtagtcccagctgctcgggaggctgaggcaggagaatctcttgaacccaagaggtggaggttgcagtgagttgagatcatgccactgcactctagcctgggtgacagagtgagactccgtttcaaaaaaaaaaaaaaaaagagagagagagagacttaagacagattcagcatcaggagtgatggagaggagtgaggctacctcccggggtttggtctgagccaccgaagggtcgcagagagctgggtcaggccgggaagggggtctctgcctatccctgcagatgtcacctcccgaggctggactacaggggtccacacttgggcttggggagtacagacttggggaggaagggatcaggctgaaattcagacctgtgaaggttgaaatgccagtagaagatcaagtagaagataaatccaaggagaggcgtggactggagtcccacactggggaggcatcggcttgtcaatggcatcccgcatggccagagcggatgagggggcagagtgaggcatctgcggatggtccctgtgcagcagcggcaagaagcttagcagggagggcaaggaccagtcaaggaaacagggcagagcagccagccggggaaggaggcccaggagggtcggtgacctggaaactagctgctaacacagcagctcagatgagagccgaaaaacaaggacgtggcaatgtgcggaggtcattagggaccttggcaaggacagtcagcgtgaggggtggcagagtctgatgggaagggcttgaggaattggaggagcggaattagacgcttgagaagagacagcttcttcaaggagttttgccagagtggggtcaagggaaggggcgtgtgtgcatgtgtacatgcctgctaggagaacatgcttgcatgcatgtagaaggcaagagccggtgctgcaggagagggtggcattgctggagaccccattgcataggggtgggggccagcacctgcaggcatggggagccggctgggggggctcagtggtcacctgaggctacctgcaggatctacaggtgcagaggcagggaggggtggatgaggcagcagcttggccccctcagtgtcctcctagcagagataccatgtgcaccgagcgtctccaccattcctacctggcctgcaagtgatttaataagacaggggcagccgggcatgtggctcatgcctgtaatcccagcactttgggaggctgaggtgggtggatcacctcaggtcaggagttcgagaccagcctggccaacgtgacgaaactctgtctccactaaaaatacaaaaattagccaggcatggtggtgcatgcctgtaatcccagctgcttgagaggctgaggcaggagaatcacttgaacctgggagagagaggttgcagagagccgagatcataccattgcactctagcctgggtgacgagtgaaactccgtctcaaaagaaataaaaaataaaaagacaggggcccctcgcgccttcaggaaaaccgtaggtacaacaccgctggcctcgctatgataagtctctgcatttaatccttctgcagtcagaaatcatgcctagactttttttgggcgtggtgcagagagggacagggtcttgctctgtcacccagcctggagtgcagtggtgcaatcgtagctctctgcagcctggaactcctggactcaagcgatcctcccgccttagcctcctgagtagctgggaccacaggtgcacaccaccatgcccggctaagttttgtatttttctgtagagatgacgttttgccatgttgcccgtgctggtctcaaacacctgagctccagcgatgctaccacctctgcctcccaaagtgctgtattccagccgtgagccactgcaccgggccctcctgaagtcttgaccttaaagatgctttgattccctcctcccctctgtgaggtgccccctctaggatgtctttgtgggttctcccagaggatgaggtcccagtctttcctgaggggaaggggaccgtcttgggcccttgcaccacagactccttttctgagcccctttccctgtcttatgctcacttatccacccgtcgcctgtcatccctctctcccctaaacaaaatctgtccctctctcctgggtttctgggttgcagatggtccattccacacactctatgcttctcaagatcccctctcgggcacacgttactgctcttccaccagttctgcccatcgggctgtgccttgcagccctgcatgcccccaccacctcgacgacaacaccttcgcctcgctcagcctctctgtagcttctgaccccctgaccctccatattcattgaccctcctgcctcatcttggtgccttcacatgcatcctcctgctgtctcccctgcctcctgctgcctcttctcagggtctttgcgggaccccctttgtggatcaccccctgaagctctggccacctcacagcagcactgtctcaggacctgtccaccacccctgattttctgtattagctgttcttgcattgctatagagaaatacctgaggctgtgtaatttatcaagaaaaggggtttctttggctcatggttctgcaggctgtaccagaagcgtggcgctggtgtcggtttggcttctggggaggcgttggaggctttactcatggtggaaggcgaagtgggagcaggtgtgagacatggcgaggccaggaggaagagagagagaatgggggtgggggaggtgccacgctccttaaacaaccagatccctatctcagagacagcaccgcgccacaagggacccgccctgtcccccaaacacctcccaccaggccccacttccaacactggggattaattacttttttttttttttgagacagggtcttactctgtcacccaagcaagagtgcagtggtgtgatcacagctcactgcaacctctgcctcctgggctcaggtgatcctcccatctcagcctccctagtagctgggactacagctacaccaccacacccagctaattttttgtgtgggtttttttgtttgtttgtttgtttgtttgtttgtttgtgtagagacagggtttttccatgttacccaggctggtctcgaattcctgggctccagtgatcctccctcctcagcctcccaaagtgctggaattataggcaagagccactgcacctggcttgattacatttcaacatgagatgtggacagggatgaatatccaaactatataattccacccctgccccctcacgcaaatctcatgtccttctcacattgcaaaatacaatcatgcctttccaacagtaccccaaagtctttttttttttagatggagtttcactcttgttgcccaggctggagtacaatggtgccatctcagctcactgtaacctccgcctcccaggttcaagccattctcctgcctcagcctcccaaatagctgggattacaggcgtccgccaccatgcccggctaattttttttttttttttttttgtatttttagtagagacgagttttcgccatgttggccaggctggtctcaaactcctgacctcaggtgatctgcccgcctcggcctctcaaagtgctgggattacaggcgtgagccaccacgcccacccccacagtcttaactcattacagcattttggtcacaaccatcgaacaagtctctaagaagttccaaactttccctcatcttactgtcttcttccatgccccccaaacgcttccaagctctgaccgttggggccctagatctcctcaaccagcatatccagcctcaggtccacaggtccaaaccccaccacacacatgcccttagctgttcacaagcaccttcgtgcttaccagaaccgagccagccagctgcccaccccttcccccacagggggccaggcccgggcctccccacctgggttctgtacagcgatggggtccacagctctctctccagctccttctgtgtcctcgccccagagccctgtactccagaggttgaagaacttgccgaagatcgtgaaattcataaaaggcagggccagaatgcaagcccggttctggacttgacatcaagtggccaccagagatgtcaccccagcttccccacctgcgtgttccagcctccagcagagaaggcagggtgaggcagccggtgggggataggggaccctcccgtggccggtgaggccctgtccttctctaagtacatctaactgaggcccctctctggtggaagcccgcacagccagtctcctggccttcgcttcctcccagcgtggagtgacagtttcaaagcacagctctggttgctgctgggatccagctgggctctgggacagtgtccagatcctgtcccctgcagcctccagttctctgtccacccccctctacccacagccttccctccagtctcaccgtctgccagcctctgctgccctgtcttacccagcctgttctctctgcctcaccagcagccatcccccaattctgctgcccgtgcaactggcctgtgctcctatcaccccaagccacctcttcagggatggcctcccccaaccactcagccctgcaccctcagatcccctcaggagctaacccagtgcccagagcatctgcagcagcgccaatggccaggcctccaggccagcttaacacatgggccttttccaggatagcgggccaccagcttggaactggggcagcctaggatagagggtttgcagccaggatgctcacacctgcacagaatgtcacctacatacacggcaggactgtgtgcccacccctgcagtagcagacacaggaacaagtgcacggggaccaggcccacgcaccccatcatctccctggtgcccacggatggtgctgggagctgcaagttgctgccaccccagggacctgaccaagaccacactggggtggtcacagactgggggcagataaaacaggcagtgcaaggaatcatctcagcagctttttatccacccctcttgccaggcgcacacctccagggaaaagggctcactctggccaggcaaaagtcacctctgcaaaggttctccatctcagccctgtctctctgtcccccaggccctcatccctgaggtggaatgtggcttccctgagccttgttggagcttaacgccctctttttatcccaggagtctgtccccatggtcccagcacggttcttggatgtgctcctgtttgtggccaaactgaagcatcccctcccttggtccaggaccttcacctctattaatgtgacccaaggccccattagctttctggtggtttcctctccctacatctcacaaccgctgtccacctcccatcctaagcatgagtggccggctctgccatcccatcccacaggccaggacccaaggactctgtactcaggccaggagggcatggtatttatcgtctctctggacctctcccctttggggtctccttaaagtccctgcaggtggcccagggccagccccaaccctgcccccgacagtcctccctccaaggccgggtcctgccttcaggtcctgcctcttccctcatcccctcctcacttccgcagataccaccttcctgccagggacccaggggctcagtgaatgtctgaaggaagaaatccatttaggggcccagtgcggtggctcacgcctgtaatcccagcacattgggaggttgaggcggacagatcacttgaggttgagaccaacctggacaacattgctaaaccccgtctctactaaaaatacaaaaattaactgggcacggtggcaggcgcctgtaatcccagctactcaggaggttgaggcaggaaaattgcttgaaccttggaggcggaggttgcagtgagccgagatggagccactgcactccagcctgggtgactgagtgagactctgtctcaataaaataaaataaaataaatccattcggggcctgaacgaggcgagactctggtgtgagcaagggcttagacagagctgggggtggatgccttgggtttggtcccaggtcgggaagcctccgttctttgactgtaaaatgtgaatcgtcttttctgactcatctataaggacttggtgtgcagtgggaacccaggagcatgtggaggtgaggctgggctgccccatcctggcccaggacactgagcccagccagggcaggtatgacagccggtcagcaggccgcgcagtcagggatgagtccacggaggaggccgcacataccatttccctggcactgcccacagcctgcagcctttgtgcatttctgaggccacagtgccccctggcggctgtgcagcctaccccaaaggacagcgtcctgggtctcaggcctcagtctccctctctgcggccccaacagctcaccctaaacaaggtttattgttaccatgttacatgtcaccatttgggaccagaaagggggatccagtggccctgagccgcacagtcaaccagaaacagggccaaacctcaccctcagggctgcctggctcctgggtcactgaagtcctgcctggcaatgcgtgcttgggtctgggtcccttccccgacatctctcaccctcctgcagggcaggaaagtcacagtttggatgctttgttataaagatgaccctggcacctggaggagggagagacagacagggctgtgggtcgggggactccttggggaccacgccaccccaaccactgcagctggagcctctgttgggggcgggaccaagcacctctgttgtcagcccagaggtggcacccctacgcgctccactgcacccccgcggctttctctgcctctcctacccccaggcttcccactggacattatcccagaacatcagctaggaagcaacctgagcctccttgcccctgcctgacaagcaaagtgaggcccagagagggaaaggggctggccagggccccccaaacagccgtgggcagagccacgttgcaccggtttctcctaatccctgacctgagctccttctcctacccaggggatttcatcaatccagagagtgcttggggccaggagtgcctctgacagtcagggagggcttcctggaggaggccctaggtctaatggggtcttctaggcagtggtgagttgggagggaatagccagcactctcacagcatccaggcagccctgcttccagaccgtgggttggagaggcagaaccaggggagggcaccaagggtcccaccaggctccctctgacggccatgtcttcctttggccacaggacgctgtgcagagctgcaagtccgtatcactgaggctgtggccacagccactgagcagagagagctgatcgcccgcctggagcaggacctgagcatcattcagtccatccagcggcccgatgccgaggtgagcccacccccctgccccatgcccatctcgctacctgcccaactgacttagcctctgcaaacactgacttcccagattagcctgtgtatcaggcagctggtgacaacccagaagggctgtcacctaaaaccattgggttctccctgcttactccatgaataccaccctgcctccgatttggggtgacaggccatggggcagaggccacagggcttcctagcggtagcacagaggcccgtctttccaggcactgccctgagagcagaggcagaggcaaggccaggaccatgcacccatctcccagctaaaggacctggagcccagagatcacagcaggctgggacataaacagcccagggagagcatctcctcgcccacctcccattctgtagagtccacagtgggactccgggagagaagtctgggctgtcccaggtcacgtggcaggctggttgcagggccagggaggcccaggtgtctgatgcatgtcaaagctgagtggctgcgaggagagctgcactgctgctgaactctggcctcaggagtgacttagggcccagccatctcttctttggtagctcatgtcacgtgtccaggtccgggccctcctgcagccagcctgcaccccggatggccccacccactccttgccacacccaccctgccatttgccttggccatgctgaaagggaatattccgtgcccattgtgcggaggcacctcctcatcgcttcctgtcacctgcagggtgccgctgagcaccgcctggagaagatcccagagcccatcaaagaggccactgccctattctacggtaaggagaggcctgacccatgggaggagggaggaggagggaagaggagacaggtgataccgcctaagaacacagatccccaaagagtagtcccttcctctaagaaggtcaggcccccacgcctgcaatgcagcagcaaccttcaaagggtcgggtaaggctaggtgtggtggcgcacacctatagtcccagctactttggaggccgaggtgggaggatcgcctgagcccaggaattggaggctgcagtgagctatgatggtgccactgcactccagcctgggcgacagaccgagaccctgtctctaaaaaacaaaaaggtgaatgagccctcaacctgcctttctggatcttagactgacaccccccaccttggggccctgacccttcagccctgccggtggcctgtgaaaggctggtgagtggtggtcagccaggcctcactgccaaagtgcagccggaggtccgtgcagtgaggggaaggcagcctccttgggtattgaggacagaaactgaggctgctggactgggatactgggggtgtgcccatgcctccccagttcccctcctgcccctttgcttccccaggggatataggcctagtctgacagctgcaagggtctcagattcaaggacagagtgactgggaggggagttctgggcctggccctctgacagcgcagacgggggtgctgggcccttccccagcgtgcgtattgtcaggtcagcccctgccatccattctcacgctccccggttcccctggctgtcccctccccttccccgacctgcccagcaccagggagtcagacaccatgtggcttctaccccatggcatttggcagaaatcccccagggctgggggacccaccccaaagggccgcctgctgggttccacctcctgccaccccccaagccaccctcctctacctgctaggacctgcagcaccagccagcggtgccctcccagagggccaggtggattcactgctttccatcatctccagccagagggagcgcttccgtgcccggaaccaggagcttgaggccgtgagtcacatccttctctccctgatgctccttgggcccaaggacacagttggggaacacacaggctttcaggagagagatgtggcacagaccgtaaacctcagggggaagagatttgttctgtgcagtcagggagggcttcctggaggaggtcatgccacactgggctttgaaagaagactcagatgctcacagtagaggagacacgggggccagtgagccagaagggagcatagatcattccaggtgaaacaagtcgccaggcaagtgccctcttgccaggctgggaggcatggccttcaatctgcagggaggggcaccaaggaaggatttaagccaggcagtggcactgcaagaatgcagggtgagccaggtgcggtggctcacacctgtaatcccaacactttgggaggctgaggcaagtggatcacttgaggttgggagtttgagaccagcctggccaacatggtgaaaccccgtctctactaaaaatacaaaaattagccgggcatggtggcgggcacctgtagtcccagctacttgggaggctgaggcaggaggatcgcttgaacctgggaggtagaggttgcagtgagctgatgagatcgtgccactgcactccagcctgtgtgacagagcaagactccatctcaaaaaaaaaaaaaaatccttcctttttaaggctgtataatattttattgtgcatatagaccacattttgtttatccattcacctattcatttacattgcctccaccttttggctgtggcgaataattctgctgtgaacatgggtgtataaatatctctccaagtctctgccttcaattcttttgggtatctacccagaagtggaattactagatcctatggtaattctatgtttaacgtttttagaggaagcgtcatactgccatatacttttttgtactgctcaagttttggttgtgtttgttttttgagacggagtcccgctctcttgcccaggctggagtgcagtggcacaatcctggctcactgcaacctccacctcctgggttcaagcgattcttctgcctcagcctcccggatagctgagattacaggcgtctgccatcacacccagctaatttttgtatttttagtagagacaggatttctccatattggccaggctggtctcgaactcctgacctcaggtgatctgcccacctcagcctcctaaagtgctgggattacaggcgtgagccaccgcgctggccactgcttgaattttgaatagtgtgaaagaaacacttattcaagcatttgaataaattgaaaactgagattccatttcacgttgcctttagattggcaaatattaaaaccacagcgtgtgattccatgaatacgaacattcggtataggcaaatccatagagacaaaaaagagactgccggttaccaggcagtaggggaggagggaatggggagtgactgctggcaggtttggggtttcttattggggtgattttaaatgttctggaattaggtagtggggatggttgcataacattgtgaatacaaatgaccgaactgtacactttgaaatgctgatgtttatgttatgggtattatatctcaataatagtttttaaaaggctaataccaatgacaaaaaaaagtatgaagaaatctgaccaggcatcgtggctcatgcctgtaatcccagcacattgggaggccgaagtgggaagattgcttgagcccaggagtttgagaccagcctgggcaacgcagtgagaccccgactctgcaaaaataaaaaagtagctgggcatggtggtgtgagcctatagtcccagctacctgggaggcagagatgggaggatcgcttgagtcgggaggctgaggctgcagtgagctctggtcatgccactttattctagcctgggtgatagagcaagaccctgtctctaaaatatatagacaggggccaggcgcagcagctcacgcctataatcccaacactttgggaggcagagatgggtggatcacctgagatcaggagttcgagaccagcctgaacaaaatggtaaaaccctgtctttactaaatacaaaaaaactagccaggcatggtggcacatgcctgtaatcccagctacttgggaggctgaggcaggagaatcgcttgaacccgggaggcagaggttgcagtgagccgagattgattgcgtcgttgcactccagcctgggcaacaagagcgaaactccatatcaaaaaaataataaaaataaaaataaaaaataaaataaaatatatagacagggtcttgctctgtcatatattaaggttgatgcaaatgtaatcatggtgtttgccattacttttaagggcaaaaaccacgattacatttgcaccaacgtgatacatatgaagaaacctgacccaagatccctgacttctgcctgtggtggggccacagtgggggaaggggcagctttacagagtcaggcaggtcaaggagaaggctgtgggcacagaaggggctccaggtagacggagcagcacctgtgccagcacggaggcctctcccccacccctttccttgcccctccccccccaggagaaccgcctggcccagcacaccctccaggccctgcagagtgagctggacagcctgcgcgccgacaacatcaagctctttgagaagatcaagttcctgcagagctaccctggccgggtgagggccctcccctggcctcagctccaggtggaccaggcagggagagaggccgatcagggctctggagatgggagggtcggggaccaagacctgctgggcagcactgggccccagagacccctgaggccttccgacatctccccacccacccacctgcctgctagctgccctccctaagccggcagaagctcacagagtggagcccctgtccagattcattcataaaaactggccagaaggaccaggcacggtggctcatgcctgtcatcccaccactgtgggaggccgaggcaggagaattgcctgagctcagaagttcgagaccagcctggccaatatggtgaaaccccgtctctactaaaaatacaaaaaaagtatccgggcatggtggtgcacacctgtagtcccagctactcaggaggctgaggcaggagaatcgctggaacccaggaggcggaggtttcagtgagccaagatcacaccactgcactccagcctgggcaacaagagcgaaactccgtctcaaaaataaaataaaataaaaataaataaaataaaattaaaataaaataaaataaaataaaataaaataaaataaaaaaataaaatataaaataaaataaaatataaaataaaataaataaaataaaataataaaatagtaaagtaaaataaaataataataaataaaataaaataaaatagaaaagaaaatactagccagaagggccaggcacagtggctcatgcctgtaatcccagcaccgtgagaggccgaggcgggtggagtttgagaccagcctggccgacatagtgaaaccctatctctactgaaaatacaaaaattagccaggcatcgtggcacgtgcctgtagtcccagctactcaggaggctgaggtgggaggatcacttgagcccaggaggtacaggctgcagtgagctgagatccagccactacactccagcccaggtgacagagcaagaccctgcctccaaaaaataaaaataaataggctgggcatggtggctcaggcctgtaatcccagcggtttgggaggctgaggcgggcggatcatttgaggtcaggagttccagaccagcctggccaacatagtgaaaccccgtctctactaaaaatataaaaattggctgggcgtggtatcatgcacctgtaatcccagctactcaggcggctaaggcaggagaatcgcttgaacctgagaggtggaggttgcagtgagccgaggtcacaccattgcgctccagcctgggcgacagagcgaaactctgtctcaaataaataaataagcaataataaaaaatgtaaacagaatttggtccacactccaaaaagcaaccaagagagtggatcagaaactcacttgccgagtttttctgggctagggaggcctgtgcgtggcttctctcagcccccaggcctcccaggggccaccccgtgccaggaaaccctttctatgagtgagagaagagcgtggggcatagtggggcagggattcacctctccctcttcctttggggcccagcagcccccagccctgtccccacccatcagagccgctccttggccaccagagggcactcagactctgcaaaccagcctggctctgggtggccagctggggggcgtctcctctcccagctgcctgcctgctcgcatgaccaccccacactcccagcaaacccaccttcctgcagctgcgcccggccctgcctgggcctcagttccccatctgtgcccggaggcactgtggccctgaccccatgggtaactccatgcccctgtggcaggaggcaccagccacattcacattgtcaccccagcaccctctcctcccgcctctgagatctagggctccctcccccacttcccttttttgcagatgaggaaactgaggctcccctgggctcctgcccttcccgctgggccccaaggcactgactggttctcttcccctcctgtctgtgcagggcagcggcagtgatgacacggagctgcggtactcgtcccagtacgaggagcgcctggaccccttctcctccttcagcaagcgggttcgtgagcccagcctgggcaggggaggggaggggcatcagcccagggaagcccaggggtccccccatcacttggcccccatccctgagcactcggccttccctggctcccctccacctgccctcgtctgggtgctctcggccagccttgccacgccagccctgcacaccctggcccctcaggccaggagcccccccaagacagcctccccaccgcttcagtgcaatgtaggcccagggcccattcaggaacacctgccgaggactacccgagggtgtgtggcagtgaccgggttaacctggagtgcatttgcgggacaggcagacaaggaaaaaccagttacagctcccagaatcgggcgatccattgtggggaccccaccccacaactcccctcccccacccagactgcagaagttctgcccgtggagtactttcccatgggcagaatggacggctgcagaggcggggaggggctctcacagatgtcaggggagtccagaatgtcacactgagtagactgtgcacccagggaagcccctggcagcaccctggcagccccctgggggtctgcaagaacagcgggcagggtgtcctgtggctggccaggccctgctctctgccacaagccagggcctgtgaggtcctttggggtcctttcctgactgtccctccctgtgcaggagcggcagaggaagtacctgagcttgagtccctgggacaaggccaccctcagcatggtgagtccctgcccctacccaccccctccctggacaggcctgagcctctgtctccaggcacctcttcacctgccctgcagcccaggctggaggagccgccagccctgccaagagtggctgtgtgatctgggacagggtctctccccttcccgggcagatcctctgagagcatggttcacagcatggttctgaactgggctgtagagggggcattcctcagaattcctgcagcctagagtcagacatggtggctcacacctgtcatcccagcactttgggaggtgggaggattgcttgagcccaggagttcgagaccagcctgggcaacacagtaagatcctgtctctacaaaaaataaaattagccaggcgcagtggtgtgcacctgtagtcccagctactcaggaggctgacggaggaggatcacttgagcctaggaagtcaatgctacagtgagctgtgaccactacattccagcctgggcaaccttgtctaaaaaaacgtttttaaagaattccggtggccgggcacagcagctcacgcctgtaatctcagcactttgggaggccaagttgggcggatcacctgaggtctggagttcgagaccagcctggccaacatagtgaaaccctatctctagtaaaaatacaaaaattagctgggcgtggtgacgcacacctgtaatcccagctactcaggaggctgaggcaggagaatcacttgaacccaggaggtggaggttgcagtgagccaagatcacaccactgcactccagcctgggcgacagagggagactctgtctcaaaaaaaaaagaattccagcagcccatgtccctggcccataatgatggaataggggccccagcttcctgtcccttccctccccttgccaccctagggccctttctgtgaagcccaggcagccctgcaggggtgggtgaggccggccccatccccactcaccccctccttgctcccaggggcgtctggttctctccaacaagatggcgcgcaccatcggcttcttctacacactgttcctgcactgcctggtcttcctggtgagtgtgcacacgggcgggccagaggcacattcaccatccccagccctgacctccagggcagcaggggcctgttacggtggcctggcccctgggcctaccccaagctgcatctctagcttgcgaccatgcctctccccttcgagagccttggcccaccccagggacgagaaggacccaccccattgggacctctggccagggcaccagccgggccgctccgtgaaagaggcctggctgatcacatctgggactggtcctggacgggcttcataggaagaagggatggagtgggaagggagcaggtctaatgaactccaccaagggacagtcacgaagactgcacagagaaggggcgtcttgaactaacctccccagctgtggaggtggcgttctagttagcggataagggcctccatgtctgccaagttgggggagaagaggggtggaaggctgtgtctctggaaggatccagccttggggtctcctgtccccagcacagtcaagatggcccctacagagctaacctgggctcaagttctgaccccagggtccagcggctcctggcccttccaagggttggcccacagtattagaggaggtgcctccgtgtctgggcccatctgatcatctgcagaagcagtgggtgcaggaacatgtctaagacccacccgccccggagtctggggctcgagaacctttatgttccaggccaggcccaggggccatgggtgggctgcaggggtggccttgaggcgaacgggcagctcaccgtgtctccacctggccaggtgctctacaagctggcatggagcgagagcatggagagggactgtgccaccttctgcgccaagaagtgaggacccccacttgggccccccctcagccccacagcgagctcccagcacccccgcaacacccccgagttcctgcctcatgtcccccactccttagccctccatcacagccccccattctggccctccccctacccctactcccggtatccactacctcctagccccaccccatcacatggtacacaccccccttccccaacacacacactcggcctcagcaaagcttcccgtgtcccccaggttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggttgcagcca

SEQ ID NO: 776 - DNA, 468068 bp, Homo sapiens; identical to SEQ ID NO: 772
